United States Patent 9,216,205 (MODIFIED POLYNUCLEOTIDES ENCODING GRANULYSIN) - sequence listing, part 2

SEQ ID NO: 405 - DNA, 6219 bp, Homo sapiens
ccaggcggcgttgcggccccggccccggctccctgcgccgccgccgccgccgccgccagcgctagcgccagcagccgggcccgatcacccgccgcccggtgcccgccgccgcccgcgccagcaaccgggcccgatcacccgccgcccggtgcccgccgccgcccgcgccaccggcatggcgctccggggcttctgcagcgccgatggctccgacccgctctgggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccatgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaagggtgatcgtcttggacaaaggagaaatccaggagtacggcgccccatcggacctcctgcagcagagaggtcttttctacagcatggccaaagacgccggcttggtgtgagccccagagctggcatatctggtcagaactgcagggcctatatgccagcgcccagggaggagtcagtacccctggtaaaccaagcctcccacactgaaaccaaaacataaaaaccaaacccagacaaccaaaacatattcaaagcagcagccaccgccatccggtcccctgcctggaactggctgtgaagacccaggagagacagagatgcgaaccacccaaaacacgcacaccctgcccctggtgccctgagacagacacacagcctcacgcccccaggaatgcaagtggtttcctggtgcttcccacggaggagttttggcagccagacttctggaggaattggttgtatagaagatcctagtgaccaaattcagcctactgcctcggatctctccagccgaagtctgtggactgcaagtctttgagatgcttctggctcccatcacctctaacatccttgtctgggtctaccaggaacgcttcatttccttggggctgcagttttgtggttgaggggcctggagaaaatcattttctccccttggcagtgtcccagggccctggatggtcctcttaccaacatctggtcttccaggcactcaaaagctgggaaccagcatctcagcgccagctctaccagttctcgttttgggccagaggcagcctctgcactcccacgcctgtcctcctggaagggacctggttggactaacggctaacctggacctggaactgtagggccaggggattgtctcagggccgacgttccacctggggcttccctccccacccaccccgactccaggctttcccttttttcttttgttcaacattgtaagaacaatcaatgctgttattactgttcccaccatgattgatgtggggtaaatattaaggagatggcctcatgggaatttgaccttgactagaaatagagactgagagtgagcaaccagctggaaggtactatgccagtcctagcagaaaaatgtgttaggggcctggcccaaagcagtgttggttgcttacagtgttgattgattttgttcttttttcttaccacctcttttctttccctctcatggtacctgctcatggttatgaagctttcaaagtaaagaacacgaaatacctcccaagtattaccagtgggtaccaaaaaaatgtccccttgagtcttttccttgtttttagatgttaattctctcccttggcatccggttagccccccagggggggcagcattgtggagaacttgatatttagttactgatgctcttccaggacacgaaaagaacccatctttgaatatcaatgattttttttttttaagtactgttccggggagaaaaacagtctcaaaacttgaacttcttgggaatagaagtgttgggctgagaagtaacattcccaggaaatagtgagaagctcgccctgtgtttgaaaccgtgttggtctctgtgttcctggaagaaaacagggaagcagcatcttttaaagcctgttctttaaggtgtctcgttagagcccaaagtggaatccggaaggcagccagagctgaggctgccccaagactcagacttgctaagaattacgccgccgacttcaaacccagagagcatctttcttttaggcgaaaacgcatatatttattttttgtaagttataccattctttcacattagataaactaagttttgggggatccttttgtaatgacttacactggaaatgcgaacatttgcagtaaaaaaatatatatatatctatatattttatttctttctaaa

SEQ ID NO: 406 - DNA, 6387 bp, Homo sapiens
ccaggcggcgttgcggccccggccccggctccctgcgccgccgccgccgccgccgccagcgctagcgccagcagccgggcccgatcacccgccgcccggtgcccgccgccgcccgcgccagcaaccgggcccgatcacccgccgcccggtgcccgccgccgcccgcgccaccggcatggcgctccggggcttctgcagcgccgatggctccgacccgctctgggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccatgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagggcgtgaacctgtctgggggccagaagcagcgcgtgagcctggcccgggccgtgtactccaacgctgacatttacctcttcgatgatcccctctcagcagtggatgcccatgtgggaaaacacatctttgaaaatgtgattggccccaaggggatgctgaagaacaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaagggtgatcgtcttggacaaaggagaaatccaggagtacggcgccccatcggacctcctgcagcagagaggtcttttctacagcatggccaaagacgccggcttggtgtgagccccagagctggcatatctggtcagaactgcagggcctatatgccagcgcccagggaggagtcagtacccctggtaaaccaagcctcccacactgaaaccaaaacataaaaaccaaacccagacaaccaaaacatattcaaagcagcagccaccgccatccggtcccctgcctggaactggctgtgaagacccaggagagacagagatgcgaaccacccaaaacacgcacaccctgcccctggtgccctgagacagacacacagcctcacgcccccaggaatgcaagtggtttcctggtgcttcccacggaggagttttggcagccagacttctggaggaattggttgtatagaagatcctagtgaccaaattcagcctactgcctcggatctctccagccgaagtctgtggactgcaagtctttgagatgcttctggctcccatcacctctaacatccttgtctgggtctaccaggaacgcttcatttccttggggctgcagttttgtggttgaggggcctggagaaaatcattttctccccttggcagtgtcccagggccctggatggtcctcttaccaacatctggtcttccaggcactcaaaagctgggaaccagcatctcagcgccagctctaccagttctcgttttgggccagaggcagcctctgcactcccacgcctgtcctcctggaagggacctggttggactaacggctaacctggacctggaactgtagggccaggggattgtctcagggccgacgttccacctggggcttccctccccacccaccccgactccaggctttcccttttttcttttgttcaacattgtaagaacaatcaatgctgttattactgttcccaccatgattgatgtggggtaaatattaaggagatggcctcatgggaatttgaccttgactagaaatagagactgagagtgagcaaccagctggaaggtactatgccagtcctagcagaaaaatgtgttaggggcctggcccaaagcagtgttggttgcttacagtgttgattgattttgttcttttttcttaccacctcttttctttccctctcatggtacctgctcatggttatgaagctttcaaagtaaagaacacgaaatacctcccaagtattaccagtgggtaccaaaaaaatgtccccttgagtcttttccttgtttttagatgttaattctctcccttggcatccggttagccccccagggggggcagcattgtggagaacttgatatttagttactgatgctcttccaggacacgaaaagaacccatctttgaatatcaatgattttttttttttaagtactgttccggggagaaaaacagtctcaaaacttgaacttcttgggaatagaagtgttgggctgagaagtaacattcccaggaaatagtgagaagctcgccctgtgtttgaaaccgtgttggtctctgtgttcctggaagaaaacagggaagcagcatcttttaaagcctgttctttaaggtgtctcgttagagcccaaagtggaatccggaaggcagccagagctgaggctgccccaagactcagacttgctaagaattacgccgccgacttcaaacccagagagcatctttcttttaggcgaaaacgcatatatttattttttgtaagttataccattctttcacattagataaactaagttttgggggatccttttgtaatgacttacactggaaatgcgaacatttgcagtaaaaaaatatatatatatctatatattttatttctttctaaa

SEQ ID NO: 407 - DNA, 6594 bp, Homo sapiens
ccaggcggcgttgcggccccggccccggctccctgcgccgccgccgccgccgccgccagcgctagcgccagcagccgggcccgatcacccgccgcccggtgcccgccgccgcccgcgccagcaaccgggcccgatcacccgccgcccggtgcccgccgccgcccgcgccaccggcatggcgctccggggcttctgcagcgccgatggctccgacccgctctgggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccatgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagggctccgtggcctatgtgccacagcaggcctggattcagaatgattctctccgagaaaacatcctttttggatgtcagctggaggaaccatattacaggtccgtgatacaggcctgtgccctcctcccagacctggaaatcctgcccagtggggatcggacagagattggcgagaagggcgtgaacctgtctgggggccagaagcagcgcgtgagcctggcccgggccgtgtactccaacgctgacatttacctcttcgatgatcccctctcagcagtggatgcccatgtgggaaaacacatctttgaaaatgtgattggccccaaggggatgctgaagaacaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggcagcacagtgatggacgaggaggaagcaggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaagggtgatcgtcttggacaaaggagaaatccaggagtacggcgccccatcggacctcctgcagcagagaggtcttttctacagcatggccaaagacgccggcttggtgtgagccccagagctggcatatctggtcagaactgcagggcctatatgccagcgcccagggaggagtcagtacccctggtaaaccaagcctcccacactgaaaccaaaacataaaaaccaaacccagacaaccaaaacatattcaaagcagcagccaccgccatccggtcccctgcctggaactggctgtgaagacccaggagagacagagatgcgaaccacccaaaacacgcacaccctgcccctggtgccctgagacagacacacagcctcacgcccccaggaatgcaagtggtttcctggtgcttcccacggaggagttttggcagccagacttctggaggaattggttgtatagaagatcctagtgaccaaattcagcctactgcctcggatctctccagccgaagtctgtggactgcaagtctttgagatgcttctggctcccatcacctctaacatccttgtctgggtctaccaggaacgcttcatttccttggggctgcagttttgtggttgaggggcctggagaaaatcattttctccccttggcagtgtcccagggccctggatggtcctcttaccaacatctggtcttccaggcactcaaaagctgggaaccagcatctcagcgccagctctaccagttctcgttttgggccagaggcagcctctgcactcccacgcctgtcctcctggaagggacctggttggactaacggctaacctggacctggaactgtagggccaggggattgtctcagggccgacgttccacctggggcttccctccccacccaccccgactccaggctttcccttttttcttttgttcaacattgtaagaacaatcaatgctgttattactgttcccaccatgattgatgtggggtaaatattaaggagatggcctcatgggaatttgaccttgactagaaatagagactgagagtgagcaaccagctggaaggtactatgccagtcctagcagaaaaatgtgttaggggcctggcccaaagcagtgttggttgcttacagtgttgattgattttgttcttttttcttaccacctcttttctttccctctcatggtacctgctcatggttatgaagctttcaaagtaaagaacacgaaatacctcccaagtattaccagtgggtaccaaaaaaatgtccccttgagtcttttccttgtttttagatgttaattctctcccttggcatccggttagccccccagggggggcagcattgtggagaacttgatatttagttactgatgctcttccaggacacgaaaagaacccatctttgaatatcaatgattttttttttttaagtactgttccggggagaaaaacagtctcaaaacttgaacttcttgggaatagaagtgttgggctgagaagtaacattcccaggaaatagtgagaagctcgccctgtgtttgaaaccgtgttggtctctgtgttcctggaagaaaacagggaagcagcatcttttaaagcctgttctttaaggtgtctcgttagagcccaaagtggaatccggaaggcagccagagctgaggctgccccaagactcagacttgctaagaattacgccgccgacttcaaacccagagagcatctttcttttaggcgaaaacgcatatatttattttttgtaagttataccattctttcacattagataaactaagttttgggggatccttttgtaatgacttacactggaaatgcgaacatttgcagtaaaaaaatatatatatatctatatattttatttctttctaaa

SEQ ID NO: 408 - DNA, 6552 bp, Homo sapiens
ccaggcggcgttgcggccccggccccggctccctgcgccgccgccgccgccgccgccagcgctagcgccagcagccgggcccgatcacccgccgcccggtgcccgccgccgcccgcgccagcaaccgggcccgatcacccgccgcccggtgcccgccgccgcccgcgccaccggcatggcgctccggggcttctgcagcgccgatggctccgacccgctctgggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccatgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagggctccgtggcctatgtgccacagcaggcctggattcagaatgattctctccgagaaaacatcctttttggatgtcagctggaggaaccatattacaggtccgtgatacaggcctgtgccctcctcccagacctggaaatcctgcccagtggggatcggacagagattggcgagaagggcgtgaacctgtctgggggccagaagcagcgcgtgagcctggcccgggccgtgtactccaacgctgacatttacctcttcgatgatcccctctcagcagtggatgcccatgtgggaaaacacatctttgaaaatgtgattggccccaaggggatgctgaagaacaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaagggtgatcgtcttggacaaaggagaaatccaggagtacggcgccccatcggacctcctgcagcagagaggtcttttctacagcatggccaaagacgccggcttggtgtgagccccagagctggcatatctggtcagaactgcagggcctatatgccagcgcccagggaggagtcagtacccctggtaaaccaagcctcccacactgaaaccaaaacataaaaaccaaacccagacaaccaaaacatattcaaagcagcagccaccgccatccggtcccctgcctggaactggctgtgaagacccaggagagacagagatgcgaaccacccaaaacacgcacaccctgcccctggtgccctgagacagacacacagcctcacgcccccaggaatgcaagtggtttcctggtgcttcccacggaggagttttggcagccagacttctggaggaattggttgtatagaagatcctagtgaccaaattcagcctactgcctcggatctctccagccgaagtctgtggactgcaagtctttgagatgcttctggctcccatcacctctaacatccttgtctgggtctaccaggaacgcttcatttccttggggctgcagttttgtggttgaggggcctggagaaaatcattttctccccttggcagtgtcccagggccctggatggtcctcttaccaacatctggtcttccaggcactcaaaagctgggaaccagcatctcagcgccagctctaccagttctcgttttgggccagaggcagcctctgcactcccacgcctgtcctcctggaagggacctggttggactaacggctaacctggacctggaactgtagggccaggggattgtctcagggccgacgttccacctggggcttccctccccacccaccccgactccaggctttcccttttttcttttgttcaacattgtaagaacaatcaatgctgttattactgttcccaccatgattgatgtggggtaaatattaaggagatggcctcatgggaatttgaccttgactagaaatagagactgagagtgagcaaccagctggaaggtactatgccagtcctagcagaaaaatgtgttaggggcctggcccaaagcagtgttggttgcttacagtgttgattgattttgttcttttttcttaccacctcttttctttccctctcatggtacctgctcatggttatgaagctttcaaagtaaagaacacgaaatacctcccaagtattaccagtgggtaccaaaaaaatgtccccttgagtcttttccttgtttttagatgttaattctctcccttggcatccggttagccccccagggggggcagcattgtggagaacttgatatttagttactgatgctcttccaggacacgaaaagaacccatctttgaatatcaatgattttttttttttaagtactgttccggggagaaaaacagtctcaaaacttgaacttcttgggaatagaagtgttgggctgagaagtaacattcccaggaaatagtgagaagctcgccctgtgtttgaaaccgtgttggtctctgtgttcctggaagaaaacagggaagcagcatcttttaaagcctgttctttaaggtgtctcgttagagcccaaagtggaatccggaaggcagccagagctgaggctgccccaagactcagacttgctaagaattacgccgccgacttcaaacccagagagcatctttcttttaggcgaaaacgcatatatttattttttgtaagttataccattctttcacattagataaactaagttttgggggatccttttgtaatgacttacactggaaatgcgaacatttgcagtaaaaaaatatatatatatctatatatttta

SEQ ID NO: 409 - DNA, 5869 bp, Homo sapiens
tgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagggctccgtggcctatgtgccacagcaggcctggattcagaatgattctctccgagaaaacatcctttttggatgtcagctggaggaaccatattacaggtccgtgatacaggcctgtgccctcctcccagacctggaaatcctgcccagtggggatcggacagagattggcgagaagggcgtgaacctgtctgggggccagaagcagcgcgtgagcctggcccgggccgtgtactccaacgctgacatttacctcttcgatgatcccctctcagcagtggatgcccatgtgggaaaacacatctttgaaaatgtgattggccccaaggggatgctgaagaacaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggcagcacagtgatggacgaggaggaagcaggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaagggtgatcgtcttggacaaaggagaaatccaggagtacggcgccccatcggacctcctgcagcagagaggtcttttctacagcatggccaaagacgccggcttggtgtgagccccagagctggcatatctggtcagaactgcagggcctatatgccagcgcccagggaggagtcagtacccctggtaaaccaagcctcccacactgaaaccaaaacataaaaaccaaacccagacaaccaaaacatattcaaagcagcagccaccgccatccggtcccctgcctggaactggctgtgaagacccaggagagacagagatgcgaaccacccaaaacacgcacaccctgcccctggtgccctgagacagacacacagcctcacgcccccaggaatgcaagtggtttcctggtgcttcccacggaggagttttggcagccagacttctggaggaattggttgtatagaagatcctagtgaccaaattcagcctactgcctcggatctctccagccgaagtctgtggactgcaagtctttgagatgcttctggctcccatcacctctaacatccttgtctgggtctaccaggaacgcttcatttccttggggctgcagttttgtggttgaggggcctggagaaaatcattttctccccttggcagtgtcccagggccctggatggtcctcttaccaacatctggtcttccaggcactcaaaagctgggaaccagcatctcagcgccagctctaccagttctcgttttgggccagaggcagcctctgcactcccacgcctgtcctcctggaagggacctggttggactaacggctaacctggacctggaactgtagggccaggggattgtctcagggccgacgttccacctggggcttccctccccacccaccccgactccaggctttcccttttttcttttgttcaacattgtaagaacaatcaatgctgttattactgttcccaccatgattgatgtggggtaaatattaaggagatggcctcatgggaatttgaccttgactagaaatagagactgagagtgagcaaccagctggaaggtactatgccagtcctagcagaaaaatgtgttaggggcctggcccaaagcagtgttggttgcttacagtgttgattgattttgttcttttttcttaccacctcttttctttccctctcatggtacctgctcatggttatgaagctttcaaagtaaagaacacgaaatacctcccaagtattaccagtgggtaccaaaaaaatgtccccttgagtcttttccttgtttttagatgttaattctctcccttggcatccggttagccccccagggggggcagcattgtggagaacttgatatttagttactgatgctcttccaggacacgaaaagaacccatctttgaatatcaatgattttttttttttaagtactgttccggggagaaaaacagtctcaaaacttgaacttcttgggaatagaagtgttgggctgagaagtaacattcccaggaaatagtgagaagctcgccctgtgtttgaaaccgtgttggtctctgtgttcctggaagaaaacagggaagcagcatcttttaaagcctgttctttaaggtgtctcgttagagcccaaagtggaatccggaaggcagccagagctgaggctgccccaagactcagacttgctaagaattacgccgccgacttcaaacccagagagcatctttcttttaggcgaaaacgcatatatttattttttgtaagttataccattctttcacattagataaactaagttttgggggatccttttgtaatgacttacactggaaatgcgaacatttgcagtaaaaaaatatatatatatctatatattttatttctttct

SEQ ID NO: 410 - DNA, 4479 bp, Homo sapiens
actgcgttcagctctggcggtccacagcccgaagcgcggcttaggaagttcgtgtcagcgctgcctgagctcgtcccctggatgtccgggtctccccaggcggccacccgccggctcccatcgtgacctccagccgcagcgcctcccacgccggccgccgcgcgaggggagcgctcgggcgcgccgggtgtggttgggggaaggggttgtgccgcgcgcgggctgcgtgctgtgcccactcaaaaggttccgggcgcgcaggagggaagaggcagtgcccgccactcccactgagattgagagacgcggcaaggaggcagcctgtggaggaactgggtaggatttaggaacgcaccgtgcacatgcttggtggtcttgttaagtggaaactgctgctttagagtttgtttggaaggtccgggtgactcatcccaacatttacatccttaattgttaaagcgctgcctccgagcgcacgcatcctgagatcctgagcctttggttaagaccgagctctattaagctgaaaagataaaaactctccagatgtcttccagtaatgtcgaagtttttatcccagtgtcacaaggaaacaccaatggcttccccgcgacagcttccaatgacctgaaggcatttactgaaggagctgtgttaagttttcataacatctgctatcgagtaaaactgaagagtggctttctaccttgtcgaaaaccagttgagaaagaaatattatcgaatatcaatgggatcatgaaacctggtctcaacgccatcctgggacccacaggtggaggcaaatcttcgttattagatgtcttagctgcaaggaaagatccaagtggattatctggagatgttctgataaatggagcaccgcgacctgccaatttcaaatgtaattcaggttacgtggtacaagatgatgttgtgatgggcactctgacggtgagagaaaacttacagttctcagcagctcttcggcttgcaacaactatgacgaatcatgaaaaaaacgaacggattaacagggtcattcaagagttaggtctggataaagtggcagactccaaggttggaactcagtttatccgtggtgtgtctggaggagaaagaaaaaggactagtataggaatggagcttatcactgatccttccatcttgttcttggatgagcctacaactggcttagactcaagcacagcaaatgctgtccttttgctcctgaaaaggatgtctaagcagggacgaacaatcatcttctccattcatcagcctcgatattccatcttcaagttgtttgatagcctcaccttattggcctcaggaagacttatgttccacgggcctgctcaggaggccttgggatactttgaatcagctggttatcactgtgaggcctataataaccctgcagacttcttcttggacatcattaatggagattccactgctgtggcattaaacagagaagaagactttaaagccacagagatcatagagccttccaagcaggataagccactcatagaaaaattagcggagatttatgtcaactcctccttctacaaagagacaaaagctgaattacatcaactttccgggggtgagaagaagaagaagatcacagtcttcaaggagatcagctacaccacctccttctgtcatcaactcagatgggtttccaagcgttcattcaaaaacttgctgggtaatccccaggcctctatagctcagatcattgtcacagtcgtactgggactggttataggtgccatttactttgggctaaaaaatgattctactggaatccagaacagagctggggttctcttcttcctgacgaccaaccagtgtttcagcagtgtttcagccgtggaactctttgtggtagagaagaagctcttcatacatgaatacatcagcggatactacagagtgtcatcttatttccttggaaaactgttatctgatttattacccatgaggatgttaccaagtattatatttacctgtatagtgtacttcatgttaggattgaagccaaaggcagatgccttcttcgttatgatgtttacccttatgatggtggcttattcagccagttccatggcactggccatagcagcaggtcagagtgtggtttctgtagcaacacttctcatgaccatctgttttgtgtttatgatgattttttcaggtctgttggtcaatctcacaaccattgcatcttggctgtcatggcttcagtacttcagcattccacgatatggatttacggctttgcagcataatgaatttttgggacaaaacttctgcccaggactcaatgcaacaggaaacaatccttgtaactatgcaacatgtactggcgaagaatatttggtaaagcagggcatcgatctctcaccctggggcttgtggaagaatcacgtggccttggcttgtatgattgttattttcctcacaattgcctacctgaaattgttatttcttaaaaaatattcttaaatttccccttaattcagtatgatttatcctcacataaaaaagaagcactttgattgaagtattcaatcaagtttttttgttgttttctgttcccttgccatcacactgttgcacagcagcaattgttttaaagagatacatttttagaaatcacaacaaactgaattaaacatgaaagaacccaagacatcatgtatcgcatattagttaatctcctcagacagtaaccatggggaagaaatctggtctaatttattaatctaaaaaaggagaattgaattctggaaactcctgacaagttattactgtctctggcatttgtttcctcatctttaaaatgaataggtaggttagtagcccttcagtcttaatactttatgatgctatggtttgccattatttaataaatgacaaatgtattaatgctatactggaaatgtaaaattgaaaatatgttggaaaaaagattctgtcttatagggtaaaaaaagccaccgtgatagaaaaaaaatctttttgataagcacattaaagttaatagaacttactgatattcctgtctagtggtataatatctcaggaatcttggctgagggtttggaactgtgggtagagtagagggccaggagtccagtaatagaattcttgcaccatttctggaacattctagctctgggaggtcacgtaaccttcttggggtagttcagtggtttagtggtttataatccaggtgtgcgtcagaatcatctgaggaactttgctaaaatacaaaaatctggcctaagtagctccagatctaccttcataaaggaatctgaccactcctggatttggtaatttccaagttctgaaaattttacttaggatttaataactattaacatctgtccctacataggttttctttcctacttatataccttatgttctcttcattctaaccttcatcagtaatagggaaatgttttaattttatttttttagttgaagggtaatgtaccaaaaaatatagttcagtgaattaaaatgaacacacatgtgcaaccatcaattcaggtcaagaaatagaagattgtagcacacaaaagcctactcagccattctcccagtcactacttccttccttacccctgggttatttttgaaatgacacttgatgtatttccctctgttgctgttatgagaacattgctacagccaagtgttgtgtttctgtgtgcataggttgatacttaattatctccccactttttaataaacttttaatttggaaataattttagattgacagaaaagttgcaaagatagtgaggaaagttcctgtctactctttgctcagcttcccttaatgttaacattttatatagcaagatgcatttgtcaaagctaacaagttaacattggtacaatcactgttaattaaactgcacacaatattcagatttcaccacttttccactaatattctttcattgttctaggattcaattcaggagaccacatttcatctagccctcttttttaaaagtaaatacttttcagcacttacaggagttaactgagctggggcatcatggtgtatagacgccctgacactggtcatcttggaattcatttagtttgtcagtgggtgccctgacattctgtcacaacatcaatttgggaacatggcattatatttttatctttgaacttttttctttttggatgacatttgattaatgcgtcatcttggaacacattatcttttttcttggttatgtgatcaggaagattaatcagtttttcctgttcttggtataattcctgcttttcacatacctgtcccttacagttctctatatatacccttcccttattacacagagagaaatatctatctatactttttacacaaaatatacttcaaaagaaacaaaacagccacaattattaactttttaaataaatgagaatttaattata

SEQ ID NO: 411 - DNA, 4276 bp, Homo sapiens
gaaaaaaggaacccaaggagataggagagctgttaatttcactcgggacatttcctcgaggctagtttactcggaaagcctcaatgttccctggtagctgcaggatctactttgggggctgccaagtttcctctctcattctttctcctgccccaagagcaggcaggaaggaaagttcctggactgatactcgtctgtttagtaggcgtgggtcctggttgaagtctgtctaggaaaactcctaagtgtagaaatcttcttcgtattaccactgtctctgcactgagatttgggctgctttgcttccagcgtcacacatcataactgagaaagataaaaactctccagatgtcttccagtaatgtcgaagtttttatcccagtgtcacaaggaaacaccaatggcttccccgcgacagcttccaatgacctgaaggcatttactgaaggagctgtgttaagttttcataacatctgctatcgagtaaaactgaagagtggctttctaccttgtcgaaaaccagttgagaaagaaatattatcgaatatcaatgggatcatgaaacctggtctcaacgccatcctgggacccacaggtggaggcaaatcttcgttattagatgtcttagctgcaaggaaagatccaagtggattatctggagatgttctgataaatggagcaccgcgacctgccaatttcaaatgtaattcaggttacgtggtacaagatgatgttgtgatgggcactctgacggtgagagaaaacttacagttctcagcagctcttcggcttgcaacaactatgacgaatcatgaaaaaaacgaacggattaacagggtcattcaagagttaggtctggataaagtggcagactccaaggttggaactcagtttatccgtggtgtgtctggaggagaaagaaaaaggactagtataggaatggagcttatcactgatccttccatcttgttcttggatgagcctacaactggcttagactcaagcacagcaaatgctgtccttttgctcctgaaaaggatgtctaagcagggacgaacaatcatcttctccattcatcagcctcgatattccatcttcaagttgtttgatagcctcaccttattggcctcaggaagacttatgttccacgggcctgctcaggaggccttgggatactttgaatcagctggttatcactgtgaggcctataataaccctgcagacttcttcttggacatcattaatggagattccactgctgtggcattaaacagagaagaagactttaaagccacagagatcatagagccttccaagcaggataagccactcatagaaaaattagcggagatttatgtcaactcctccttctacaaagagacaaaagctgaattacatcaactttccgggggtgagaagaagaagaagatcacagtcttcaaggagatcagctacaccacctccttctgtcatcaactcagatgggtttccaagcgttcattcaaaaacttgctgggtaatccccaggcctctatagctcagatcattgtcacagtcgtactgggactggttataggtgccatttactttgggctaaaaaatgattctactggaatccagaacagagctggggttctcttcttcctgacgaccaaccagtgtttcagcagtgtttcagccgtggaactctttgtggtagagaagaagctcttcatacatgaatacatcagcggatactacagagtgtcatcttatttccttggaaaactgttatctgatttattacccatgaggatgttaccaagtattatatttacctgtatagtgtacttcatgttaggattgaagccaaaggcagatgccttcttcgttatgatgtttacccttatgatggtggcttattcagccagttccatggcactggccatagcagcaggtcagagtgtggtttctgtagcaacacttctcatgaccatctgttttgtgtttatgatggtctgttggtcaatctcacaaccattgcatcttggctgtcatggcttcagtacttcagcattccacgatatggatttacggctttgcagcataatgaatttttgggacaaaacttctgcccaggactcaatgcaacaggaaacaatccttgtaactatgcaacatgtactggcgaagaatatttggtaaagcagggcatcgatctctcaccctggggcttgtggaagaatcacgtggccttggcttgtatgattgttattttcctcacaattgcctacctgaaattgttatttcttaaaaaatattcttaaatttccccttaattcagtatgatttatcctcacataaaaaagaagcactttgattgaagtattcaatcaagtttttttgttgttttctgttcccttgccatcacactgttgcacagcagcaattgttttaaagagatacatttttagaaatcacaacaaactgaattaaacatgaaagaacccaagacatcatgtatcgcatattagttaatctcctcagacagtaaccatggggaagaaatctggtctaatttattaatctaaaaaaggagaattgaattctggaaactcctgacaagttattactgtctctggcatttgtttcctcatctttaaaatgaataggtaggttagtagcccttcagtcttaatactttatgatgctatggtttgccattatttaataaatgacaaatgtattaatgctatactggaaatgtaaaattgaaaatatgttggaaaaaagattctgtcttatagggtaaaaaaagccaccgtgatagaaaaaaaatctttttgataagcacattaaagttaatagaacttactgatattcctgtctagtggtataatatctcaggaatcttggctgagggtttggaactgtgggtagagtagagggccaggagtccagtaatagaattcttgcaccatttctggaacattctagctctgggaggtcacgtaaccttcttggggtagttcagtggtttagtggtttataatccaggtgtgcgtcagaatcatctgaggaactttgctaaaatacaaaaatctggcctaagtagctccagatctaccttcataaaggaatctgaccactcctggatttggtaatttccaagttctgaaaattttacttaggatttaataactattaacatctgtccctacataggttttctttcctacttatataccttatgttctcttcattctaaccttcatcagtaatagggaaatgttttaattttatttttttagttgaagggtaatgtaccaaaaaatatagttcagtgaattaaaatgaacacacatgtgcaaccatcaattcaggtcaagaaatagaagattgtagcacacaaaagcctactcagccattctcccagtcactacttccttccttacccctgggttatttttgaaatgacacttgatgtatttccctctgttgctgttatgagaacattgctacagccaagtgttgtgtttctgtgtgcataggttgatacttaattatctccccactttttaataaacttttaatttggaaataattttagattgacagaaaagttgcaaagatagtgaggaaagttcctgtctactctttgctcagcttcccttaatgttaacattttatatagcaagatgcatttgtcaaagctaacaagttaacattggtacaatcactgttaattaaactgcacacaatattcagatttcaccacttttccactaatattctttcattgttctaggattcaattcaggagaccacatttcatctagccctcttttttaaaagtaaatacttttcagcacttacaggagttaactgagctggggcatcatggtgtatagacgccctgacactggtcatcttggaattcatttagtttgtcagtgggtgccctgacattctgtcacaacatcaatttgggaacatggcattatatttttatctttgaacttttttctttttggatgacatttgattaatgcgtcatcttggaacacattatcttttttcttggttatgtgatcaggaagattaatcagtttttcctgttcttggtataattcctgcttttcacatacctgtcccttacagttctctatatatacccttcccttattacacagagagaaatatctatctatactttttacacaaaatatacttcaaaagaaacaaaacagccacaattattaactttttaaataaatgagaatttaattatatccta

SEQ ID NO: 412 - DNA, 2223 bp, Homo sapiens
acaaggcagcctcgctcgagcgcaggccaatcggctttctagctagagggtttaactcctatttaaaaagaagaacctttgaattctaacggctgagctcttggaagacttgggtccttgggtcgcagggtctcactccattgcccaggccagagtgcggggatatttgataagaaacttcagtgaaggccgggcgcggtggctcatgcccgtaatcccagcattttcggaggccgaggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcattcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggcatcctaatattcttagactgtatggttatttccatgatgctaccagagtctacctaattctggaatatgcaccacttggaacagtttatagagaacttcagaaactttcaaagtttgatgagcagagaactgctacttatataacagaattggcaaatgccctgtcttactgtcattcgaagagagttattcatagagacattaagccagagaacttacttcttggatcagctggagagcttaaaattgcagattttgggtggtcagtacatgctccatcttccaggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggttgaattcacattccctgactttgtaacagagggagccagggacctcatttcaagactgttgaagcataatcccagccagaggccaatgctcagagaagtacttgaacacccctggatcacagcaaattcatcaaaaccatcaaattgccaaaacaaagaatcagctagcaaacagtcttaggaatcgtgcagggggagaaatccttgagccagggctgccatataacctgacaggaacatgctactgaagtttattttaccattgactgctgccctcaatctagaacgctacacaagaaatatttgttttactcagcaggtgtgccttaacctccctattcagaaagctccacatcaataaacatgacactctgaagtgaaagtagccacgagaattgtgctacttatactggttcataatctggaggcaaggttcgactgcagccgccccgtcagcctgtgctaggcatggtgtcttcacaggaggcaaatccagagcctggctgtggggaaagtgaccactctgccctgaccccgatcagttaaggagctgtgcaataaccttcctagtacctgagtgagtgtgtaacttattgggttggcgaagcctggtaaagctgttggaatgagtatgtgattctttttaagtatgaaaataaagatatatgtacagacttgtattttttctctggtggcattcctttaggaatgctgtgtgtctgtccggcaccccggtaggcctgattgggtttctagtcctccttaaccacttatctcccatatgagagtgtgaaaaataggaacacgtgctctacctccatttagggatttgcttgggatacagaagaggccatgtgtctcagagctgttaagggcttatttttttaaaacattggagtcatagcatgtgtgtaaactttaaatatgcaaataaataagtatctatgtc

SEQ ID NO: 413 - DNA, 2248 bp, Homo sapiens
ggctgagctcttggaagacttgggtccttgggtcgcaggtgggagccgacgggtgggtagaccgtgggggatatctcagtggcggacgaggacggcggggacaaggggcggctggtcggagtggcggagcgtcaagtcccctgtcggttcctccgtccctgagtgtccttggcgctgccttgtgcccgcccagcgcctttgcatccgctcctgggcaccgaggcgccctgtaggatactgcttgttacttattacagctagaggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcattcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggcatcctaatattcttagactgtatggttatttccatgatgctaccagagtctacctaattctggaatatgcaccacttggaacagtttatagagaacttcagaaactttcaaagtttgatgagcagagaactgctacttatataacagaattggcaaatgccctgtcttactgtcattcgaagagagttattcatagagacattaagccagagaacttacttcttggatcagctggagagcttaaaattgcagattttgggtggtcagtacatgctccatcttccaggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggttgaattcacattccctgactttgtaacagagggagccagggacctcatttcaagactgttgaagcataatcccagccagaggccaatgctcagagaagtacttgaacacccctggatcacagcaaattcatcaaaaccatcaaattgccaaaacaaagaatcagctagcaaacagtcttaggaatcgtgcagggggagaaatccttgagccagggctgccatataacctgacaggaacatgctactgaagtttattttaccattgactgctgccctcaatctagaacgctacacaagaaatatttgttttactcagcaggtgtgccttaacctccctattcagaaagctccacatcaataaacatgacactctgaagtgaaagtagccacgagaattgtgctacttatactggttcataatctggaggcaaggttcgactgcagccgccccgtcagcctgtgctaggcatggtgtcttcacaggaggcaaatccagagcctggctgtggggaaagtgaccactctgccctgaccccgatcagttaaggagctgtgcaataaccttcctagtacctgagtgagtgtgtaacttattgggttggcgaagcctggtaaagctgttggaatgagtatgtgattctttttaagtatgaaaataaagatatatgtacagacttgtattttttctctggtggcattcctttaggaatgctgtgtgtctgtccggcaccccggtaggcctgattgggtttctagtcctccttaaccacttatctcccatatgagagtgtgaaaaataggaacacgtgctctacctccatttagggatttgcttgggatacagaagaggccatgtgtctcagagctgttaagggcttatttttttaaaacattggagtcatagcatgtgtgtaaactttaaatatgcaaataaataagtatctatgtc

SEQ ID NO: 414 - DNA, 2112 bp, Homo sapiens
cttggaagacttgggtccttgggtcgcaggctggagtgcaatggtgtgatctcagctcactgcaacctctgcttcctgggtttaagtgattctcctgcctcagcctcccgagtagctgggattacaggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcattcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggcatcctaatattcttagactgtatggttatttccatgatgctaccagagtctacctaattctggaatatgcaccacttggaacagtttatagagaacttcagaaactttcaaagtttgatgagcagagaactgctacttatataacagaattggcaaatgccctgtcttactgtcattcgaagagagttattcatagagacattaagccagagaacttacttcttggatcagctggagagcttaaaattgcagattttgggtggtcagtacatgctccatcttccaggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggttgaattcacattccctgactttgtaacagagggagccagggacctcatttcaagactgttgaagcataatcccagccagaggccaatgctcagagaagtacttgaacacccctggatcacagcaaattcatcaaaaccatcaaattgccaaaacaaagaatcagctagcaaacagtcttaggaatcgtgcagggggagaaatccttgagccagggctgccatataacctgacaggaacatgctactgaagtttattttaccattgactgctgccctcaatctagaacgctacacaagaaatatttgttttactcagcaggtgtgccttaacctccctattcagaaagctccacatcaataaacatgacactctgaagtgaaagtagccacgagaattgtgctacttatactggttcataatctggaggcaaggttcgactgcagccgccccgtcagcctgtgctaggcatggtgtcttcacaggaggcaaatccagagcctggctgtggggaaagtgaccactctgccctgaccccgatcagttaaggagctgtgcaataaccttcctagtacctgagtgagtgtgtaacttattgggttggcgaagcctggtaaagctgttggaatgagtatgtgattctttttaagtatgaaaataaagatatatgtacagacttgtattttttctctggtggcattcctttaggaatgctgtgtgtctgtccggcaccccggtaggcctgattgggtttctagtcctccttaaccacttatctcccatatgagagtgtgaaaaataggaacacgtgctctacctccatttagggatttgcttgggatacagaagaggccatgtgtctcagagctgttaagggcttatttttttaaaacattggagtcatagcatgtgtgtaaactttaaatatgcaaataaataagtatctatgtc

SEQ ID NO: 415 - DNA, 1902 bp, Homo sapiens
gaattctaacggctgagctcttggaagacttgggtccttgggtcgcaggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcattcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggcatcctaatattcttagactgtatggttatttccatgatgctaccagagtctacctaattctggaatatgcaccacttggaacagtttatagagaacttcagaaactttcaaagtttgatgagcagagaactgctacttatataacagaattggcaaatgccctgtcttactgtcattcgaagagagttattcatagagacattaagccagagaacttacttcttggatcagctggagagcttaaaattgcagattttgggtggtcagtacatgctccatcttccaggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggtaagacgcaactgaaaaggacccagcacatctgctggaattctttccttatcagcctgaactgcaggccaagatccgaacatctatactatttgatctctctaacctgtgttttgtgatattttatcatttgttgtactccaggttgaattcacattccctgactttgtaacagagggagccagggacctcatttcaagactgttgaagcataatcccagccagaggccaatgctcagagaagtacttgaacacccctggatcacagcaaattcatcaaaaccatcaaattgccaaaacaaagaatcagctagcaaacagtcttaggaatcgtgcagggggagaaatccttgagccagggctgccatataacctgacaggaacatgctactgaagtttattttaccattgactgctgccctcaatctagaacgctacacaagaaatatttgttttactcagcaggtgtgccttaacctccctattcagaaagctccacatcaataaacatgacactctgaagtgaaagtagccacgagaattgtgctacttatactggttcataatctggaggcaaggttcgactgcagccgccccgtcagcctgtgctaggcatggtgtcttcacaggaggcaaatccagagcctggctgtggggaaagtgaccactctgccctgaccccgatcagttaaggagctgtgcaataaccttcctagtacctgagtgagtgtgtaacttattgggttggcgaagcctggtaaagctgttggaatgagtatgtgattctttttaagtatgaaaataaagatatatgtacaga

SEQ ID NO: 416 - DNA, 2547 bp, Homo sapiens
acaaggcagcctcgctcgagcgcaggccaatcggctttctagctagagggtttaactcctatttaaaaagaagaacctttgaattctaacggctgagctcttggaagacttgggtccttgggtcgcaggtgggagccgacgggtgggtagaccgtgggggatatctcagtggcggacgaggacggcggggacaaggggcggctggtcggagtggcggagcgtcaagtcccctgtcggttcctccgtccctgagtgtccttggcgctgccttgtgcccgcccagcgcctttgcatccgctcctgggcaccgaggcgccctgtaggatactgcttgttacttattacagctagagggtctcactccattgcccaggccagagtgcggggatatttgataagaaacttcagtgaaggccgggcgcggtggctcatgcccgtaatcccagcattttcggaggccgaggctggagtgcaatggtgtgatctcagctcactgcaacctctgcttcctgggtttaagtgattctcctgcctcagcctcccgagtagctgggattacaggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcattcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggcatcctaatattcttagactgtatggttatttccatgatgctaccagagtctacctaattctggaatatgcaccacttggaacagtttatagagaacttcagaaactttcaaagtttgatgagcagagaactgctacttatataacagaattggcaaatgccctgtcttactgtcattcgaagagagttattcatagagacattaagccagagaacttacttcttggatcagctggagagcttaaaattgcagattttgggtggtcagtacatgctccatcttccaggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggttgaattcacattccctgactttgtaacagagggagccagggacctcatttcaagactgttgaagcataatcccagccagaggccaatgctcagagaagtacttgaacacccctggatcacagcaaattcatcaaaaccatcaaattgccaaaacaaagaatcagctagcaaacagtcttaggaatcgtgcagggggagaaatccttgagccagggctgccatataacctgacaggaacatgctactgaagtttattttaccattgactgctgccctcaatctagaacgctacacaagaaatatttgttttactcagcaggtgtgccttaacctccctattcagaaagctccacatcaataaacatgacactctgaagtgaaagtagccacgagaattgtgctacttatactggttcataatctggaggcaaggttcgactgcagccgccccgtcagcctgtgctaggcatggtgtcttcacaggaggcaaatccagagcctggctgtggggaaagtgaccactctgccctgaccccgatcagttaaggagctgtgcaataaccttcctagtacctgagtgagtgtgtaacttattgggttggcgaagcctggtaaagctgttggaatgagtatgtgattctttttaagtatgaaaataaagatatatgtacagacttgtattttttctctggtggcattcctttaggaatgctgtgtgtctgtccggcaccccggtaggcctgattgggtttctagtcctccttaaccacttatctcccatatgagagtgtgaaaaataggaacacgtgctctacctccatttagggatttgcttgggatacagaagaggccatgtgtctcagagctgttaagggcttatttttttaaaacattggagtcatagcatgtgtgtaaactttaaatatgcaaataaataagtatctatgtct

SEQ ID NO: 417 - DNA, 2145 bp, Homo sapiens
gaattctaacggctgagctcttggaagacttgggtccttgggtcgcaggtgggagccgacgggctggagtgcaatggtgtgatctcagctcactgcaacctctgcttcctgggtttaagtgattctcctgcctcagcctcccgagtagctgggattacaggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcattcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggcatcctaatattcttagactgtatggttatttccatgatgctaccagagtctacctaattctggaatatgcaccacttggaacagtttatagagaacttcagaaactttcaaagtttgatgagcagagaactgctacttatataacagaattggcaaatgccctgtcttactgtcattcgaagagagttattcatagagacattaagccagagaacttacttcttggatcagctggagagcttaaaattgcagattttgggtggtcagtacatgctccatcttccaggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggttgaattcacattccctgactttgtaacagagggagccagggacctcatttcaagactgttgaagcataatcccagccagaggccaatgctcagagaagtacttgaacacccctggatcacagcaaattcatcaaaaccatcaaattgccaaaacaaagaatcagctagcaaacagtcttaggaatcgtgcagggggagaaatccttgagccagggctgccatataacctgacaggaacatgctactgaagtttattttaccattgactgctgccctcaatctagaacgctacacaagaaatatttgttttactcagcaggtgtgccttaacctccctattcagaaagctccacatcaataaacatgacactctgaagtgaaagtagccacgagaattgtgctacttatactggttcataatctggaggcaaggttcgactgcagccgccccgtcagcctgtgctaggcatggtgtcttcacaggaggcaaatccagagcctggctgtggggaaagtgaccactctgccctgaccccgatcagttaaggagctgtgcaataaccttcctagtacctgagtgagtgtgtaacttattgggttggcgaagcctggtaaagctgttggaatgagtatgtgattctttttaagtatgaaaataaagatatatgtacagacttgtattttttctctggtggcattcctttaggaatgctgtgtgtctgtccggcaccccggtaggcctgattgggtttctagtcctccttaaccacttatctcccatatgagagtgtgaaaaataggaacacgtgctctacctccatttagggatttgcttgggatacagaagaggccatgtgtctcagagctgttaagggcttatttttttaaaacattggagtcatagcatgtgtgtaaactttaaatatgcaaataaataagtatctatgtc

SEQ ID NO: 418 - DNA, 2169 bp, Homo sapiens
cttaaacgcgactcaaggcgtcgggtttgttgtcaaccaatcacaaggcagcctcgctcgagcgcaggccaatcggctttctagctagagggtttaactcctatttaaaaagaagaacctttgaattctaacggctgagctcttggaagacttgggtccttgggtcgcaggtgggagccgacgggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcattcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggcatcctaatattcttagactgtatggttatttccatgatgctaccagagtctacctaattctggaatatgcaccacttggaacagtttatagagaacttcagaaactttcaaagtttgatgagcagagaactgctacttatataacagaattggcaaatgccctgtcttactgtcattcgaagagagttattcatagagacattaagccagagaacttacttcttggatcagctggagagcttaaaattgcagattttgggtggtcagtacatgctccatcttccaggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggttgaattcacattccctgactttgtaacagagggagccagggacctcatttcaagactgttgaagcataatcccagccagaggccaatgctcagagaagtacttgaacacccctggatcacagcaaattcatcaaaaccatcaaattgccaaaacaaagaatcagctagcaaacagtcttaggaatcgtgcagggggagaaatccttgagccagggctgccatataacctgacaggaacatgctactgaagtttattttaccattgactgctgccctcaatctagaacgctacacaagaaatatttgttttactcagcaggtgtgccttaacctccctattcagaaagctccacatcaataaacatgacactctgaagtgaaagtagccacgagaattgtgctacttatactggttcataatctggaggcaaggttcgactgcagccgccccgtcagcctgtgctaggcatggtgtcttcacaggaggcaaatccagagcctggctgtggggaaagtgaccactctgccctgaccccgatcagttaaggagctgtgcaataaccttcctagtacctgagtgagtgtgtaacttattgggttggcgaagcctggtaaagctgttggaatgagtatgtgattctttttaagtatgaaaataaagatatatgtacagacttgtattttttctctggtggcattcctttaggaatgctgtgtgtctgtccggcaccccggtaggcctgattgggtttctagtcctccttaaccacttatctcccatatgagagtgtgaaaaataggaacacgtgctctacctccatttagggatttgcttgggatacagaagaggccatgtgtctcagagctgttaagggcttatttttttaaaacattggagtcatagcatgtgtgtaaactttaaatatgcaaataaataagtatctatgtc

SEQ ID NO: 419 - DNA, 2238 bp, Homo sapiens
acaaggcagcctcgctcgagcgcaggccaatcggctttctagctagagggtttaactcctatttaaaaagaagaacctttgaattctaacggctgagctcttggaagacttgggtccttgggtcgcaggtgggagccgacggggtctcactccattgcccaggccagagtgcggggatatttgataagaaacttcagtgaaggccgggcgcggtggctcatgcccgtaatcccagcattttcggaggccgaggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcattcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggcatcctaatattcttagactgtatggttatttccatgatgctaccagagtctacctaattctggaatatgcaccacttggaacagtttatagagaacttcagaaactttcaaagtttgatgagcagagaactgctacttatataacagaattggcaaatgccctgtcttactgtcattcgaagagagttattcatagagacattaagccagagaacttacttcttggatcagctggagagcttaaaattgcagattttgggtggtcagtacatgctccatcttccaggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggttgaattcacattccctgactttgtaacagagggagccagggacctcatttcaagactgttgaagcataatcccagccagaggccaatgctcagagaagtacttgaacacccctggatcacagcaaattcatcaaaaccatcaaattgccaaaacaaagaatcagctagcaaacagtcttaggaatcgtgcagggggagaaatccttgagccagggctgccatataacctgacaggaacatgctactgaagtttattttaccattgactgctgccctcaatctagaacgctacacaagaaatatttgttttactcagcaggtgtgccttaacctccctattcagaaagctccacatcaataaacatgacactctgaagtgaaagtagccacgagaattgtgctacttatactggttcataatctggaggcaaggttcgactgcagccgccccgtcagcctgtgctaggcatggtgtcttcacaggaggcaaatccagagcctggctgtggggaaagtgaccactctgccctgaccccgatcagttaaggagctgtgcaataaccttcctagtacctgagtgagtgtgtaacttattgggttggcgaagcctggtaaagctgttggaatgagtatgtgattctttttaagtatgaaaataaagatatatgtacagacttgtattttttctctggtggcattcctttaggaatgctgtgtgtctgtccggcaccccggtaggcctgattgggtttctagtcctccttaaccacttatctcccatatgagagtgtgaaaaataggaacacgtgctctacctccatttagggatttgcttgggatacagaagaggccatgtgtctcagagctgttaagggcttatttttttaaaacattggagtcatagcatgtgtgtaaactttaaatatgcaaataaataagtatctatgtct

SEQ ID NO: 420 - DNA, 2114 bp, Homo sapiens
cacaaggcagcctcgctcgagcgcaggccaatcggctttctagctagagggtttaactcctatttaaaaagaagaacctttgaattctaacggctgagctcttggaagacttgggtccttgggtcgcaggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcattcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggcatcctaatattcttagactgtatggttatttccatgatgctaccagagtctacctaattctggaatatgcaccacttggaacagtttatagagaacttcagaaactttcaaagtttgatgagcagagaactgctacttatataacagaattggcaaatgccctgtcttactgtcattcgaagagagttattcatagagacattaagccagagaacttacttcttggatcagctggagagcttaaaattgcagattttgggtggtcagtacatgctccatcttccaggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggttgaattcacattccctgactttgtaacagagggagccagggacctcatttcaagactgttgaagcataatcccagccagaggccaatgctcagagaagtacttgaacacccctggatcacagcaaattcatcaaaaccatcaaattgccaaaacaaagaatcagctagcaaacagtcttaggaatcgtgcagggggagaaatccttgagccagggctgccatataacctgacaggaacatgctactgaagtttattttaccattgactgctgccctcaatctagaacgctacacaagaaatatttgttttactcagcaggtgtgccttaacctccctattcagaaagctccacatcaataaacatgacactctgaagtgaaagtagccacgagaattgtgctacttatactggttcataatctggaggcaaggttcgactgcagccgccccgtcagcctgtgctaggcatggtgtcttcacaggaggcaaatccagagcctggctgtggggaaagtgaccactctgccctgaccccgatcagttaaggagctgtgcaataaccttcctagtacctgagtgagtgtgtaacttattgggttggcgaagcctggtaaagctgttggaatgagtatgtgattctttttaagtatgaaaataaagatatatgtacagacttgtattttttctctggtggcattcctttaggaatgctgtgtgtctgtccggcaccccggtaggcctgattgggtttctagtcctccttaaccacttatctcccatatgagagtgtgaaaaataggaacacgtgctctacctccatttagggatttgcttgggatacagaagaggccatgtgtctcagagctgttaagggcttatttttttaaaacattggagtcatagcatgtgtgtaaactttaaatatgcaaataaataagtatctatgtc

SEQ ID NO: 421 - DNA, 879 bp, Homo sapiens
aatcggctttctagctagagggtttaactcctatttaaaaagaagaacctttgaattctaacggctgagctcttggaagacttgggtccttgggtcgcagggtctcactccattgcccaggccagagtgcggggatatttgataagaaacttcagtgaaggccgggcgcggtggctcatgcccgtaatcccagcattttcggaggccgaggctggagtgcaatggtgtgatctcagctcactgcaacctctgcttcctgggtttaagtgattctcctgcctcagcctcccgagtagctgggattacaggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcattcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcg

SEQ ID NO: 422 - DNA, 744 bp, Homo sapiens
ctcagtggcggacgaggacggcggggacaaggggcggctggtcggagtggcggagcgtcaagtcccctgtcggttcctccgtccctgagtgtccttggcgctgccttgtgcccgcccagcgcctttgcatccgctcctgggcaccgaggcgccctgtaggatactgcttgttacttattacagctagagggtctcactccattgcccaggccagagtgcggggatatttgataagaaacttcagtgaaggccgggcgcggtggctcatgcccgtaatcccagcattttcggaggccgaggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcattcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgt

SEQ ID NO: 423 - DNA, 991 bp, Homo sapiens
gaattctaacggctgagctcttggaagacttgggtccttgggtcgcaggtgggagccgacggggtctcactccattgcccaggccagagtgcggggatatttgataagaaacttcagtgaaggccgggcgcggtggctcatgcccgtaatcccagcattttcggaggccgaggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcattcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggcatcctaatattcttagactgtatggttatttccatgatgctaccagagtctacctaattctggaatatgcaccacttggaacagtttatagagaacttcagaaactttcaaagtttgatgagcagagaactgctacttatataacagaattggcaaatgccctgtcttactgtcattcgaagagagttattcatagagacattaagccagagaacttacttcttggatcagctggagagcttaaaa

SEQ ID NO: 424 - DNA, 584 bp, Homo sapiens
tgagctcttggaagacttgggtccttgggtcgcagggtctcactccattgcccaggccagagtgcggggatatttgataagaaacttcagtgaaggccgggcgcggtggctcatgcccgtaatcccagcattttcggaggccgagcaggtatgccagtaggctgcacagggatggaagtgatccattagaggagagatgatggagcagcaagaccatcaggagtgaagactccgtgacagaggatgggacgcagtgcccaaggggaggttggccttgcagggaaagcacatgcctgtccctccctcattagcttcatttggacaaaacatgtaaaatccggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcattcctttgcaagcacaaaagcttgtctccagtcacaagccggttcagaatcagaagcagaagcaattgca

SEQ ID NO: 425 - DNA, 810 bp, Homo sapiens
cctttgaattctaacggctgagctcttggaagacttgggtccttgggtcgcaggtgggagccgacgggtgggtagaccgtgggggatatctcagtggcggacgaggacggcggggacaaggggcggctggtcggagtggcggagcgtcaagtcccctgtcggttcctccgtccctgagtgtccttggcgctgccttgtgcccgcccagcgcctttgcatccgctcctgggcaccgaggcgccctgtaggatactgcttgttacttattacagctagagggtctcactccattgcccaggccagagtgcggggatatttgataagaaacttcagtgaaggccgggcgcggtggctcatgcccgtaatcccagcattttcggaggccgaggctggagtgcaatggtgtgatctcagctcactgcaacctctgcttcctgggtttaagtgattctcctgcctcagcctcccgagtagctgggattacaggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcattcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctg

SEQ ID NO: 426 - DNA, 1287 bp, Homo sapiens
gagatttgaaaagtccttggccagggcgcggcgtggcagattcagttgtttgcgggcggccgggagagtagcagtgccttggaccccagctctcctccccctttctctctaaggatggcccagaaggagaactcctacccctggccctacggccgacagacggctccatctggcctgagcaccctgccccagcgagtcctccggaaagagcctgtcaccccatctgcacttgtcctcatgagccgctccaatgtccagcccacagctgcccctggccagaaggtgatggagaatagcagtgggacacccgacatcttaacgcggcacttcacaattgatgactttgagattgggcgtcctctgggcaaaggcaagtttggaaacgtgtacttggctcgggagaagaaaagccatttcatcgtggcgctcaaggtcctcttcaagtcccagatagagaaggagggcgtggagcatcagctgcgcagagagatcgaaatccaggcccacctgcaccatcccaacatcctgcgtctctacaactatttttatgaccggaggaggatctacttgattctagagtatgccccccgcggggagctctacaaggagctgcagaagagctgcacatttgacgagcagcgaacagccacgatcatggaggagttggcagatgctctaatgtactgccatgggaagaaggtgattcacagagacataaagccagaaaatctgctcttagggctcaagggagagctgaagattgctgacttcggctggtctgtgcatgcgccctccctgaggaggaagacaatgtgtggcaccctggactacctgcccccagagatgattgaggggcgcatgcacaatgagaaggtggatctgtggtgcattggagtgctttgctatgagctgctggtggggaacccaccctttgagagtgcatcacacaacgagacctatcgccgcatcgtcaaggtggacctaaagttccccgcttccgtgcccatgggagcccaggacctcatctccaaactgctcaggcataacccctcggaacggctgcccctggcccaggtctcagcccacccttgggtccgggccaactctcggagggtgctgcctccctctgcccttcaatctgtcgcctgatggtccctgtcattcactcgggtgcgtgtgtttgtatgtctgtgtatgtataggggaaagaagggatccctaactgttcccttatctgttttctacctcctcctttgtttaataaaggctgaagctttttgtactcat

SEQ ID NO: 427 - DNA, 1167 bp, Homo sapiens
agattcagttgtttgcgggcggccgggagagtagcagtgccttggaccccaggctccatctggcctgagcaccctgccccagcgagtcctccggaaagagcctgtcaccccatctgcacttgtcctcatgagccgctccaatgtccagcccacagctgcccctggccagaaggtgatggagaatagcagtgggacacccgacatcttaacgcggcacttcacaattgatgactttgagattgggcgtcctctgggcaaaggcaagtttggaaacgtgtacttggctcgggagaagaaaagccatttcatcgtggcgctcaaggtcctcttcaagtcccagatagagaaggagggcgtggagcatcagctgcgcagagagatcgaaatccaggcccacctgcaccatcccaacatcctgcgtctctacaactatttttatgaccggaggaggatctacttgattctagagtatgccccccgcggggagctctacaaggagctgcagaagagctgcacatttgacgagcagcgaacagccacgatcatggaggagttggcagatgctctaatgtactgccatgggaagaaggtgattcacagagacataaagccagaaaatctgctcttagggctcaagggagagctgaagattgctgacttcggctggtctgtgcatgcgccctccctgaggaggaagacaatgtgtggcaccctggactacctgcccccagagatgattgaggggcgcatgcacaatgagaaggtggatctgtggtgcattggagtgctttgctatgagctgctggtggggaacccaccctttgagagtgcatcacacaacgagacctatcgccgcatcgtcaaggtggacctaaagttccccgcttccgtgcccatgggagcccaggacctcatctccaaactgctcaggcataacccctcggaacggctgcccctggcccaggtctcagcccacccttgggtccgggccaactctcggagggtgctgcctccctctgcccttcaatctgtcgcctgatggtccctgtcattcactcgggtgcgtgtgtttgtatgtctgtgtatgtataggggaaagaagggatccctaactgttcccttatctgttttctacctcctcctttgtttaataaaggctgaagcttt

SEQ ID NO: 428 - DNA, 1227 bp, Homo sapiens
ccagggcgcggcgtggcagattcagttgtttgcgggcggccgggagagtagcagtgccttggaccccagctctcctccccctttctctctaaggatggcccagaaggagaactcctacccctggccctacggccgacagacggctccatctggcctgagcaccctgccccagcgagtcctccggaaagagcctgtcaccccatctgcacttgtcctcatgagccgctccaatgtccagcccacagctgcccctggccagaaggtgatggagaatagcagtgggacacccgacatcttaacgcggcacttcacaattgatgactttgagattgggcgtcctctgggcaaaggcaagtttggaaacgtgtacttggctcgggagaagaaaagccatttcatcgtggcgctcaaggtcctcttcaagtcccagatagagaaggagggcgtggagcatcagctgcgcagagagatcgaaatccaggcccacctgcaccatcccaacatcctgcgtctctacaactatttttatgaccggaggaggatctacttgattctagagtatgccccccgcggggagctctacaaggagctgcagaagagctgcacatttgacgagcagcgaacagccacgatcatggaggagttggcagatgctctaatgtactgccatgggaagaaggtgattcacagagacataaagccagaaaatctgctcttagggctcaagggagagctgaagattgctgacttcggctggtctgtgcatgcgccctccctgaggaggaagacaatgtgtggcaccctggactacctgcccccagagatgattgaggggcgcatgcacaatgagaaggtggatctgtggtgcattggagtgctttgctatgagctgctggtggggaacccaccctttgagagtgcatcacacaacgagacctatcgccgcatcgtcaaggtggacctaaagttccccgcttccgtgcccatgggagcccaggacctcatctccaaactgctcaggcataacccctcggaacggctgcccctggcccaggtctcagcccacccttgggtccgggccaactctcggagggtgctgcctccctctgcccttcaatctgtcgcctgatggtccctgtcattcactcgggtgcgtgtgtttgtatgtctgtgtatgtataggggaaagaagggatccctaactgttcccttatctgttttctacct

SEQ ID NO: 429 - DNA, 1249 bp, Homo sapiens
ccacggctgctcacgacgccgcggatcccgaagcctgtgtagcagtgagacatcagtgaggctgcaggacgagcaggattggaagcgccccggccagaaagtgaccccccacccctttcaggaccctgtgaacgggaacagccatccagagggttcaggaaggcgtccgcgccctcacctcttctccccatgagctcccccagagctgtggtgcagctgggcaaagctcaacctgcaggcgaagagttggctacagcaaaccaaacagcccagcagcccagcagcccagccatgcggcgcctcacagtcgatgactttgaaatcgggcgtcccctgggcaaggggaaatttgggaatgtgtacctggctcggctcaaggaaagccatttcattgtggccctgaaggttctcttcaagtcgcagatagagaaggaaggactggagcaccagctgcgccgggaaattgagatccaggctcatctacaacaccccaatatcctgcgcctgtataactatttccatgatgcacgccgggtgtacctgattctggaatatgctccaaggggtgagctctacaaggagctgcagaaaagcgagaaattagatgaacagcgcacagccacgataatagaggagttggcagatgccctgacctactgccatgacaagaaagtgattcacagagatattaagccagagaacctgctgctggggttcaggggtgaggtgaagattgcagattttggctggtctgtgcacaccccctccctgaggaggaagacaatgtgtgggacactggactacttgccgccagaaatgattgaggggagaacatatgatgaaaaggtggatttgtggtgcattggagtgctctgctatgagctgctggtgggatatccaccctttgagagcgcctcccacagtgagacttacagacgcatcctcaaggtagatgtgaggtttccactatcaatgcctctgggggcccgggacttgatttccaggcttctcagataccagcccttggagagactgcccctggcccagatcctgaagcacccctgggttcaggcccactcccgaagggtgctgcctccctgtgctcagatggcttcctgagccctgtctgcctctgttccctttgtgtgtgttcagggagctctcctggctctgccacctcatttgtctttatttttttctcttttaagatgtaagatgctaattaataaaagctgaatcatttcatacc

SEQ ID NO: 430 - DNA, 1108 bp, Homo sapiens
ggaagtacctctctgagcggttggtgccgggtataaaagaaggccgcgcagccacggctgctcacgacgccgcggatcccgaagcctgtgtagcagtgagacatcatggctacagcaaaccaaacagcccagcagcccagcagcccagccatgcggcgcctcacagtcgatgactttgaaatcgggcgtcccctgggcaaggggaaatttgggaatgtgtacctggctcggctcaaggaaagccatttcattgtggccctgaaggttctcttcaagtcgcagatagagaaggaaggactggagcaccagctgcgccgggaaattgagatccaggctcatctacaacaccccaatatcctgcgcctgtataactatttccatgatgcacgccgggtgtacctgattctggaatatgctccaaggggtgagctctacaaggagctgcagaaaagcgagaaattagatgaacagcgcacagccacgataatagaggagttggcagatgccctgacctactgccatgacaagaaagtgattcacagagatattaagccagagaacctgctgctggggttcaggggtgaggtgaagattgcagattttggctggtctgtgcacaccccctccctgaggaggaagacaatgtgtgggacactggactacttgccgccagaaatgattgaggggagaacatatgatgaaaaggtggatttgtggtgcattggagtgctctgctatgagctgctggtgggatatccaccctttgagagcgcctcccacagtgagacttacagacgcatcctcaaggtagatgtgaggtttccactatcaatgcctctgggggcccgggacttgatttccaggcttctcagataccagcccttggagagactgcccctggcccagatcctgaagcacccctgggttcaggcccactcccgaagggtgctgcctccctgtgctcagatggcttcctgagccctgtctgcctctgttccctttgtgtgtgttcagggagctctcctggctctgccacctcatttgtctttatttttttctcttttaagatgtaagatgctaattaataaaagctgaatcatttcatacc

SEQ ID NO: 431 - DNA, 1113 bp, Homo sapiens
ggaagtacctctctgagcggttggtgccgggtataaaagaaggccgcgcagccacggctgctcacgacgccgcggatcccgaagcctgtgtagcagtgagacatcagtgagtggctacagcaaaccaaacagcccagcagcccagcagcccagccatgcggcgcctcacagtcgatgactttgaaatcgggcgtcccctgggcaaggggaaatttgggaatgtgtacctggctcggctcaaggaaagccatttcattgtggccctgaaggttctcttcaagtcgcagatagagaaggaaggactggagcaccagctgcgccgggaaattgagatccaggctcatctacaacaccccaatatcctgcgcctgtataactatttccatgatgcacgccgggtgtacctgattctggaatatgctccaaggggtgagctctacaaggagctgcagaaaagcgagaaattagatgaacagcgcacagccacgataatagaggagttggcagatgccctgacctactgccatgacaagaaagtgattcacagagatattaagccagagaacctgctgctggggttcaggggtgaggtgaagattgcagattttggctggtctgtgcacaccccctccctgaggaggaagacaatgtgtgggacactggactacttgccgccagaaatgattgaggggagaacatatgatgaaaaggtggatttgtggtgcattggagtgctctgctatgagctgctggtgggatatccaccctttgagagcgcctcccacagtgagacttacagacgcatcctcaaggtagatgtgaggtttccactatcaatgcctctgggggcccgggacttgatttccaggcttctcagataccagcccttggagagactgcccctggcccagatcctgaagcacccctgggttcaggcccactcccgaagggtgctgcctccctgtgctcagatggcttcctgagccctgtctgcctctgttccctttgtgtgtgttcagggagctctcctggctctgccacctcatttgtctttatttttttctcttttaagatgtaagatgctaattaataaaagctgaatcatttcatacc

SEQ ID NO: 432 - DNA, 3643 bp, Homo sapiens
ctcgggaggcgatcgtggccgctgccgccgccagagccggccggagtcggcccggagccgcgtccacgcggagcgggcgggtgggagctggcggctgggcccctgcggcgcccccgcggcctgccccgcgtccgcctccgggccgccgagccgcagccgccgagatgggggccgccccgggccgcgcccccgccgggtcccgcccgccgcgctgccgctgagcgcatgggcccggaccgcgccgcgccgctccgggagccgggcccggggtcccgccaccaccgcgcgcgggacagattgattcactttggagctgtaagtactgatgtattagggtgcagcgctcattgttccttgacgcagagtcccaaaatgaatatccaagagcagggtttccccttggacctcggagcaagtttcaccgaagatgctccccgacccccagtgcctggtgaggagggagaactggtgtccacagacccgaggcccgccagctacagtttctgctccgggaaaggtgttggcattaaaggtgagacttcgacggccactccgaggcgctcggatctggacctggggtatgagcctgagggcagtgcctcccccaccccaccatacttgaagtgggctgagtcactgcattccctgctggatgaccaagatgggataagcctgttcaggactttcctgaagcaggagggctgtgccgacttgctggacttctggtttgcctgcactggcttcaggaagctggagccctgtgactcgaacgaggagaagaggctgaagctggcgagagccatctaccgaaagtacattcttgataacaatggcatcgtgtcccggcagaccaagccagccaccaagagcttcataaagggctgcatcatgaagcagctgatcgatcctgccatgtttgaccaggcccagaccgaaatccaggccactatggaggaaaacacctatccctccttccttaagtctgatatttatttggaatatacgaggacaggctcggagagccccaaagtctgtagtgaccagagctctgggtcagggacagggaagggcatatctggatacctgccgaccttaaatgaagatgaggaatggaagtgtgaccaggacatggatgaggacgatggcagagacgctgctccccccggaagactccctcagaagctgctcctggagacagctgccccgagggtctcctccagtagacggtacagcgaaggcagagagttcaggtatggatcctggcgggagccagtcaacccctattatgtcaatgccggctatgccctggccccagccaccagtgccaacgacagcgagcagcagagcctgtccagcgatgcagacaccctgtccctcacggacagcagcgtggatgggatccccccatacaggatccgtaagcagcaccgcagggagatgcaggagagcgtgcaggtcaatgggcgggtgcccctacctcacattccccgcacgtaccgggtgccgaaggaggtccgcgtggagcctcagaagttcgcggaggagctcatccaccgcctggaggctgtgcagcgcacgcgggaggccgaggagaagctggaggagcggctgaagcgcgtgcgcatggaggaggaaggtgaggacggcgatccatcgtcagggcccccagggccgtgtcacaagctgcctcccgcccccgcttggcaccacttcccgccccgctgtgtggacatgggctgtgccgggctccgggatgcacacgaggagaaccctgagagcatcctggacgagcacgtacagcgtgtgctgaggacacctggccgccagtcgcctgggcctggccatcgctccccggacagtgggcacgtggccaagatgccagtggcactggggggtgccgcctcggggcacgggaagcacgtacccaagtcaggggcgaagctggacgcggccggcctgcaccaccaccgacacgtccaccaccacgtccaccacagcacagcccggcccaaggagcaggtggaggccgaggccacccgcagggcccagagcagcttcgcctggggcctggaaccacacagccatggggcaaggtcccgaggctactcagagagtgttggcgctgcccccaacgccagtgatggcctcgcccacagtgggaaggtgggcgtggcgtgcaaaagaaatgccaagaaggctgagtcggggaagagcgccagcaccgaggtgccaggtgcctcggaggatgcggagaagaaccagaaaatcatgcagtggatcattgagggggaaaaggagatcagcaggcaccgcaggaccggccacgggtcttcggggacgaggaagccacagccccatgagaactccagacccttgtcccttgagcacccctgggccggccctcagctccggacctccgtgcagccctcccacctcttcatccaagaccccaccatgccaccccacccagctcccaaccccctaacccagctggaggaggcgcgccgacgtctggaggaggaagaaaagagagccagccgagcaccctccaagcagaggtatgtgcaggaggttatgcggcggggacgcgcctgcgtcaggccagcgtgcgcgccggtgctgcacgtggtaccagccgtgtcggacatggagctctccgagacagagacaagatcgcagaggaaggtgggcggcgggagtgcccagccgtgtgacagcatcgttgtggcgtactacttctgcggggaacccatcccctaccgcaccctggtgaggggccgcgctgtcaccctgggccagttcaaggagctgctgaccaaaaagggcagctacagatactacttcaagaaagtgagcgacgagtttgactgtggggtggtgtttgaggaggttcgagaggacgaggccgtcctgcccgtctttgaggagaagatcatcggcaaagtggagaaggtggactgataggctggtgggctggccgctgtgccaggcgaggcccttggcgggcacgggtgtcacggccaggcagatgacctcgtactcaggagcccgatggggaacagtgttgggtgtaccacccatccctgtggtctacccgtgtctagaggcaggtagggggtccctccaagtggtccacaagcttctgtcctgcccccaaggaggcagcctggaccactcctcatagcaatacttggagggcccagcccaagtgaggcagccgaggtccctgctgccagcttcaggtgacccccccccatcccccggcacctcccttgggcacgtgtgctgggatctactttccctctgggatttgcccacgtacccaggtctgggtggggcccaggcccggatgcagaggcctgcagggcctctgtcaattgtacgcgccaccgagtgccttcaacacagcttgtctcttgcctgccactgtgtgaatcggcgacggagcactgcacctgcctccagccgccggctgtgcagtcctgggtcctcctttctgagggcccgtgtaaatatgtacatttctcaggctaggccagcaggggctgcccgagtctgtttttcatgcgatgacacttgtacaattaattatcttttcaaaggtacttggataataatgaaataaaactgtttttgaacctgc

SEQ ID NO: 433 - DNA, 3324 bp, Homo sapiens
gctgccgctgagcgcatgggcccggaccgcgccgcgccgctccgggagccgggcccggggtcccgccaccaccgcgcgcgggacagattgattcactttggagctgtaagtactgatgtattagggtgcagcgctcattgttccttgacgcagagtcccaaaatgaatatccaagagcagggtttccccttggacctcggagcaagtttcaccgaagatgctccccgacccccagtgcctggtgaggagggagaactggtgtccacagacccgaggcccgccagctacagtttctgctccgggaaaggtgttggcattaaaggtgagacttcgacggccactccgaggcgctcggatctggacctggggtatgagcctgagggcagtgcctcccccaccccaccatacttgaagtgggctgagtcactgcattccctgctggatgaccaagatgggataagcctgttcaggactttcctgaagcaggagggctgtgccgacttgctggacttctggtttgcctgcactggcttcaggaagctggagccctgtgactcgaacgaggagaagaggctgaagctggcgagagccatctaccgaaagtacattcttgataacaatggcatcgtgtcccggcagaccaagccagccaccaagagcttcataaagggctgcatcatgaagcagctgatcgatcctgccatgtttgaccaggcccagaccgaaatccaggccactatggaggaaaacacctatccctccttccttaagtctgatatttatttggaatatacgaggacaggctcggagagccccaaagtctgtagtgaccagagctctgggtcagggacagggaagggcatatctggatacctgccgaccttaaatgaagatgaggaatggaagtgtgaccaggacatggatgaggacgatggcagagacgctgctccccccggaagactccctcagaagctgctcctggagacagctgccccgagggtctcctccagtagacggtacagcgaaggcagagagttcaggtatggatcctggcgggagccagtcaacccctattatgtcaatgccggctatgccctggccccagccaccagtgccaacgacagcgagcagcagagcctgtccagcgatgcagacaccctgtccctcacggacagcagcgtggatgggatccccccatacaggatccgtaagcagcaccgcagggagatgcaggagagcgtgcaggtcaatgggcgggtgcccctacctcacattccccgcacgtaccgggtgccgaaggaggtccgcgtggagcctcagaagttcgcggaggagctcatccaccgcctggaggctgtgcagcgcacgcgggaggccgaggagaagctggaggagcggctgaagcgcgtgcgcatggaggaggaaggtgaggacggcgatccatcgtcagggcccccagggccgtgtcacaagctgcctcccgcccccgcttggcaccacttcccgccccgctgtgtggacatgggctgtgccgggctccgggatgcacacgaggagaaccctgagagcatcctggacgagcacgtacagcgtgtgctgaggacacctggccgccagtcgcctgggcctggccatcgctccccggacagtgggcacgtggccaagatgccagtggcactggggggtgccgcctcggggcacgggaagcacgtacccaagtcaggggcgaagctggacgcggccggcctgcaccaccaccgacacgtccaccaccacgtccaccacagcacagcccggcccaaggagcaggtggaggccgaggccacccgcagggcccagagcagcttcgcctggggcctggaaccacacagccatggggcaaggtcccgaggctactcagagagtgttggcgctgcccccaacgccagtgatggcctcgcccacagtgggaaggtgggcgtggcgtgcaaaagaaatgccaagaaggctgagtcggggaagagcgccagcaccgaggtgccaggtgcctcggaggatgcggagaagaaccagaaaatcatgcagtggatcattgagggggaaaaggagatcagcaggcaccgcaggaccggccacgggtcttcggggacgaggaagccacagccccatgagaactccagacccttgtcccttgagcacccctgggccggccctcagctccggacctccgtgcagccctcccacctcttcatccaagaccccaccatgccaccccacccagctcccaaccccctaacccagctggaggaggcgcgccgacgtctggaggaggaagaaaagagagccagccgagcaccctccaagcagaggacaagatcgcagaggaaggtgggcggcgggagtgcccagccgtgtgacagcatcgttgtggcgtactacttctgcggggaacccatcccctaccgcaccctggtgaggggccgcgctgtcaccctgggccagttcaaggagctgctgaccaaaaagggcagctacagatactacttcaagaaagtgagcgacgagtttgactgtggggtggtgtttgaggaggttcgagaggacgaggccgtcctgcccgtctttgaggagaagatcatcggcaaagtggagaaggtggactgataggctggtgggctggccgctgtgccaggcgaggcccttggcgggcacgggtgtcacggccaggcagatgacctcgtactcaggagcccgatggggaacagtgttgggtgtaccacccatccctgtggtctacccgtgtctagaggcaggtagggggtccctccaagtggtccacaagcttctgtcctgcccccaaggaggcagcctggaccactcctcatagcaatacttggagggcccagcccaagtgaggcagccgaggtccctgctgccagcttcaggtgacccccccccatcccccggcacctcccttgggcacgtgtgctgggatctactttccctctgggatttgcccacgtacccaggtctgggtggggcccaggcccggatgcagaggcctgcagggcctctgtcaattgtacgcgccaccgagtgccttcaacacagcttgtctcttgcctgccactgtgtgaatcggcgacggagcactgcacctgcctccagccgccggctgtgcagtcctgggtcctcctttctgagggcccgtgtaaatatgtacatttctcaggctaggccagcaggggctgcccgagtctgtttttcatgcgatgacacttgtacaattaattatcttttcaaaggtacttggataataatgaaataaaactgtttttgaacctg

SEQ ID NO: 434 - DNA, 334 bp, Homo sapiens
gtctggaggaggaagaaaagagagccagccgagcaccctccaagcagaggacaagatcgcagaggaaggtgggcggcgggagtgcccagccgtgtgacagcatcgttgtggcgtactacttctgcggggaacccatcccctaccgcaccctggtgaggggccgcgctgtcaccctgggccagttcaaggagctgctgaccaaaaagggcagctacaggcctccttcccatctgcggtgctgcctgctcactgccctcctcacctccgtcctgcagatactacttcaagaaagtgagcgacgagtttgactgtggggtggtgtttgaggaggttc

SEQ ID NO: 435 - DNA, 3743 bp, Homo sapiens
ggatggggcggcgggcttcgggagcgcccgggctgatccgagccgagcgggccgtatctccttgtcggcgccgctgattcccggctctgcggaggcctctaggcagccgcgcagcttccgtgtttgctgcgcccgcactgcgatttacaaccctgaagaatctccctatccctattttgtccccctgcagtaataaatcccattatggagatctcgaaactttataaagggatatagtttgaattctatggagtgtaattttgtgtatgaattatatttttaaaacattgaagagttttcagaaagaaggctagtagagttgattactgatactttatgctaagcagtacttttttggtagtacaatattttgttaggcgtttctgataacactagaaaggacaagttttatcttgtgataaattgattaatgtttacaacatgactgataattatagctgaatagtccttaaatgatgaacaggttatttagtttttaaatgcagtgtaaaaagtgtgctgtggaaattttatggctaactaagtttatggagaaaataccttcagttgatcaagaataatagtggtatacaaagttaggaagaaagtcaacatgatgctgcaggaaatggaaacaaatacaaatgatatttaacaaagatagagtttacagtttttgaactttaagccaaattcatttgacatcaagcactatagcaggcacaggttcaacaaagcttgtgggtattgacttcccccaaaagttgtcagctgaagtaatttagcccacttaagtaaatactatgatgataagctgtgtgaacttagcttttaaatagtgtgaccatatgaaggttttaattacttttgtttattggaataaaatgagattttttgggttgtcatgttaaagtgcttatagggaaagaagcctgcatataattttttaccttgtggcataatcagtaattggtctgttattcaggcttcatagcttgtaaccaaatataaataaaaggcataatttaggtattctatagttgcttagaattttgttaatataaatctctgtgaaaaatcaaggagttttaatattttcagaagtgcatccacctttcagggctttaagttagtattactcaagattatgaacaaatagcacttaggttacctgaaagagttactacaaccccaaagagttgtgttctaagtagtatcttggtaattcagagagatactcatcctacctgaatataaactgagataaatccagtaaagaaagtgtagtaaattctacataagagtctatcattgatttctttttgtggtaaaaatcttagttcatgtgaagaaatttcatgtgaatgttttagctatcaaacagtactgtcacctactcatgcacaaaactgcctcccaaagacttttcccaggtccctcgtatcaaaacattaagagtataatggaagatagcacgatcttgtcagattggacaaacagcaacaaacaaaaaatgaagtatgacttttcctgtgaactctacagaatgtctacatattcaactttccccgccggggtgcctgtctcagaaaggagtcttgctcgtgctggtttttattatactggtgtgaatgacaaggtcaaatgcttctgttgtggcctgatgctggataactggaaactaggagacagtcctattcaaaagcataaacagctatatcctagctgtagctttattcagaatctggtttcagctagtctgggatccacctctaagaatacgtctccaatgagaaacagttttgcacattcattatctcccaccttggaacatagtagcttgttcagtggttcttactccagcctttctccaaaccctcttaattctagagcagttgaagacatctcttcatcgaggactaacccctacagttatgcaatgagtactgaagaagccagatttcttacctaccatatgtggccattaacttttttgtcaccatcagaattggcaagagctggtttttattatataggacctggagatagggtagcctgctttgcctgtggtgggaagctcagtaactgggaaccaaaggatgatgctatgtcagaacaccggaggcattttcccaactgtccatttttggaaaattctctagaaactctgaggtttagcatttcaaatctgagcatgcagacacatgcagctcgaatgagaacatttatgtactggccatctagtgttccagttcagcctgagcagcttgcaagtgctggtttttattatgtgggtcgcaatgatgatgtcaaatgcttttgttgtgatggtggcttgaggtgttgggaatctggagatgatccatgggtagaacatgccaagtggtttccaaggtgtgagttcttgatacgaatgaaaggccaagagtttgttgatgagattcaaggtagatatcctcatcttcttgaacagctgttgtcaacttcagataccactggagaagaaaatgctgacccaccaattattcattttggacctggagaaagttcttcagaagatgctgtcatgatgaatacacctgtggttaaatctgccttggaaatgggctttaatagagacctggtgaaacaaacagttcaaagtaaaatcctgacaactggagagaactataaaacagttaatgatattgtgtcagcacttcttaatgctgaagatgaaaaaagagaagaggagaaggaaaaacaagctgaagaaatggcatcagatgatttgtcattaattcggaagaacagaatggctctctttcaacaattgacatgtgtgcttcctatcctggataatcttttaaaggccaatgtaattaataaacaggaacatgatattattaaacaaaaaacacagatacctttacaagcgagagaactgattgataccattttggttaaaggaaatgctgcggccaacatcttcaaaaactgtctaaaagaaattgactctacattgtataagaacttatttgtggataagaatatgaagtatattccaacagaagatgtttcaggtctgtcactggaagaacaattgaggaggttgcaagaagaacgaacttgtaaagtgtgtatggacaaagaagtttctgttgtatttattccttgtggtcatctggtagtatgccaggaatgtgccccttctctaagaaaatgccctatttgcaggggtataatcaagggtactgttcgtacatttctctcttaaagaaaaatagtctatattttaacctgcataaaaaggtctttaaaatattgttgaacacttgaagccatctaaagtaaaaagggaattatgagtttttcaattagtaacattcatgttctagtctgctttggtactaataatcttgtttctgaaaagatggtatcatatatttaatcttaatctgtttatttacaagggaagatttatgtttggtgaactatattagtatgtatgtgtacctaagggagtagtgtcactgcttgttatgcatcatttcaggagttactggatttgttgttctttcagaaagctttgaatactaaattatagtgtagaaaagaactggaaaccaggaactctggagttcatcagagttatggtgccgaattgtctttggtgcttttcacttgtgttttaaaataaggatttttctcttatttctccccctagtttgtgagaaacatctcaataaagtgctttaaaaaga

SEQ ID NO: 436 - DNA, 1927 bp, Homo sapiens
atcgtgcgtcagagtgagcccggatggggcggcgggcttcgggagcgcccgggctgatccgagccgagcgggccgtatctccttgtcggcgccgctgattcccggctctgcggaggcctctaggcagccgcgcagcttccgtgtttgctgcgcccgcactgcgaatgtctacatattcaactttccccgccggggtgcctgtctcagaaaggagtcttgctcgtgctggtttttattatactggtgtgaatgacaaggtcaaatgcttctgttgtggcctgatgctggataactggaaactaggagacagtcctattcaaaagcataaacagctatatcctagctgtagctttattcagaatctggtttcagctagtctgggatccacctctaagaatacgtctccaatgagaaacagttttgcacattcattatctcccaccttggaacatagtagcttgttcagtggttcttactccagcctttctccaaaccctcttaattctagagcagttgaagacatctcttcatcgaggactaacccctacagttatgcaatgagtactgaagaagccagatttcttacctaccatatgtggccattaacttttttgtcaccatcagaattggcaagagctggtttttattatataggacctggagatagggtagcctgctttgcctgtggtgggaagctcagtaactgggaaccaaaggatgatgctatgtcagaacaccggaggcattttcccaactgtccatttttggaaaattctctagaaactctgaggtttagcatttcaaatctgagcatgcagacacatgcagctcgaatgagaacatttatgtactggccatctagtgttccagttcagcctgagcagcttgcaagtgctggtttttattatgtgggtcgcaatgatgatgtcaaatgcttttgttgtgatggtggcttgaggtgttgggaatctggagatgatccatgggtagaacatgccaagtggtttccaaggtgtgagttcttgatacgaatgaaaggccaagagtttgttgatgagattcaaggtagatatcctcatcttcttgaacagctgttgtcaacttcagataccactggagaagaaaatgctgacccaccaattattcattttggacctggagaaagttcttcagaagatgctgtcatgatgaatacacctgtggttaaatctgccttggaaatgggctttaatagagacctggtgaaacaaacagttcaaagtaaaatcctgacaactggagagaactataaaacagttaatgatattgtgtcagcacttcttaatgctgaagatgaaaaaagagaagaggagaaggaaaaacaagctgaagaaatggcatcagatgatttgtcattaattcggaagaacagaatggctctctttcaacaattgacatgtgtgcttcctatcctggataatcttttaaaggccaatgtaattaataaacaggaacatgatattattaaacaaaaaacacagatacctttacaagcgagagaactgattgataccattttggttaaaggaaatgctgcggccaacatcttcaaaaactgtctaaaagaaattgactctacattgtataagaacttatttgtggataagaatatgaagtatattccaacagaagatgtttcaggtctgtcactggaagaacaattgaggaggttgcaagaagaacgaacttgtaaagtgtgtatggacaaagaagtttctgttgtatttattccttgtggtcatctggtagtatgccaggaatgtgccccttctctaagaaaatgccctatttgcaggggtataatcaagggtactgttcgtacatttctctcttaaagaaaaatagtctatattttaacctgcataaaaaggtctttaaaatattgttg

SEQ ID NO: 437 - DNA, 2617 bp, Homo sapiens
gggcttcgggagcgcccgggctgatccgagccgagcgggccgtatctccttgtcggcgccgctgattcccggctctgcggaggcctctaggcagccgcgcagcttccgtgtttgctgcgcccgcactgcgatttacaaccctgaagaatctccctatccctattttgtccccctgcagtaataaatcccattatggagatctcgaaactttataaagggatatagtttgaattctatggagtgtaattttgtgtatgaattatatttttaaaacattgaagagttttcagaaagaagacttttcccaggtccctcgtatcaaaacattaagagtataatggaagatagcacgatcttgtcagattggacaaacagcaacaaacaaaaaatgaagtatgacttttcctgtgaactctacagaatgtctacatattcaactttccccgccggggtgcctgtctcagaaaggagtcttgctcgtgctggtttttattatactggtgtgaatgacaaggtcaaatgcttctgttgtggcctgatgctggataactggaaactaggagacagtcctattcaaaagcataaacagctatatcctagctgtagctttattcagaatctggtttcagctagtctgggatccacctctaagaatacgtctccaatgagaaacagttttgcacattcattatctcccaccttggaacatagtagcttgttcagtggttcttactccagcctttctccaaaccctcttaattctagagcagttgaagacatctcttcatcgaggactaacccctacagttatgcaatgagtactgaagaagccagatttcttacctaccatatgtggccattaacttttttgtcaccatcagaattggcaagagctggtttttattatataggacctggagatagggtagcctgctttgcctgtggtgggaagctcagtaactgggaaccaaaggatgatgctatgtcagaacaccggaggcattttcccaactgtccatttttggaaaattctctagaaactctgaggtttagcatttcaaatctgagcatgcagacacatgcagctcgaatgagaacatttatgtactggccatctagtgttccagttcagcctgagcagcttgcaagtgctggtttttattatgtgggtcgcaatgatgatgtcaaatgcttttgttgtgatggtggcttgaggtgttgggaatctggagatgatccatgggtagaacatgccaagtggtttccaaggtgtgagttcttgatacgaatgaaaggccaagagtttgttgatgagattcaaggtagatatcctcatcttcttgaacagctgttgtcaacttcagataccactggagaagaaaatgctgacccaccaattattcattttggacctggagaaagttcttcagaagatgctgtcatgatgaatacacctgtggttaaatctgccttggaaatgggctttaatagagacctggtgaaacaaacagttcaaagtaaaatcctgacaactggagagaactataaaacagttaatgatattgtgtcagcacttcttaatgctgaagatgaaaaaagagaagaggagaaggaaaaacaagctgaagaaatggcatcagatgatttgtcattaattcggaagaacagaatggctctctttcaacaattgacatgtgtgcttcctatcctggataatcttttaaaggccaatgtaattaataaacaggaacatgatattattaaacaaaaaacacagatacctttacaagcgagagaactgattgataccattttggttaaaggaaatgctgcggccaacatcttcaaaaactgtctaaaagaaattgactctacattgtataagaacttatttgtggataagaatatgaagtatattccaacagaagatgtttcaggtctgtcactggaagaacaattgaggaggttgcaagaagaacgaacttgtaaagtgtgtatggacaaagaagtttctgttgtatttattccttgtggtcatctggtagtatgccaggaatgtgccccttctctaagaaaatgccctatttgcaggggtataatcaagggtactgttcgtacatttctctcttaaagaaaaatagtctatattttaacctgcataaaaaggtctttaaaatattgttgaacacttgaagccatctaaagtaaaaagggaattatgagtttttcaattagtaacattcatgttctagtctgctttggtactaataatcttgtttctgaaaagatggtatcatatatttaatcttaatctgtttatttacaagggaagatttatgtttggtgaactatattagtatgtatgtgtacctaagggagtagtgtcactgcttgttatgcatcatttcaggagttactggatttgttgttctttcagaaagctttgaatactaaattatagtgtagaaaagaactggaaaccaggaactctggagttcatcagagttatggtgccgaattgtctttggtgcttttcacttgtgttttaaaataaggatttttctcttatttctccccctagtttgtgagaaacatctcaataaagtgctttaaaaag

SEQ ID NO: 438 - DNA, 3001 bp, Homo sapiens
ggatggggcggcgggcttcgggagcgcccgggctgatccgagccgagcgggccgtatctccttgtcggcgccgctgattcccggctctgcggaggcctctaggcagccgcgcagcttccgtgtttgctgcgcccgcactgcgatttacaaccctgaagaatctccctatccctattttgtccccctgcagtaataaatcccattatggagatctcgaaactttataaagggatatagtttgaattctatggagtgtaattttgtgtatgaattatatttttaaaacattgaagagttttcagaaagaaggctagtagagttgattactgatactttatgctaagcagtacttttttggtagtacaatattttgttaggcgtttctgataacactagaaaggacaagttttatcttgtgataaattgattaatgtttacaacatgactgataattatagctgaatagtccttaaatgatgaacaggttatttagtttttaaatgcagtgtaaaaagtgtgctgtggaaattttatggctaactaagtttatggagaaaataccttcagttgatcaagaataatagtggtatacaaagttaggaagaaagtcaacatgatgctgcaggaaatggaaacaaatacaaatgatatttaacaaagatagagtttacagtttttgaactttaagccaaattcatttgacatcaagcactatagcaggcacaggttcaacaaagcttgtgggtattgacttcccccaaaagttgtcagctgaagtaatttagcccacttaagtaaatactatgatgataagctgtgtgaacttagcttttaaatagtgtgaccatatgaaggttttaattacttttgtttattggaataaaatgagattttttgggttgtcatgttaaagtgcttatagggaaagaagcctgcatataattttttaccttgtggcataatcagtaattggtctgttattcaggcttcatagcttgtaaccaaatataaataaaaggcataatttaggtattctatagttgcttagaattttgttaatataaatctctgtgaaaaatcaaggagttttaatattttcagaagtgcatccacctttcagggctttaagttagtattactcaagattatgaacaaatagcacttaggttacctgaaagagttactacaaccccaaagagttgtgttctaagtagtatcttggtaattcagagagatactcatcctacctgaatataaactgagataaatccagtaaagaaagtgtagtaaattctacataagagtctatcattgatttctttttgtggtaaaaatcttagttcatgtgaagaaatttcatgtgaatgttttagctatcaaacagtactgtcacctactcatgcacaaaactgcctcccaaagacttttcccaggtccctcgtatcaaaacattaagagtataatggaagatagcacgatcttgtcagattggacaaacagcaacaaacaaaaaatgaagtatgacttttcctgtgaactctacagaatgtctacatattcaactttccccgccggggtgcctgtctcagaaaggagtcttgctcgtgctggtttttattatactggtgtgaatgacaaggtcaaatgcttctgttgtggcctgatgctggataactggaaactaggagacagtcctattcaaaagcataaacagctatatcctagctgtagctttattcagaatctggtttcagctagtctgggatccacctctaagaatacgtctccaatgagaaacagttttgcacattcattatctcccaccttggaacatagtagcttgttcagtggttcttactccagcctttctccaaaccctcttaattctagagcagttgaagacatctcttcatcgaggactaacccctacagttatgcaatgagtactgaagaagccagatttcttacctaccatatgtggccattaacttttttgtcaccatcagaattggcaagagctggtttttattatataggacctggagatagggtagcctgctttgcctgtggtgggaagctcagtaactgggaaccaaaggatgatgctatgtcagaacaccggaggcattttcccaactgtccatttttggaaaattctctagaaactctgaggtttagcatttcaaatctgagcatgcagacacatgcagctcgaatgagaacatttatgtactggccatctagtgttccagttcagcctgagcagcttgcaagtgctggtttttattatgtgggtcgcaatgatgatgtcaaatgcttttgttgtgatggtggcttgaggtgttgggaatctggagatgatccatgggtagaacatgccaagtggtttccaaggtgtgagttcttgatacgaatgaaaggccaagagtttgttgatgagattcaaggtagatatcctcatcttcttgaacagctgttgtcaacttcagataccactggagaagaaaatgctgacccaccaattattcattttggacctggagaaagttcttcagaagatgctgtcatgatgaatacacctgtggttaaatctgccttggaaatgggctttaatagagacctggtgaaacaaacagttcaaagtaaaatcctgacaactggagagaactataaaacagttaatgatattgtgtcagcacttcttaatgctgaagatgaaaaaagagaagaggagaaggaaaaacaagctgaagaaatggcatcagatgatttgtcattaattcggaagaacagaatggctctctttcaacaattgacatgtgtgcttcctatcctggataatcttttaaaggccaatgtaattaataaacaggaacatgatattattaaacaaaaaacacagatacctttacaagcgagagaactgattgataccattttggttaaaggaaatgctgcggccaacatcttcaaaaactgtctaaaagtaaaacaaagattt

SEQ ID NO: 439 - DNA, 5197 bp, Homo sapiens
ggccaggcgacaggtgtcgcttgaaaagactgggcttgtccttgctggtgcatgcgtcgtcggcctctgggcagcaggtttacaaaggaggaaaacgacttcttctagatttttttttcagtttcttctataaatcaaaacatctcaaaatggagacctaaaatccttaaagggacttagtctaatctcgggaggtagttttgtgcatgggtaaacaaattaagtattaactggtgttttactatccaaagaatgctaattttataaacatgatcgagttatataaggtataccataatgagtttgattttgaatttgatttgtggaaataaaggaaaagtgattctagctggggcatattgttaaagcatttttttcagagttggccaggcagtctcctactggcacattctcccattatgtagaatagaaatagtacctgtgtttgggaaagattttaaaatgagtgacagttatttggaacaaagagctaataatcaatccactgcaaattaaagaaacatgcagatgaaagttttgacacattaaaatacttctacagtgacaaagaaaaatcaagaacaaagctttttgatatgtgcaacaaatttagaggaagtaaaaagataaatgtgatgattggtcaagaaattatccagttatttacaaggccactgatattttaaacgtccaaaagtttgtttaaatgggctgttaccgctgagaatgatgaggatgagaatgatggttgaaggttacattttaggaaatgaagaaacttagaaaattaatataaagacagtgatgaatacaaagaagatttttataacaatgtgtaaaatttttggccagggaaaggaatattgaagttagatacaattacttacctttgagggaaataattgttggtaatgagatgtgatgtttctcctgccacctggaaacaaagcattgaagtctgcagttgaaaagcccaacgtctgtgagatccaggaaaccatgcttgcaaaccactggtaaaaaaaaaaaaaaaaaaaaaaaaaagccacagtgacttgcttattggtcattgctagtattatcgactcagaacctctttactaatggctagtaaatcataattgagaaattctgaattttgacaaggtctctgctgttgaaatggtaaatttattattttttttgtcatgataaattctggttcaaggtatgctatccatgaaataatttctgaccaaaactaaattgatgcaatttgattatccatcttagcctacagatggcatctggtaacttttgactgttttaaaaaataaatccactatcagagtagatttgatgttggcttcagaaacatttagaaaaacaaaagttcaaaaatgttttcaggaggtgataagttgaataactctacaatgttagttctttgagggggacaaaaaatttaaaatctttgaaaggtcttattttacagccatatctaaattatcttaagaaaatttttaacaaagggaatgaaatatatatcatgattctgtttttccaaaagtaacctgaatatagcaatgaagttcagttttgttattggtagtttgggcagagtctctttttgcagcacctgttgtctaccataattacagaggacatttccatgttctagccaagtatactattagaataaaaaaacttaacattgagttgcttcaacagcatgaaactgagtccaaaagaccaaatgaacaaacacattaatctctgattatttattttaaatagaatatttaattgtgtaagatctaatagtatcattatacttaagcaatcatattcctgatgatctatgggaaataactattatttaattaatattgaaaccaggttttaagatgtgttagccagtcctgttactagtaaatctctttatttggagagaaattttagattgttttgttctccttattagaaggattgtagaaagaaaaaaatgactaattggagaaaaattggggatatatcatatttcactgaattcaaaatgtcttcagttgtaaatcttaccattattttacgtacctctaagaaataaaagtgcttctaattaaaatatgatgtcattaattatgaaatacttcttgataacagaagttttaaaatagccatcttagaatcagtgaaatatggtaatgtattattttcctcctttgagttaggtcttgtgcttttttttcctggccactaaatttcacaatttccaaaaagcaaaataaacatattctgaatatttttgctgtgaaacacttgacagcagagctttccaccatgaaaagaagcttcatgagtcacacattacatctttgggttgattgaatgccactgaaacattctagtagcctggagaagttgacctacctgtggagatgcctgccattaaatggcatcctgatggcttaatacacatcactcttctgtgaagggttttaattttcaacacagcttactctgtagcatcatgtttacattgtatgtataaagattatacaaaggtgcaattgtgtatttcttccttaaaatgtatcagtataggatttagaatctccatgttgaaactctaaatgcatagaaataaaaataataaaaaatttttcattttggcttttcagcctagtattaaaactgataaaagcaaagccatgcacaaaactacctccctagagaaaggctagtcccttttcttccccattcatttcattatgaacatagtagaaaacagcatattcttatcaaatttgatgaaaagcgccaacacgtttgaactgaaatacgacttgtcatgtgaactgtaccgaatgtctacgtattccacttttcctgctggggttcctgtctcagaaaggagtcttgctcgtgctggtttctattacactggtgtgaatgacaaggtcaaatgcttctgttgtggcctgatgctggataactggaaaagaggagacagtcctactgaaaagcataaaaagttgtatcctagctgcagattcgttcagagtctaaattccgttaacaacttggaagctacctctcagcctacttttccttcttcagtaacaaattccacacactcattacttccgggtacagaaaacagtggatatttccgtggctcttattcaaactctccatcaaatcctgtaaactccagagcaaatcaagatttttctgccttgatgagaagttcctaccactgtgcaatgaataacgaaaatgccagattacttacttttcagacatggccattgacttttctgtcgccaacagatctggcaaaagcaggcttttactacataggacctggagacagagtggcttgctttgcctgtggtggaaaattgagcaattgggaaccgaaggataatgctatgtcagaacacctgagacattttcccaaatgcccatttatagaaaatcagcttcaagacacttcaagatacacagtttctaatctgagcatgcagacacatgcagcccgctttaaaacattctttaactggccctctagtgttctagttaatcctgagcagcttgcaagtgcgggtttttattatgtgggtaacagtgatgatgtcaaatgcttttgctgtgatggtggactcaggtgttgggaatctggagatgatccatgggttcaacatgccaagtggtttccaaggtgtgagtacttgataagaattaaaggacaggagttcatccgtcaagttcaagccagttaccctcatctacttgaacagctgctatccacatcagacagcccaggagatgaaaatgcagagtcatcaattatccattttgaacctggagaagaccattcagaagatgcaatcatgatgaatactcctgtgattaatgctgccgtggaaatgggctttagtagaagcctggtaaaacagacagttcagagaaaaatcctagcaactggagagaattatagactagtcaatgatcttgtgttagacttactcaatgcagaagatgaaataagggaagaggagagagaaagagcaactgaggaaaaagaatcaaatgatttattattaatccggaagaatagaatggcactttttcaacatttgacttgtgtaattccaatcctggatagtctactaactgccggaattattaatgaacaagaacatgatgttattaaacagaagacacagacgtctttacaagcaagagaactgattgatacgattttagtaaaaggaaatattgcagccactgtattcagaaactctctgcaagaagctgaagctgtgttatatgagcatttatttgtgcaacaggacataaaatatattcccacagaagatgtttcagatctaccagtggaagaacaattgcggagactacaagaagaaagaacatgtaaagtgtgtatggacaaagaagtgtccatagtgtttattccttgtggtcatctagtagtatgcaaagattgtgctccttctttaagaaagtgtcctatttgtaggagtacaatcaagggtacagttcgtacatttctttcatgaagaagaaccaaaacatcgtctaaactttagaattaatttattaaatgtattataactttaacttttatcctaatttggtttccttaaaatttttatttatttacaactcaaaaaacattgttttgtgtaacatatttatatatgtatctaaaccatatgaacatatattttttagaaactaagagaatgataggcttttgttcttatgaacgaaaaagaggtagcactacaaacacaatattcaatcaaaatttcagcattattgaaattgtaagtgaagtaaaacttaagatatttgagttaacctttaagaattttaaatattttggcattgtactaataccgggaacatgaagccaggtgtggtggtatgtgcctgtagtcccaggctgaggcaagagaattacttgagcccaggagtttgaatccatcctgggcagcatactgagaccctgcctttaaaaacaaacagaacaaaaacaaaacaccagggacacatttctctgtcttttttgatcagtgtcctatacatcgaaggtgtgcatatatgttgaatgacattttagggacatggtgtttttataaagaattctgtgagaaaaaatttaataaagcaacaaaaattactctta

SEQ ID NO: 440 - DNA, 4238 bp, Homo sapiens
gggcagcaggtttacaaaggaggaaaacgacttcttctagatttttttttcagtttcttctataaatcaaaactacctccctagagaaaggctagtcccttttcttccccattcatttcattatgaacatagtagaaaacagcatattcttatcaaatttgatgaaaagcgccaacacgtttgaactgaaatacgacttgtcatgtgaactgtaccgaatgtctacgtattccacttttcctgctggggttcctgtctcagaaaggagtcttgctcgtgctggtttctattacactggtgtgaatgacaaggtcaaatgcttctgttgtggcctgatgctggataactggaaaagaggagacagtcctactgaaaagcataaaaagttgtatcctagctgcagattcgttcagagtctaaattccgttaacaacttggaagctacctctcagcctacttttccttcttcagtaacaaattccacacactcattacttccgggtacagaaaacagtggatatttccgtggctcttattcaaactctccatcaaatcctgtaaactccagagcaaatcaagatttttctgccttgatgagaagttcctaccactgtgcaatgaataacgaaaatgccagattacttacttttcagacatggccattgacttttctgtcgccaacagatctggcaaaagcaggcttttactacataggacctggagacagagtggcttgctttgcctgtggtggaaaattgagcaattgggaaccgaaggataatgctatgtcagaacacctgagacattttcccaaatgcccatttatagaaaatcagcttcaagacacttcaagatacacagtttctaatctgagcatgcagacacatgcagcccgctttaaaacattctttaactggccctctagtgttctagttaatcctgagcagcttgcaagtgcgggtttttattatgtgggtaacagtgatgatgtcaaatgcttttgctgtgatggtggactcaggtgttgggaatctggagatgatccatgggttcaacatgccaagtggtttccaaggtgtgagtacttgataagaattaaaggacaggagttcatccgtcaagttcaagccagttaccctcatctacttgaacagctgctatccacatcagacagcccaggagatgaaaatgcagagtcatcaattatccattttgaacctggagaagaccattcagaagatgcaatcatgatgaatactcctgtgattaatgctgccgtggaaatgggctttagtagaagcctggtaaaacagacagttcagagaaaaatcctagcaactggagagaattatagactagtcaatgatcttgtgttagacttactcaatgcagaagatgaaataagggaagaggagagagaaagagcaactgaggaaaaagaatcaaatgatttattattaatccggaagaatagaatggcactttttcaacatttgacttgtgtaattccaatcctggatagtctactaactgccggaattattaatgaacaagaacatgatgttattaaacagaagacacagacgtctttacaagcaagagaactgattgatacgattttagtaaaaggaaatattgcagccactgtattcagaaactctctgcaagaagctgaagctgtgttatatgagcatttatttgtgcaacaggacataaaatatattcccacagaagatgtttcagatctaccagtggaagaacaattgcggagactacaagaagaaagaacatgtaaagtgtgtatggacaaagaagtgtccatagtgtttattccttgtggtcatctagtagtatgcaaagattgtgctccttctttaagaaagtgtcctatttgtaggagtacaatcaagggtacagttcgtacatttctttcatgaagaagaaccaaaacatcgtctaaactttagaattaatttattaaatgtattataactttaacttttatcctaatttggtttccttaaaatttttatttatttacaactcaaaaaacattgttttgtgtaacatatttatatatgtatctaaaccatatgaacatatattttttagaaactaagagaatgataggcttttgttcttatgaacgaaaaagaggtagcactacaaacacaatattcaatcaaaatttcagcattattgaaattgtaagtgaagtaaaacttaagatatttgagttaacctttaagaattttaaatattttggcattgtactaataccgggaacatgaagccaggtgtggtggtatgtgcctgtagtcccaggctgaggcaagagaattacttgagcccaggagtttgaatccatcctgggcagcatactgagaccctgcctttaaaaacaaacagaacaaaaacaaaacaccagggacacatttctctgtcttttttgatcagtgtcctatacatcgaaggtgtgcatatatgttgaatgacattttagggacatggtgtttttataaagaattctgtgagaaaaaatttaataaagcaacaaaaattactcttattcttcattgctttatttcaatgacattggatagtttagtcactcccagactctttccataccttcttaaagcctctcaaatattgaactacagtttatactccttcccataagatgcttcttcattgacacttgtagaacacggggtcaacacatcataaaatctattatggaatgcctgagacaagaatcaaacagtccctttagtaagtttgtttattcacttctctattgattcattcaagaagtctcatgccagccccacctattggaagaaggtctgagttttattcttatctctttggtattaattctgaaacttagaaagtacactggttagcaatgcttgggaccaacaggttgttctggtaaataaatctgtttcatattgtcagtgcaacaaaatgtccccctctgcattatgttattggtactcaacacgtccgagtcataactctgtcctttgcttcttatagaggtattaggtcttcaagagcagaagtaagactgtaatagggaatactcaggggaaggcaggcaaaggctagtcatctaaaccagttctagatgtctgtataggggcagatggctctgtaagggcagaagggaaagaccccttcataagggtcacagctgacaatcctataacaaaagacaggttaacaagagaaaaacttaacaaatttatttaatcacagatttacatcaccggggagccttcgtaatgaagatccaaaattacaggggaaactgtgcatttttatgcttaggtttgataatgaatggacagccctgaagaatagtgattggaaaaaaaggatatgatctaatgggaatagacacaggttggggacccagcaaggcctgtctgttcagattattcttggtctctgtgcagcattccttcctcctggatatagggcagggcctgtatgggatggggatattataacctgctatcaagcaaggtaggtcagagaatttatttatggccagctcttacatagttaggtgaggaaagattagagtactatctttaagatgtaagtctggcattgtggaaagatggttccagtttctatgacctaccttggggaagaggaattcaagtttctgtggcttgccttcagggagaatgaggctgagacaggagggcaggataacatcagagaaaaactttgcttctgaggccttcactttgggttttctgagccccaacatctgctagtgttgtaaagagaacaattagggaccaagtgaggggaggaaagaatccatctctgcattctgatgctgggagacttatttccttgaaatgcaattgattttgcctctgctaagaggctctgctggctacccatgtactagccagtgtcctgcatgggtgctaggctgaattatttgtaattgtgcttaggtgatttgtaactcaggtatagggtatttaaatagtaggcaccctttttgcaccatgtgtttttttttttatctagttcttgtatactacagataatatttgaactttgtcatctcactgtaaaacttttgttcatttctcattatggtaataaatagctattataaccaacccatttattcaaatatgttatttccctaagtgttattttgacattttgttttggaaaaaataaatcaccatagataataa

SEQ ID NO: 441 - DNA, 2699 bp, Homo sapiens
cccagaaggccgcggggggtggaccgcctaagagggcgtgcgctcccgacatgccccgcggcgcgccattaaccgccagatttgaatcgcgggacccgttggcagaggtggcggcggcggcatgggtgccccgacgttgccccctgcctggcagccctttctcaaggaccaccgcatctctacattcaagaactggcccttcttggagggctgcgcctgcaccccggagcggatggccgaggctggcttcatccactgccccactgagaacgagccagacttggcccagtgtttcttctgcttcaaggagctggaaggctgggagccagatgacgaccccattgggccgggcacggtggcttacgcctgtaataccagcactttgggaggccgaggcgggcggatcacgagagaggaacataaaaagcattcgtccggttgcgctttcctttctgtcaagaagcagtttgaagaattaacccttggtgaatttttgaaactggacagagaaagagccaagaacaaaattgcaaaggaaaccaacaataagaagaaagaatttgaggaaactgcggagaaagtgcgccgtgccatcgagcagctggctgccatggattgaggcctctggccggagctgcctggtcccagagtggctgcaccacttccagggtttattccctggtgccaccagccttcctgtgggccccttagcaatgtcttaggaaaggagatcaacattttcaaattagatgtttcaactgtgctcttgttttgtcttgaaagtggcaccagaggtgcttctgcctgtgcagcgggtgctgctggtaacagtggctgcttctctctctctctctcttttttgggggctcatttttgctgttttgattcccgggcttaccaggtgagaagtgagggaggaagaaggcagtgtcccttttgctagagctgacagctttgttcgcgtgggcagagccttccacagtgaatgtgtctggacctcatgttgttgaggctgtcacagtcctgagtgtggacttggcaggtgcctgttgaatctgagctgcaggttccttatctgtcacacctgtgcctcctcagaggacagtttttttgttgttgtgtttttttgtttttttttttttggtagatgcatgacttgtgtgtgatgagagaatggagacagagtccctggctcctctactgtttaacaacatggctttcttattttgtttgaattgttaattcacagaatagcacaaactacaattaaaactaagcacaaagccattctaagtcattggggaaacggggtgaacttcaggtggatgaggagacagaatagagtgataggaagcgtctggcagatactccttttgccactgctgtgtgattagacaggcccagtgagccgcggggcacatgctggccgctcctccctcagaaaaaggcagtggcctaaatcctttttaaatgacttggctcgatgctgtgggggactggctgggctgctgcaggccgtgtgtctgtcagcccaaccttcacatctgtcacgttctccacacgggggagagacgcagtccgcccaggtccccgctttctttggaggcagcagctcccgcagggctgaagtctggcgtaagatgatggatttgattcgccctcctccctgtcatagagctgcagggtggattgttacagcttcgctggaaacctctggaggtcatctcggctgttcctgagaaataaaaagcctgtcatttcaaacactgctgtggaccctactgggtttttaaaatattgtcagtttttcatcgtcgtccctagcctgccaacagccatctgcccagacagccgcagtgaggatgagcgtcctggcagagacgcagttgtctctgggcgcttgccagagccacgaaccccagacctgtttgtatcatccgggctccttccgggcagaaacaactgaaaatgcacttcagacccacttatttctgccacatctgagtcggcctgagatagacttttccctctaaactgggagaatatcacagtggtttttgttagcagaaaatgcactccagcctctgtactcatctaagctgcttatttttgatatttgtgtcagtctgtaaatggatacttcactttaataactgttgcttagtaattggctttgtagagaagctggaaaaaaatggttttgtcttcaactcctttgcatgccaggcggtgatgtggatctcggcttctgtgagcctgtgctgtgggcagggctgagctggagccgcccctctcagcccgcctgccacggcctttccttaaaggccatccttaaaaccagaccctcatggctaccagcacctgaaagcttcctcgacatctgttaataaagccgtaggcccttgtctaagtgcaaccgcctagactttctttcagatacatgtccacatgtccatttttcaggttctctaagttggagtggagtctgggaagggttgtgaatgaggcttctgggctatgggtgaggttccaatggcaggttagagcccctcgggccaactgccatcctggaaagtagagacagcagtgcccgctgcccagaagagaccagcaagccaaactggagcccccattgcaggctgtcgccatgtggaaagagtaactcacaattgccaataaagtctcatgtggttttatct

SEQ ID NO: 442 - DNA, 2630 bp, Homo sapiens
cccagaaggccgcggggggtggaccgcctaagagggcgtgcgctcccgacatgccccgcggcgcgccattaaccgccagatttgaatcgcgggacccgttggcagaggtggcggcggcggcatgggtgccccgacgttgccccctgcctggcagccctttctcaaggaccaccgcatctctacattcaagaactggcccttcttggagggctgcgcctgcaccccggagcggatggccgaggctggcttcatccactgccccactgagaacgagccagacttggcccagtgtttcttctgcttcaaggagctggaaggctgggagccagatgacgaccccatagaggaacataaaaagcattcgtccggttgcgctttcctttctgtcaagaagcagtttgaagaattaacccttggtgaatttttgaaactggacagagaaagagccaagaacaaaattgcaaaggaaaccaacaataagaagaaagaatttgaggaaactgcggagaaagtgcgccgtgccatcgagcagctggctgccatggattgaggcctctggccggagctgcctggtcccagagtggctgcaccacttccagggtttattccctggtgccaccagccttcctgtgggccccttagcaatgtcttaggaaaggagatcaacattttcaaattagatgtttcaactgtgctcttgttttgtcttgaaagtggcaccagaggtgcttctgcctgtgcagcgggtgctgctggtaacagtggctgcttctctctctctctctcttttttgggggctcatttttgctgttttgattcccgggcttaccaggtgagaagtgagggaggaagaaggcagtgtcccttttgctagagctgacagctttgttcgcgtgggcagagccttccacagtgaatgtgtctggacctcatgttgttgaggctgtcacagtcctgagtgtggacttggcaggtgcctgttgaatctgagctgcaggttccttatctgtcacacctgtgcctcctcagaggacagtttttttgttgttgtgtttttttgtttttttttttttggtagatgcatgacttgtgtgtgatgagagaatggagacagagtccctggctcctctactgtttaacaacatggctttcttattttgtttgaattgttaattcacagaatagcacaaactacaattaaaactaagcacaaagccattctaagtcattggggaaacggggtgaacttcaggtggatgaggagacagaatagagtgataggaagcgtctggcagatactccttttgccactgctgtgtgattagacaggcccagtgagccgcggggcacatgctggccgctcctccctcagaaaaaggcagtggcctaaatcctttttaaatgacttggctcgatgctgtgggggactggctgggctgctgcaggccgtgtgtctgtcagcccaaccttcacatctgtcacgttctccacacgggggagagacgcagtccgcccaggtccccgctttctttggaggcagcagctcccgcagggctgaagtctggcgtaagatgatggatttgattcgccctcctccctgtcatagagctgcagggtggattgttacagcttcgctggaaacctctggaggtcatctcggctgttcctgagaaataaaaagcctgtcatttcaaacactgctgtggaccctactgggtttttaaaatattgtcagtttttcatcgtcgtccctagcctgccaacagccatctgcccagacagccgcagtgaggatgagcgtcctggcagagacgcagttgtctctgggcgcttgccagagccacgaaccccagacctgtttgtatcatccgggctccttccgggcagaaacaactgaaaatgcacttcagacccacttatttctgccacatctgagtcggcctgagatagacttttccctctaaactgggagaatatcacagtggtttttgttagcagaaaatgcactccagcctctgtactcatctaagctgcttatttttgatatttgtgtcagtctgtaaatggatacttcactttaataactgttgcttagtaattggctttgtagagaagctggaaaaaaatggttttgtcttcaactcctttgcatgccaggcggtgatgtggatctcggcttctgtgagcctgtgctgtgggcagggctgagctggagccgcccctctcagcccgcctgccacggcctttccttaaaggccatccttaaaaccagaccctcatggctaccagcacctgaaagcttcctcgacatctgttaataaagccgtaggcccttgtctaagtgcaaccgcctagactttctttcagatacatgtccacatgtccatttttcaggttctctaagttggagtggagtctgggaagggttgtgaatgaggcttctgggctatgggtgaggttccaatggcaggttagagcccctcgggccaactgccatcctggaaagtagagacagcagtgcccgctgcccagaagagaccagcaagccaaactggagcccccattgcaggctgtcgccatgtggaaagagtaactcacaattgccaataaagtctcatgtggttttatct

SEQ ID NO: 443 - DNA, 2512 bp, Homo sapiens
cccagaaggccgcggggggtggaccgcctaagagggcgtgcgctcccgacatgccccgcggcgcgccattaaccgccagatttgaatcgcgggacccgttggcagaggtggcggcggcggcatgggtgccccgacgttgccccctgcctggcagccctttctcaaggaccaccgcatctctacattcaagaactggcccttcttggagggctgcgcctgcaccccggagcggatggccgaggctggcttcatccactgccccactgagaacgagccagacttggcccagtgtttcttctgcttcaaggagctggaaggctgggagccagatgacgaccccatgcaaaggaaaccaacaataagaagaaagaatttgaggaaactgcggagaaagtgcgccgtgccatcgagcagctggctgccatggattgaggcctctggccggagctgcctggtcccagagtggctgcaccacttccagggtttattccctggtgccaccagccttcctgtgggccccttagcaatgtcttaggaaaggagatcaacattttcaaattagatgtttcaactgtgctcttgttttgtcttgaaagtggcaccagaggtgcttctgcctgtgcagcgggtgctgctggtaacagtggctgcttctctctctctctctcttttttgggggctcatttttgctgttttgattcccgggcttaccaggtgagaagtgagggaggaagaaggcagtgtcccttttgctagagctgacagctttgttcgcgtgggcagagccttccacagtgaatgtgtctggacctcatgttgttgaggctgtcacagtcctgagtgtggacttggcaggtgcctgttgaatctgagctgcaggttccttatctgtcacacctgtgcctcctcagaggacagtttttttgttgttgtgtttttttgtttttttttttttggtagatgcatgacttgtgtgtgatgagagaatggagacagagtccctggctcctctactgtttaacaacatggctttcttattttgtttgaattgttaattcacagaatagcacaaactacaattaaaactaagcacaaagccattctaagtcattggggaaacggggtgaacttcaggtggatgaggagacagaatagagtgataggaagcgtctggcagatactccttttgccactgctgtgtgattagacaggcccagtgagccgcggggcacatgctggccgctcctccctcagaaaaaggcagtggcctaaatcctttttaaatgacttggctcgatgctgtgggggactggctgggctgctgcaggccgtgtgtctgtcagcccaaccttcacatctgtcacgttctccacacgggggagagacgcagtccgcccaggtccccgctttctttggaggcagcagctcccgcagggctgaagtctggcgtaagatgatggatttgattcgccctcctccctgtcatagagctgcagggtggattgttacagcttcgctggaaacctctggaggtcatctcggctgttcctgagaaataaaaagcctgtcatttcaaacactgctgtggaccctactgggtttttaaaatattgtcagtttttcatcgtcgtccctagcctgccaacagccatctgcccagacagccgcagtgaggatgagcgtcctggcagagacgcagttgtctctgggcgcttgccagagccacgaaccccagacctgtttgtatcatccgggctccttccgggcagaaacaactgaaaatgcacttcagacccacttatttctgccacatctgagtcggcctgagatagacttttccctctaaactgggagaatatcacagtggtttttgttagcagaaaatgcactccagcctctgtactcatctaagctgcttatttttgatatttgtgtcagtctgtaaatggatacttcactttaataactgttgcttagtaattggctttgtagagaagctggaaaaaaatggttttgtcttcaactcctttgcatgccaggcggtgatgtggatctcggcttctgtgagcctgtgctgtgggcagggctgagctggagccgcccctctcagcccgcctgccacggcctttccttaaaggccatccttaaaaccagaccctcatggctaccagcacctgaaagcttcctcgacatctgttaataaagccgtaggcccttgtctaagtgcaaccgcctagactttctttcagatacatgtccacatgtccatttttcaggttctctaagttggagtggagtctgggaagggttgtgaatgaggcttctgggctatgggtgaggttccaatggcaggttagagcccctcgggccaactgccatcctggaaagtagagacagcagtgcccgctgcccagaagagaccagcaagccaaactggagcccccattgcaggctgtcgccatgtggaaagagtaactcacaattgccaataaagtctcatgtggttttatct

SEQ ID NO: 444 - DNA, 476 bp, Homo sapiens
agatttgaatcgcgggacccgttggcagaggtggcggcggcggcatgggtgccccgacgttgccccctgcctggcagccctttctcaaggaccaccgcatctctacattcaagaactggcccttcttggagggctgcgcctgcaccccggagcggatggccgaggctggcttcatccactgccccactgagaacgagccagacttggcccagtgtttcttctgcttcaaggagctggaaggctgggagccagatgacgaccccattgggccgggcacggtggcttacgcctgtaataccagcactttgggaggccgaggcgggcggatcacgagagaggaacataaaaagcattcgtccggttgcgctttcctttctgtcaagaagcagtttgaagaattaacccttggtgaatttttgaaactggacagagaaagagccaagaacaaaattgagagagctctgttagcagaatga

SEQ ID NO: 445 - DNA, 15703 bp, Homo sapiens
tccctgcttctccccctctcccgtcagcctccctccgagtttggcccctccggccgggcgatcgacgttccgcgtgcgtgcgggcgcctgacttcacttccggctaacgcgctcggcttgccccctggccccggatggtgactggtggtggtgctgcacctcccgggactgtcactgagccgcttcccagtgtgattgtgctgagcgcaggccggaagatggcggctgcggctgcggcggcctcgggccccggctgctcctcggcggcgggggcgggggcggccggggtctcagagtggctggtgctgcgggacggctgcatgcactgcgacgccgacgggctgcacagcctgtcctaccaccctgcgctcaacgccatcctggccgtcactagccgcgggaccatcaaagtcatcgacggcacctcgggggccacactgcaggcctccgcgctcagtgctaaaccaggtggacaggtgaaatgtcagtatatctctgctgtggataaagttatatttgtggatgattatgcagtagggtgtaggaaggaccttaatggaatcttgttgttagacactgctctgcaaactccagtttcaaagcaggatgatgtggttcagcttgaattacccgttacagaggcacagcagctcttatcagcatgtttagaaaaggtagatatttctagtacagagggttatgatttgttcatcacacagctcaaagatggtttaaaaaatacatctcatgagactgcagcaaaccacaaagttgctaagtgggccacagttacatttcatcttcctcatcatgtgttgaagtccattgccagtgccattgtaaatgaactcaagaaaataaatcaaaatgttgctgccttacctgtggcgtcctcagtgatggacagattgtcttacctcttacctagtgcacgtccagaactcggagtggggccaggccgttctgtagacagatcactgatgtatagtgaagctaacagacgggagacatttacctcatggcctcatgtaggctataggtgggcacaaccagatcccatggctcaagctggattttatcatcagcctgcctcatctggagatgatagagccatgtgttttacttgtagtgtatgcctcgtttgttgggaacctactgatgaaccttggtctgaacacgaaagacattccccaaactgcccatttgtgaaaggtgagcacacacagaatgtgccattgtcagtcactcttgcaacaagtcctgcacagtttccttgtacggatggaactgacagaatatcttgctttgggtcggggagctgccctcattttctagctgctgcaactaaacgaggaaagatctgcatatgggatgtttccaaacttatgaaggtgcacttaaagtttgaaattaatgcctatgatccagcaattgtacaacagcttattctatcaggagacccaagctcaggagttgattcaaggagaccaactttggcgtggctggaggactcctctagttgctcagatataccaaaattggaaggagatagtgatgatttactggaggattcagacagtgaagagcattccagatcagattctgtgacagggcatacatcacagaaggaagccatggaagtaagccttgatataacagcactcagcattctccaacagccagaaaaacttcagtgggagattgttgcaaatgtgcttgaagatactgttaaggatcttgaagaacttggggcaaatccttgtttaacaaactctaagagtgaaaagacaaaggaaaagcaccaggagcaacacaacattccttttccatgtttattagctggaggtttattaacatataaatctcctgctacctcacccattagtagtaattctcacaggtcactggatggtttaagcagaactcagggtgaaagtatatcagaacaagggtcaactgacaatgaatcctgcactaattcagaactaaattctcctctggtaaggaggactttaccggttttgcttctttatagcatcaaggaatctgatgagaaagcaggaaagatcttttcacagatgaacaatattatgagtaaaagtttgcatgatgatggttttactgttccacagattattgaaatggagctggatagtcaggagcagttgttattgcaggatcctcctgtgacttacattcagcaatttgcagatgcagcagccaaccttacctctccggattctgagaagtggaactctgtgtttcccaagcctgggactttggttcagtgcttgaggctgccaaagtttgcagaggaggagaatctttgtatagactcaataactccttgtgctgacggaattcatttgttggtaggactgcggacatgccctgttgaatccttgagtgcaataaatcaagtagaggccttgaataatttaaataaattaaactctgcactatgtaatagacggaaaggtgagctggaatcaaatcttgctgtagtgaatggtgcaaatattagtgtaatccaacatgaatcaccagcagatgtacagactcctttaataattcagcctgagcagaggaatgttagtggtggatatttagtgctttataaaatgaattatgccactcggatagtgactttagaagaggagccaataaaaatacaacatatcaaagatccccaggacacaattacctcgctcattttgcttccacccgatatattggataatcgagaggatgactgtgaggaacctattgaggacatgcagttaacctcaaagaatggttttgagagagaaaaaacgtctgacatttctactcttggacacctggtaataaccactcagggaggatatgtaaaaatactagatctttcaaactttgaaattttggccaaagtggagcctcccaaaaaggagggcactgaggaacaggacacatttgtttctgtgatttactgttctggcacagacaggctgtgtgcatgcaccaaaggtggtgagcttcattttctccaaattggaggaacctgtgatgatattgatgaagctgatatactagtggatggatctctttctaaaggaatagaaccatcttcagaaggttccaaacctttatcaaatccttcaagtcctggcatttcaggagttgatttattggtggaccagccattcacccttgaaatcttgacatccctagtggagctaacccgctttgagactttgactccaaggttttcagcgactgttcctccatgctgggtagaagttcaacaagaacagcagcaaaggaggcatcctcaacatttgcatcagcaacaccatggtgatgctgctcagcatactcgaacttggaaactacagaccgacagcaacagctgggatgaacatgtatttgaattagtactacctaaagcttgtatggttggacatgtggacttcaaattcgttttgaactcaaacatcaccaatattccacagatacaagtgacactgctgaaaaataaagctccaggattagggaaagtcaatgctcttaacattgaagtggaacaaaatgggaaaccgtccctggttgatttgaatgaagaaatgcagcacatggatgtagaggaatcacagtgtcttagattatgtccatttttggaggatcataaagaagacattctatgtgggccagtatggcttgctagtggccttgatctatcagggcatgctggaatgttgacgttaacaagccccaaacttgttaaaggtatggcaggaggaaaatatcgttcgtttttaatccatgtcaaggcagtgaatgaaagaggaacagaagagatttgtaatggtggtatgcgtcctgtagtaaggcttccatccctaaaacaccagagtaacaagggttattcacttgcttcacttttggctaaagttgcagcaggcaaggaaaaatcatctaatgttaagaatgaaaatacaagtggcacccgtaaatctgaaaacctccggggctgtgatttacttcaagaggtctcagtcaccattcgaagatttaagaaaacctcaatttctaaggaaagagtgcaacgatgtgccatgttacagttttcagaatttcatgagaagcttgttaatactctttgcagaaaaacagatgatggccagatcacagaacatgcccagagccttgtgttggatactctctgttggttagctggagttcattcaaatggacccggaagctcaaaggaaggaaatgagaacctactttcaaaaacacgaaaatttctgtcagacatcgtacgtgtttgcttctttgaggcaggacgaagtatagcccataagtgtgcccgatttctagccttgtgcattagtaatggcaaatgtgacccatgtcaaccagcatttggacctgttctgttgaaggctttacttgataatatgtcatttttacctgcagcaacaactggtggttctgtctattggtattttgtcttactgaattatgtgaaagatgaagatctggctggatgcagtacagcttgtgcatctttgcttactgcagtgtccagacagttacaggacaggctaacaccaatggaggctttacttcagacaagatatggattatatagctcaccatttgatccagtcctctttgatttggagatgagtggctcttcttgtaaaaatgtttataacagcagcattggtgtccagtcagatgaaattgatttatcagatgtcctttcaggaaatggaaaggtcagtagttgcacagctgctgagggtagtttcacatctctcactggacttttggaagttgaacctctgcactttacttgtgtgtcaactagtgatggaaccagaatagaaagggatgatgcaatgagttccttcggggttactcctgcagtaggtggactatcatctgggacagttggggaagcctcgacagccctgagttcagcagcccaggtagctttgcagtctctctctcatgcaatggcttcagccgagcaacagctacaggtgctgcaagagaaacagcagcagcttttgaagcttcagcaacagaaagcaaagctggaagccaagttacatcagacaacagctgcagcagctgcagcagcatcagcagtaggtcctgttcacaactctgtgccttccaacccagtggctgcccctggattcttcattcatccatctgatgttattccacccactccaaaaacaacacctctttttatgactccaccactcactccacccaatgaagcagtttccgttgtgattaatgccgaacttgcacagcttttcccaggctcagtcattgatcccccagcagtcaatcttgctgcacataacaaaaattccaacaagtccagaatgaatccacttggttctggtctagcccttgcaatttctcatgcttcacattttcttcaacctccgcctcaccagtccattattatagagcgaatgcattcaggagcaagaagatttgtgaccttggattttgggaggcctatattgttgactgatgtattgattcccacttgtggagacttggcctctttgtcaattgacatttggacattaggagaagaggtggatggaaggcggttggtagtggcaactgatataagcactcattcactaattcttcatgacttaataccacctcccgtgtgcagattcatgaagatcactgttattggacgttacgggagtacaaatgccagagccaaaatcccattaggattttactatggtcatacctacatcttgccttgggaaagtgaactgaagttaatgcatgatcctctaaagggagagggagaatctgcaaaccagccagaaattgaccagcatttagcaatgatggttgctttgcaggaggatatacagtgcaggtataacttggcttgtcatcgtctggaaacccttttgcaaagtattgatcttcctcctctaaacagtgctaacaatgcacagtactttttacgaaaaccagataaggcagttgaggaagacagtagggttttttctgcttatcaagattgtattcagctacagcttcaactaaatttggctcataatgcagtgcagaggctcaaagtggcgctaggtgcaagccggaagatgttgagtgaaacatcaaatccagaagatttaattcagacatcttccacagagcagttacgtactatcatcagatatttactggacactttgctcagcctgcttcatgcttctaatggacactctgttcctgcagttttgcagagcacatttcatgcccaggcctgtgaagagctctttaaacacttgtgcatcagtggaaccccaaagatacggttacatactggtcttcttcttgttcaactgtgtggtggtgaaaggtggtggggtcaatttctttctaatgtccttcaggaattgtacaattcggaacagcttctcatctttccacaggatagggtcttcatgttactttcctgcattggtcaaagatcacttagtaatagtggagtattagaaagcttacttaatctcttggataatttattgtcacctcttcagccacagttacccatgcataggaggacagaaggagtactagatattcccatgatcagttgggttgttatgctggtgtccaggttgctggattatgtggcaactgttgaagatgaagcagcagctgcaaagaaacctttgaatggtaatcagtggagttttattaacaataatctacacactcagagcttaaatagatcttctaaaggcagcagtagccttgatagattatattccagaaaaatcagaaagcagcttgttcatcataaacagcaacttaacctactaaaagcaaagcagaaggcattggtagaacagatggaaaaagaaaaaatacaaagtaacaaaggatcatcatataaactcctggtagaacaagcaaaactaaagcaggccacttcaaagcactttaaggatttaattcgtttacgtcggacagcagaatggtcccgttctaatttagacacagaagttacaacagcaaaagaaagtcctgagatagaaccacttccatttactctggcccatgagcgttgtatctcagtagtccagaaacttgttctgtttcttctctccatggactttacatgtcatgcagatctcttattgtttgtttgtaaggttcttgcacgcattgcaaatgccacgaggccaactattcatctgtgtgagattgtgaacgaaccccagctggaaagactgctgttacttttggttggaactgacttcaatagaggagatatatcttggggtggtgcttgggctcagtattccttaacttgcatgctacaagatattttagcaggagaattactggctccagtagccgcagaagccatggaggaaggaacagtgggtgatgatgtaggtgcgacagctggtgactctgatgactcccttcaacagtcctcagttcagttgctggaaactatagatgaacctttgacacatgacataacaggtgcacctcctctgtcctctttggaaaaagataaagaaattgaccttgagttacttcaggatctaatggaagttgacattgatcctttagatattgatttggaaaaggaccctcttgcagccaaggtttttaagccaataagcagtacatggtatgattattggggtgctgattatgggacctacaattacaacccttacattggaggtctgggaattcctgtagcaaagccaccagcaaacacggagaagaacggatcacagacagttagcgtttcagtctctcaggccctggatgctcgcctagaagttggacttgaacagcaagcagaactgatgttgaaaatgatgtctactctggaggcagattccattttacaggcattaacaaatacatctcctacattatcacagtctcccactggaacagatgattcacttctagggggtttacaagcagcaaaccaaaccagccagcttattatacagttatcatctgtcccaatgttaaatgtttgtttcaacaaacttttttccatgcttcaagtccatcatgttcagttggagtcacttctccaattgtggctcacactgagcctgaattctagttcaactggaaacaaagaaaatggagcagacatatttttatataatgctaataggatacctgttatttcattaaatcaagcatcaataactagctttctcacagtgttagcttggtatcccaatactttgctccggacatggtgccttgtgcttcatagcctaacactcatgacaaacatgcagcttaattctggttccagcagtgccattggaactcaggagagtactgctcatttgttggtttcagatccaaacctaattcatgtattagtgaaatttctttctggcaccagtccacatggaacaaatcaacacagtccacaggttggtcctacagctacacaagctatgcaagaatttcttactcgattacaagtgcatctttcttcaacatgtcctcagatattcagtgaatttttgctcaagctaattcatatactttcaactgaaaggggtgctttccagacaggccaaggacctctcgatgcccaagtgaagctcttagaattcactctggagcagaattttgaagtcgtttcagttagtactatttctgccgtgatagaatcggttacatttttagtgcaccactatatcacttgctcagacaaagtaatgtcaagaagtggatcagatagctccgtgggtgctcgagcatgctttgggggactctttgccaatcttattcgtccgggtgatgcaaaagcagtttgtggcgaaatgacaagagatcaactcatgtttgatttgttaaaacttgttaacattttagtgcagctgcctctttcaggcaatagggaatacagtgcaagagtgtctgtgaccacaaatacaacagatagtgtttcagatgaagaaaaagtctcaggaggcaaagatggcaatggaagcagtaccagtgttcaaggatcgcctgcatatgttgctgacttagtcttagccaaccaacaaattatgagccagattttgtctgctctgggcctgtgtaatagcagtgccatggcaatgataattggagcaagtggattacatctcactaaacatgaaaactttcatggtgggttggatgccatatcagttggggatggattatttaccatactgacaacccttagtaaaaaagcttctacagtccacatgatgctgcagccaattttaacatacatggcctgtggatatatgggcagacaaggctctcttgctacttgccagttatctgagccattattgtggttcattttgagagtattggatactagtgatgccttgaaagcatttcatgatatgggtggtgttcagctcatatgcaataatatggttactagtacaagggctattgtgaacactgcaagaagtatggtatcaactattatgaaatttcttgactctggtccaaataaagctgttgacagcacattgaaaacaagaatactagcttctgagcctgacaatgctgaagggattcataactttgcacccctcggtacaatcacatctagcagtcctactgcccaaccagctgaagtgctattgcaggccacacctcctcacagaagagctcgctctgctgcttggtcctacatctttcttccagaggaggcttggtgtgaccttaccattcaccttcctgcagcagtgctgcttaaggagatacatatccagcctcatcttgcatctcttgcaacctgcccttcctcagtgtctgttgaagtaagtgcagatggggtaaatatgctacctttgtccactcctgttgtcacaagtggcctcacctacataaaaattcagcttgtaaaagccgaagtagcttctgctgtctgccttagactacatcgtccacgggatgccagcacattaggcctttcacaaattaaattattggggctcactgcttttggtaccacctcttctgcaacagttaataatccattccttccatctgaagatcaggtatccaaaacaagtattggatggttacggttattacatcattgccttactcacataagtgatctagaaggaatgatggcaagtgcagctgcacctactgctaatctgctgcagacttgtgcggccttattgatgtcaccttactgtggaatgcattcacccaacatcgaggttgtgcttgtaaagataggactgcagtctactagaattggcctgaagctcatagacattctcctgagaaattgtgcagcatcaggcagtgatcctacagatttgaatagtcctttactttttggaagactaaatggactctcttctgactctacgatagatattctttaccagcttggaacaactcaggatcctggtacaaaagacagaattcaggccttgttaaaatgggttagtgattctgcaagagtggctgctatgaagagaagtggcaggatgaactacatgtgtcctaactcctcaacagtagagtatggtcttctgatgccatctccttctcatttgcactgtgtagcagccattctgtggcatagttatgagctgcttgtagaatatgacttaccagcactcctggaccaagagctctttgagttactttttaattggtccatgtctcttccctgcaatatggttttgaagaaagctgttgacagtctactttgctcaatgtgtcacgtacacccaaactatttttctttgctcatgggctggatgggaattacccctcctccagtgcaatgtcatcatagactgtccatgacagatgatagcaaaaagcaggatcttagttcatctttaacagatgactctaaaaatgcacaagcacctctcgcattaactgaatcacatttggctacccttgcttcctcttctcaatctcctgaagctattaaacaattactagactcaggtttgccttctcttcttgtgaggagtctggctagtttctgctttagccacatttctagctcagaaagcattgcccagtcaatagatatttcccaggacaaactcaggcgccatcatgtcccacaacaatgtaataagatgcctatcacagccgacctagttgctcctattcttaggtttttgacagaagttggcaatagccatattatgaaagattggcttggtggttctgaagtcaatccactatggacagcacttctgtttttattgtgtcactctgggtccacttctggaagccataatttaggtgcacaacagaccagtgcaagatcagcttctctttcttcagctgctacaacaggactgactactcaacagcgcacagcaattgagaatgcaactgttgcgttctttctacagtgcatttcatgccatcctaataatcaaaagctgatggcacaggttctttgtgaactatttcagacatctcctcaaagagggaaccttccaacatctgggaacatttcagggtttatacgaagattatttttacagttgatgctggaagatgagaaagtgacaatgtttcttcagtctccatgtccactgtacaaaggtagaattaatgctactagccacgtcatccagcatccaatgtatggagcaggccacaaattccgtactcttcatttgccagtctcaacaacattatcagatgttcttgacagagtgtcagatactccaagtatcacagctaaattaattagtgaacaaaaagatgacaaagaaaagaaaaaccatgaagagaaagaaaaagttaaagcggaaaatggatttcaagacaattacagtgttgttgttgcctctgggctgaagtctcaatctaaacgtgctgtgtcagctacaccacctcgcccaccatccaggagggggaggacaatacctgataaaataggaagtacttcaggagcagaggctgccaacaaaataattactgtcccagtgtttcacctgtttcacaaactcttggcaggccagccattgccagctgaaatgacacttgcccagcttttaactctcctatatgaccgaaaacttcctcagggttaccgctcaatagatctgactgttaaattgggatcaagagttataacagaccccagtctatcaaaaacagattcttataaaagactacaccctgaaaaagatcatggagacttacttgctagctgtccagaagatgaggctctcactccaggtgatgaatgcatggatgggatactggatgaatctttgcttgaaacctgtccaattcagtcaccattacaagtttttgcaggaatgggtggactggctcttattgctgaaagactacccatgctatatccagaagtaattcaacaggtgagtgctccagttgtaacatctaccactcaggaaaagccgaaggatagcgatcagtttgaatgggtgaccattgaacagtcaggggagttagtttatgaagcaccagaaactgttgcggctgaacctccacctatcaagtcagcagtacagaccatgtctcccatacctgcccattctttggctgcttttggattatttcttcgtcttccgggctatgcggaagtgctactgaaagagagaaaacatgcccagtgccttcttcgattggtattgggagtgacagatgatggagaaggaagtcatattcttcaatctccatcagccaatgtgcttccaacccttcctttccacgtccttcgtagcttgtttagcactacacctttgacaactgatgatggtgtacttctaaggcggatggcattggaaattggagccttacacctcattcttgtctgtctctctgctttgagccaccattccccacgagttccaaactctagcgtgaatcaaactgagccacaggtgtcaagctctcataaccctacatcaacagaagaacaacagttatattgggccaaagggactggctttggaacaggctctacagcttctgggtgggatgtggaacaagccttaactaagcaaaggctggaagaggaacatgttacctgccttctgcaggttcttgccagttacataaatcccgtcagtagtgcggtaaatggagaagctcagtcatctcatgagactagagggcagaacagtaatgcccttccttctgtacttctcgagcttctcagtcagtcctgcctcatcccagccatgtcatcttatctacgaaatgattcagttctggacatggcaagacatgtgccactctatcgggcactgctggaattgcttcgggccattgcttcttgtgctgccatggtgcccctattgttgcccctttctacagagaacggtgaagaggaagaagaacagtcagaatgtcaaacttctgttggtacattgttagccaaaatgaagacctgtgttgatacctataccaaccgtttaagatctaaaagggaaaatgttaaaacaggagtaaaaccagatgcgtctgatcaagaaccagaaggacttactcttttggtaccagacatccaaaagactgctgagatagtttatgcagccaccaccagtttgcggcaagcaaatcaggaaaaaaaactgggtgaatactccaagaaggcggctatgaaacccaaacctttgtcagtattaaagtcacttgaagaaaaatatgtggctgttatgaagaaattacagtttgatacgtttgaaatggtttctgaagatgaagatgggaaattgggatttaaagtaaattaccactacatgtctcaggtgaaaaatgctaatgatgcgaacagtgctgccagagctcgccgccttgcccaggaagctgtgacgctttcaacctcactgcctctgtcttcatcctctagtgtgtttgtacgctgtgatgaggagcgacttgatatcatgaaggttctaataactggtccagcggacaccccttatgcaaatggctgctttgagtttgatgtgtattttcctcaagattatcccagttcaccccctcttgtgaatctagagacaactggtggtcatagcgtgcgattcaatccaaacctttataatgatggcaaggtttgtttaagcatcttaaacacgtggcatggaagaccagaagagaagtggaatcctcagacctcaagctttttgcaagtgttggtgtctgtccagtcccttatattagtagctgagccttattttaatgaaccgggatatgaacggtctagaggcactcccagtggcacacagagttctcgagaatatgatggaaacattcgacaagcaacagttaagtgggcaatgctagaacaaatcagaaacccttcaccatgttttaaagaggtaatacacaaacatttttacttgaaaagagttgagataatggcccaatgtgaggagtggattgcggatatccagcagtacagcagtgataagcgggtaggcaggactatgtctcaccatgcagcagctctcaagcgtcacactgctcagctccgcgaagagttgctgaaacttccctgccctgaaggcttggatcctgacactgacgatgccccagaggtgtgcagagccacaacaggtgctgaggagactctaatgcatgatcaggttaaacccagcagcagcaaagaactccccagtgacttccagttatgagctgcattgatgtggacttcatagacacaaaggcttcgaagcacaagccaaatatgtcaatatttgtatgtaagaaactaattatgtaataggtaatgaaactgaaactatactatgcccttaaggagatccagtttaattcaaggtgatcttttatttacctgtacaggagtgtaaacttttttgtgcttttatttttcaattgtgagaaccactgattggtatgttcaacaaatttgtgtatacaaagaaatggataaatcactgctatataagggaaactaccttaggaaagaatgtttactgaatgtttattttattttattttttttttactatagagtgaggggttgttaacaaagaatatatattggtcattcttacaactactatttaaagtcagcaacttttcactgaatttgatagattttatgtttggccatatcttcatgctcacatttgatttctgaagacctcctacatacacttcaataaaagttaaatggacatactccctcttttttgatttactggtacatttttaaaataataaatctgccataaaatgcattatatctggagacttgcacttgtatggatgaatttattacattcaacatatttaattttatgccttctaattctaagatgcagaaaaaaataaatgaacatgattttattctatgccaacatttgggcctctgaatgtatctgttatttgaatttaagtatttgaaaaggaatggtcaatttgaaagtcattctaaactgattttttttttctaaagggctccttttttcctggactatgtggttttatgactaaagtcacatgtatgtattaaacattgaggctctgtagaggagagaggatgtacctctctggtgctgttacagtacattctgtacctgccatacaggctcattttcatgcaaattcttcctagagccaaataaataaagacttaggtgaattagtatgtcttgtttctaaa

SEQ ID NO: 446 - DNA, 3188 bp, Homo sapiens
ctctgtggttcgggtccgctttcgtctccgtcctgctgccgttaccgccgctgctgccgccgcttgcgtcccccgctccggtctgtggtgcagccgggacccaggaccatgtctctgtctcgctcagaggagatgcaccggctcacggaaaatgtctataagaccatcatggagcagttcaaccctagcctccggaacttcatcgccatggggaagaattacgagaaggcactggcaggtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgcccaggagagcacacccatcatgaacggcgtcacaggcccggatggcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccaccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccagggcctggatgactatggagcgcggtccatgagcagtggcagcggcacgctggtgtccacagtgtgaggacgctgaccccgggcagccgctgctctgaagagcttccgcgccttccccctggtctcgtccgttttcctcctcagctctcgctggtttgttcttgggttgtttttcttttccacctgccccatgccttttggttggtgaccccagactctgtgatcccccagggtccatggtgctgctccatccgccccccctcccctgtgtttacgcgccccatcctgtgtgtcccagccttttgagcagaaactgccaggcaggacctgctgggccgtgcggggcaccctcggcctcaccctgcagtgtctgtggcactcactgcttttctaaggctcgccgtgagccaggtctaaagtttgaagaaaaagaaaaatcttaaaaaaaaaaaaaaaaaaaaaaagaaaaaaagaaaaacaggaaaaaggactttttttttcctgaaaaacaaaaaccgatctgcatggactccggtgtgcgctgttatctcgcatccgacttccccggtgcgatggcctctgtccggacagggaaggtgctggggtccctggccgccccggcccctgtggaggggtgcacagagaaagggggctcgtgccaagctcgaggggcctcctgaggaagccggccgctcctgtgagggaggccgggcccgggcacctgagggcttctccctctggacactgcgggccaggtgtacatagagcagcgcggcacagtggcctcacctcccgtcgggcactggcgggagcaaggtcgggggcaggcgctgcccagctggccgcacacggacattccaaagacctccagagaccaccccacccccacattcctttgaccagccttgtgagggcatcgatgctgccccgggctacctggctgctctgggcagggtgtgcgggccgggcccggctgggggagggcagctctgggcacgccgcacccacgccccccacctgggggaaacaggcggttcctgcccggttcttcctaaacgctctcgtctttttgtgtgtcttggtgactttagaaacaaacacagtggactcagtggctactggtattgtctcttcccacactgaactctggggaattgagtgcagggcacagcccggctcagcctgcccgctggtgggagcccctgggaagctgcggcgctcctttatctgatgtggtttagtaaaagcctcccacacacctccccgtggcctgggacgtggctggtagtgtttgtgtgggaagcagctcaagacgcggaccgcgtgacattaaggagagctcaagggcggaccgggccctgtgtagagacccttccgcgccggcgttcccgctccgctaaagatttcaaatccaggggattccatgctcaatggatgaatgtagacacaaaacagcaacacttgtatgaagatgtaaagtgctgaacatatttttttcctgtttcctttccttttttttaaaaaatctgaattgtgccctgtactgcagttacttgtttgaataaaagttttatttattgc

SEQ ID NO: 447 - DNA, 2894 bp, Homo sapiens
ctctgtggttcgggtccgctttcgtctccgtcctgctgccgttaccgccgctgctgccgccgcttgcgtcccccgctccggtctgtggtgcagccgggacccaggaccatgtctctgtctcgctcagaggagatgcaccggctcacggaaaatgtctataagaccatcatggagcagttcaaccctagcctccggaacttcatcgccatggggaagaattacgagaaggcactggcaggtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgcccaggagagcacacccatcatgaacggcgtcacaggcccggatggcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccaccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccagggcctggatgactatggagcgcggtccatgagcaggaatccctttgcccacgtccagctgaagccgacagtgaccaacgacaggtgtgatctgtccgcccaagggccagaaggccgggagcacggggatgggagcgcccgcaccctggctggaagatgaacttcccgtaagcacgtaattccctgcaggtccggcagctacacctggagtgtggggcctggtccctccccatgcccctcggtggggctctcctgggcccctcactcccactggcaatgtcacaagggcctccccaggcccctcctgcctcgggcaggccccagccctcctccttacccaacctcccatccagaaccttgctgccagggcctcccagctcgctcctgcggccaaaggccagctgtcaggtgctatgcggggtcaccagcagagtgcccgctggcaggtgggggcttccccgcttccggggtctgccccaggactcctgggtggacctcccccccccacctccgctgactcctgcaggcactggggagctctgctggaattgggggttttaaaacttcattagcagatttgtgctcttccatactgtttgtttgtttgttaggtgaaatacagtgtggtgagctgcactggtgacaacagcccttacctggctggggaggtgtctccagcagagctcactcccgcctacagccactcacaccccggggacaggaagctgtagagttggcgggccaggagggcagttgagagctggccagcggagggtgcagggaagcccagctgtgctcaactctcctgcctccgccttccaccctgggcccagggacagacagacattgccctcagaagggcagggaggaggctgtcctggagaggcctgtaggtccattcttcacccgtccctaccaggccaactcggcctgcaggaagggagacctgcagggcgctacccctgcgcccccacacacagtagggccagaacaccatcccctccaccggggtgtgccgaggacagtggggaggagaggagaggggcagcttcctcctggccccaggaagggctggcatcgggttcctggcacagcccctcctgtccaggactttatcatcggcagacctcagaagacaacacacaaaggtttcttttgtcttagcttcatttctcttaaaaaacaaggaacaagaaaacattgcaccagcgttctaagcctcaaacaaaacacaaaacaaatccccctgcgaagcaacaataaactttacatctctttggcaacaat

SEQ ID NO: 448 - DNA, 1686 bp, Homo sapiens
tgtggttcgggtccgctttcgtctccgtcctgctgccgttaccgccgctgctgccgccgcttgcgtcccccgctccggtctgtggtgcagccgggacccaggaccatgtctctgtctcgctcagaggagatgcaccggctcacggaaaatgtctataaggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgcccaggagagcacacccatcatgaacggcgtcacaggcccggatggcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccaccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccagggcctggatgactatggagcgcggtccatgagcaggaatccctttgcccacgtccagctgaagccgacagtgaccaacgacaggtctgcccccctcctcagctgatggccacatctgcagtgctgcccatctggtggcttcccccgcccttcccatgtagcctgttctgtcatcatctgtgcgttcctgtgtagagaacatccaggccccggctgcctggtcttgccccacttgagtctggcct

SEQ ID NO: 449 - DNA, 1442 bp, Homo sapiens
atgctcctcccagagggacagaggcagagagccctggggtttggaactgtcacttccacctacagccctgttggtcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgcccaggagagcacacccatcatgaacggcgtcacaggcccggatggcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccaccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccagggcctggatgactatggagcgcggtccatgagcaggtaaggggactttcagacctgtctttgggaccgtgggtgggtgtgaagaggccgggtggggcaggtccctctgctaggacctggggccacctcttttcctttagggcccagcctggcccttcacccctgtcagagccggggatgtcccttagggcgtcctgctttctccgagtgacacgggaacccccctgggccctgcccctctttcatcgcatctggccggccccatccatccctgtcaggcaaggttggggagggtagctgaggctggcatccatggctggggctgcagcctcctctgccccaatctgtgctccg

SEQ ID NO: 450 - DNA, 3306 bp, Homo sapiens
ctctgtggttcgggtccgctttcgtctccgtcctgctgccgttaccgccgctgctgccgccgcttgcgtcccccgctccggtctgtggtgcagccgggacccaggaccatgtctctgtctcgctcagaggagatgcaccggctcacggaaaatgtctataagaccatcatggagcagttcaaccctagcctccggaacttcatcgccatggggaagaattacgagaaggcactggcaggtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgcccaggagagcacacccatcatgaacggcgtcacaggcccggatggcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccaccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccagggcctggatgactatggagcgcggtccatgagcaggaatccctttgcccacgtccagctgaagccgacagtgaccaacgacaggtctgcccccctcctcagctgatggccacatctgcagtgctgcccatctggtggcttcccccgcccttcccatgtagcctgttctgtcatcatctgtgcgttcctgtgtagagaacatccaggccccggctgcctggtcttgccccacttgagtctggcctggactggatcccagctgttctaggcagggccgggcagagtggggcgcaggcccctgaagggcgagacccagtggctgggctgcccagggctgaggggccgcctcttgagggtacacgcctctggtcacatggccatggagccttgggtacccctgagttaagggaggacatttggccagctggtggctgggaggggagcctggctgccctgctgcttctcctgcctaataaacaggcttctcctgcaccaggtgtgatctgtccgcccaagggccagaaggccgggagcacggggatgggagcgcccgcaccctggctggaagatgaacttcccgtaagcacgtaattccctgcaggtccggcagctacacctggagtgtggggcctggtccctccccatgcccctcggtggggctctcctgggcccctcactcccactggcaatgtcacaagggcctccccaggcccctcctgcctcgggcaggccccagccctcctccttacccaacctcccatccagaaccttgctgccagggcctcccagctcgctcctgcggccaaaggccagctgtcaggtgctatgcggggtcaccagcagagtgcccgctggcaggtgggggcttccccgcttccggggtctgccccaggactcctgggtggacctcccccccccacctccgctgactcctgcaggcactggggagctctgctggaattgggggttttaaaacttcattagcagatttgtgctcttccatactgtttgtttgtttgttaggtgaaatacagtgtggtgagctgcactggtgacaacagcccttacctggctggggaggtgtctccagcagagctcactcccgcctacagccactcacaccccggggacaggaagctgtagagttggcgggccaggagggcagttgagagctggccagcggagggtgcagggaagcccagctgtgctcaactctcctgcctccgccttccaccctgggcccagggacagacagacattgccctcagaagggcagggaggaggctgtcctggagaggcctgtaggtccattcttcacccgtccctaccaggccaactcggcctgcaggaagggagacctgcagggcgctacccctgcgcccccacacacagtagggccagaacaccatcccctccaccggggtgtgccgaggacagtggggaggagaggagaggggcagcttcctcctggccccaggaagggctggcatcgggttcctggcacagcccctcctgtccaggactttatcatcggcagacctcagaagacaacacacaaaggtttcttttgtcttagcttcatttctcttaaaaaacaaggaacaagaaaacattgcaccagcgttctaagcctcaaacaaaacacaaaacaaatccccctgcgaagcaacaataaactttacatctctttggcaacaat

SEQ ID NO: 451 - DNA, 3352 bp, Homo sapiens
ctctgtggttcgggtccgctttcgtctccgtcctgctgccgttaccgccgctgctgccgccgcttgcgtcccccgctccggtctgtggtgcagccgggacccaggaccatgtctctgtctcgctcagaggagatgcaccggctcacggaaaatgtctataagaccatcatggagcagttcaaccctagcctccggaacttcatcgccatggggaagaattacgagaaggcactggcaggtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgcccaggagagcacacccatcatgaacggcgtcacaggcccggatggcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccaccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccagggcctggatgactatggagcgcggtccatgagcagcgccgatgtggaagtggccagattctgagccgcctgactagagttagaatccctttgcccacgtccagctgaagccgacagtgaccaacgacaggtctgcccccctcctcagctgatggccacatctgcagtgctgcccatctggtggcttcccccgcccttcccatgtagcctgttctgtcatcatctgtgcgttcctgtgtagagaacatccaggccccggctgcctggtcttgccccacttgagtctggcctggactggatcccagctgttctaggcagggccgggcagagtggggcgcaggcccctgaagggcgagacccagtggctgggctgcccagggctgaggggccgcctcttgagggtacacgcctctggtcacatggccatggagccttgggtacccctgagttaagggaggacatttggccagctggtggctgggaggggagcctggctgccctgctgcttctcctgcctaataaacaggcttctcctgcaccaggtgtgatctgtccgcccaagggccagaaggccgggagcacggggatgggagcgcccgcaccctggctggaagatgaacttcccgtaagcacgtaattccctgcaggtccggcagctacacctggagtgtggggcctggtccctccccatgcccctcggtggggctctcctgggcccctcactcccactggcaatgtcacaagggcctccccaggcccctcctgcctcgggcaggccccagccctcctccttacccaacctcccatccagaaccttgctgccagggcctcccagctcgctcctgcggccaaaggccagctgtcaggtgctatgcggggtcaccagcagagtgcccgctggcaggtgggggcttccccgcttccggggtctgccccaggactcctgggtggacctcccccccccacctccgctgactcctgcaggcactggggagctctgctggaattgggggttttaaaacttcattagcagatttgtgctcttccatactgtttgtttgtttgttaggtgaaatacagtgtggtgagctgcactggtgacaacagcccttacctggctggggaggtgtctccagcagagctcactcccgcctacagccactcacaccccggggacaggaagctgtagagttggcgggccaggagggcagttgagagctggccagcggagggtgcagggaagcccagctgtgctcaactctcctgcctccgccttccaccctgggcccagggacagacagacattgccctcagaagggcagggaggaggctgtcctggagaggcctgtaggtccattcttcacccgtccctaccaggccaactcggcctgcaggaagggagacctgcagggcgctacccctgcgcccccacacacagtagggccagaacaccatcccctccaccggggtgtgccgaggacagtggggaggagaggagaggggcagcttcctcctggccccaggaagggctggcatcgggttcctggcacagcccctcctgtccaggactttatcatcggcagacctcagaagacaacacacaaaggtttcttttgtcttagcttcatttctcttaaaaaacaaggaacaagaaaacattgcaccagcgttctaagcctcaaacaaaacacaaaacaaatccccctgcgaagcaacaataaactttacatctctttggcaacaat

SEQ ID NO: 452 - DNA, 6492 bp, Homo sapiens
tttctgtgaagcagaagtctgggaatcgatctggaaatcctcctaatttttactccctctccccgcgactcctgattcattgggaagtttcaaatcagctataactggagagtgctgaagattgatgggatcgttgccttatgcatttgttttggttttacaaaaaggaaacttgacagaggatcatgctgtacttaaaaaatacaacatcacagaggaagtagactgatattaacaatacttactaataataacgtgcctcatgaaataaagatccgaaaggaattggaataaaaatttcctgcatctcatgccaagggggaaacaccagaatcaagtgttccgcgtgattgaagacaccccctcgtccaagaatgcaaagcacatccaataaaatagctggattataactcctcttctttctctgggggccgtggggtgggagctggggcgagaggtgccgttggcccccgttgcttttcctctgggaaggatggcgcacgctgggagaacagggtacgataaccgggagatagtgatgaagtacatccattataagctgtcgcagaggggctacgagtgggatgcgggagatgtgggcgccgcgcccccgggggccgcccccgcaccgggcatcttctcctcccagcccgggcacacgccccatccagccgcatcccgggacccggtcgccaggacctcgccgctgcagaccccggctgcccccggcgccgccgcggggcctgcgctcagcccggtgccacctgtggtccacctgaccctccgccaggccggcgacgacttctcccgccgctaccgccgcgacttcgccgagatgtccagccagctgcacctgacgcccttcaccgcgcggggacgctttgccacggtggtggaggagctcttcagggacggggtgaactgggggaggattgtggccttctttgagttcggtggggtcatgtgtgtggagagcgtcaaccgggagatgtcgcccctggtggacaacatcgccctgtggatgactgagtacctgaaccggcacctgcacacctggatccaggataacggaggctgggatgcctttgtggaactgtacggccccagcatgcggcctctgtttgatttctcctggctgtctctgaagactctgctcagtttggccctggtgggagcttgcatcaccctgggtgcctatctgggccacaagtgaagtcaacatgcctgccccaaacaaatatgcaaaaggttcactaaagcagtagaaataatatgcattgtcagtgatgtaccatgaaacaaagctgcaggctgtttaagaaaaaataacacacatataaacatcacacacacagacagacacacacacacacaacaattaacagtcttcaggcaaaacgtcgaatcagctatttactgccaaagggaaatatcatttattttttacattattaagaaaaaaagatttatttatttaagacagtcccatcaaaactcctgtctttggaaatccgaccactaattgccaagcaccgcttcgtgtggctccacctggatgttctgtgcctgtaaacatagattcgctttccatgttgttggccggatcaccatctgaagagcagacggatggaaaaaggacctgatcattggggaagctggctttctggctgctggaggctggggagaaggtgttcattcacttgcatttctttgccctgggggctgtgatattaacagagggagggttcctgtggggggaagtccatgcctccctggcctgaagaagagactctttgcatatgactcacatgatgcatacctggtgggaggaaaagagttgggaacttcagatggacctagtacccactgagatttccacgccgaaggacagcgatgggaaaaatgcccttaaatcataggaaagtatttttttaagctaccaattgtgccgagaaaagcattttagcaatttatacaatatcatccagtaccttaagccctgattgtgtatattcatatattttggatacgcaccccccaactcccaatactggctctgtctgagtaagaaacagaatcctctggaacttgaggaagtgaacatttcggtgacttccgcatcaggaaggctagagttacccagagcatcaggccgccacaagtgcctgcttttaggagaccgaagtccgcagaacctgcctgtgtcccagcttggaggcctggtcctggaactgagccggggccctcactggcctcctccagggatgatcaacagggcagtgtggtctccgaatgtctggaagctgatggagctcagaattccactgtcaagaaagagcagtagaggggtgtggctgggcctgtcaccctggggccctccaggtaggcccgttttcacgtggagcatgggagccacgacccttcttaagacatgtatcactgtagagggaaggaacagaggccctgggcccttcctatcagaaggacatggtgaaggctgggaacgtgaggagaggcaatggccacggcccattttggctgtagcacatggcacgttggctgtgtggccttggcccacctgtgagtttaaagcaaggctttaaatgactttggagagggtcacaaatcctaaaagaagcattgaagtgaggtgtcatggattaattgacccctgtctatggaattacatgtaaaacattatcttgtcactgtagtttggttttatttgaaaacctgacaaaaaaaaagttccaggtgtggaatatgggggttatctgtacatcctggggcattaaaaaaaaaatcaatggtggggaactataaagaagtaacaaaagaagtgacatcttcagcaaataaactaggaaatttttttttcttccagtttagaatcagccttgaaacattgatggaataactctgtggcattattgcattatataccatttatctgtattaactttggaatgtactctgttcaatgtttaatgctgtggttgatatttcgaaagctgctttaaaaaaatacatgcatctcagcgtttttttgtttttaattgtatttagttatggcctatacactatttgtgagcaaaggtgatcgttttctgtttgagatttttatctcttgattcttcaaaagcattctgagaaggtgagataagccctgagtctcagctacctaagaaaaacctggatgtcactggccactgaggagctttgtttcaaccaagtcatgtgcatttccacgtcaacagaattgtttattgtgacagttatatctgttgtccctttgaccttgtttcttgaaggtttcctcgtccctgggcaattccgcatttaattcatggtattcaggattacatgcatgtttggttaaacccatgagattcattcagttaaaaatccagatggcaaatgaccagcagattcaaatctatggtggtttgacctttagagagttgctttacgtggcctgtttcaacacagacccacccagagccctcctgccctccttccgcgggggctttctcatggctgtccttcagggtcttcctgaaatgcagtggtgcttacgctccaccaagaaagcaggaaacctgtggtatgaagccagacctccccggcgggcctcagggaacagaatgatcagacctttgaatgattctaatttttaagcaaaatattattttatgaaaggtttacattgtcaaagtgatgaatatggaatatccaatcctgtgctgctatcctgccaaaatcattttaatggagtcagtttgcagtatgctccacgtggtaagatcctccaagctgctttagaagtaacaatgaagaacgtggacgtttttaatataaagcctgttttgtcttttgttgttgttcaaacgggattcacagagtatttgaaaaatgtatatatattaagaggtcacgggggctaattgctggctggctgccttttgctgtggggttttgttacctggttttaataacagtaaatgtgcccagcctcttggccccagaactgtacagtattgtggctgcacttgctctaagagtagttgatgttgcattttccttattgttaaaaacatgttagaagcaatgaatgtatataaaagcctcaactagtcatttttttctcctcttcttttttttcattatatctaattattttgcagttgggcaacagagaaccatccctattttgtattgaagagggattcacatctgcatcttaactgctctttatgaatgaaaaaacagtcctctgtatgtactcctctttacactggccagggtcagagttaaatagagtatatgcactttccaaattggggacaagggctctaaaaaaagccccaaaaggagaagaacatctgagaacctcctcggccctcccagtccctcgctgcacaaatactccgcaagagaggccagaatgacagctgacagggtctatggccatcgggtcgtctccgaagatttggcaggggcagaaaactctggcaggcttaagatttggaataaagtcacagaattaaggaagcacctcaatttagttcaaacaagacgccaacattctctccacagctcacttacctctctgtgttcagatgtggccttccatttatatgtgatctttgttttattagtaaatgcttatcatctaaagatgtagctctggcccagtgggaaaaattaggaagtgattataaatcgagaggagttataataatcaagattaaatgtaaataatcagggcaatcccaacacatgtctagctttcacctccaggatctattgagtgaacagaattgcaaatagtctctatttgtaattgaacttatcctaaaacaaatagtttataaatgtgaacttaaactctaattaattccaactgtacttttaaggcagtggctgtttttagactttcttatcacttatagttagtaatgtacacctactctatcagagaaaaacaggaaaggctcgaaatacaagccattctaaggaaattagggagtcagttgaaattctattctgatcttattctgtggtgtcttttgcagcccagacaaatgtggttacacactttttaagaaatacaattctacattgtcaagcttatgaaggttccaatcagatctttattgttattcaatttggatctttcagggattttttttttaaattattatgggacaaaggacatttgttggaggggtgggagggaggaagaatttttaaatgtaaaacattcccaagtttggatcagggagttggaagttttcagaataaccagaactaagggtatgaaggacctgtattggggtcgatgtgatgcctctgcgaagaaccttgtgtgacaaatgagaaacattttgaagtttgtggtacgacctttagattccagagacatcagcatggctcaaagtgcagctccgtttggcagtgcaatggtataaatttcaagctggatatgtctaatgggtatttaaacaataaatgtgcagttttaactaacaggatatttaatgacaaccttctggttggtagggacatctgtttctaaatgtttattatgtacaatacagaaaaaaattttataaaattaagcaatgtgaaactgaattggagagtgataatacaagtcctttagtcttacccagtgaatcattctgttccatgtctttggacaaccatgaccttggacaatcatgaaatatgcatctcactggatgcaaagaaaatcagatggagcatgaatggtactgtaccggttcatctggactgccccagaaaaataacttcaagcaaacatcctatcaacaacaaggttgttctgcataccaagctgagcacagaagatgggaacactggtggaggatggaaaggctcgctcaatcaagaaaattctgagactattaataaataagactgtagtgtagatactgagtaaatccatgcacctaaaccttttggaaaatctgccgtgggccctccagatagctcatttcattaagtttttccctccaaggtagaatttgcaagagtgacagtggattgcatttcttttggggaagctttcttttggtggttttgtttattataccttcttaagttttcaaccaaggtttgcttttgttttgagttactggggttatttttgttttaaataaaaataagtgtacaataagtgtttttgtattgaaagcttttgttatcaagattttcatacttttaccttccatggctctttttaagattgatacttttaagaggtggctgatattctgcaacactgtacacataaaaaatacggtaaggatactttacatggttaaggtaaagtaagtctccagttggccaccattagctataatggcactttgtttgtgttgttggaaaaagtcacattgccattaaactttccttgtctgtctagttaatattgtgaagaaaaataaagtacagtgtgagatactg

SEQ ID NO: 453 - DNA, 7461 bp, Homo sapiens
gcgcccgcccctccgcgccgcctgcccgcccgcccgccgcgctcccgcccgccgctctccgtggccccgccgcgctgccgccgccgccgctgccagcgaaggtgccggggctccgggccctccctgccggcggccgtcagcgctcggagcgggctgcgcggcgggagctccgggaggcggccgtagccagcgccgccgcgcaggaccaggaggaggagaaagggtgcgcagcccggaggcggggtgcgccggtggggtgcagcggaagagggggtccaggggggagaacttcgtagcagtcatcctttttaggaaaagagggaaaaaataaaaccctcccccaccacctccttctccccacccctcgccgcaccacacacagcgcgggcttctagcgctcggcaccggcgggccaggcgcgtcctgccttcatttatccagcagcttttcggaaaatgcatttgctgttcggagtttaatcagaagaggattcctgcctccgtccccggctccttcatcgtcccctctcccctgtctctctcctggggaggcgtgaagcggtcccgtggatagagattcatgcctgtgcccgcgcgtgtgtgcgcgcgtgtaaattgccgagaaggggaaaacatcacaggacttctgcgaataccggactgaaaattgtaattcatctgccgccgccgctgccttttttttttctcgagctcttgagatctccggttgggattcctgcggattgacatttctgtgaagcagaagtctgggaatcgatctggaaatcctcctaatttttactccctctccccgcgactcctgattcattgggaagtttcaaatcagctataactggagagtgctgaagattgatgggatcgttgccttatgcatttgttttggttttacaaaaaggaaacttgacagaggatcatgctgtacttaaaaaatacaagtaagttctctgcacaggaaattggtttaatgtaactttcaatggaaacctttgagattttttacttaaagtgcattcgagtaaatttaatttccaggcagcttaatacattctttttagccgtgttacttgtagtgtgtatgccctgctttcactcagtgtgtacagggaaacgcacctgattttttacttattagtttgttttttctttaacctttcagcatcacagaggaagtagactgatattaacaatacttactaataataacgtgcctcatgaaataaagatccgaaaggaattggaataaaaatttcctgcatctcatgccaagggggaaacaccagaatcaagtgttccgcgtgattgaagacaccccctcgtccaagaatgcaaagcacatccaataaaatagctggattataactcctcttctttctctgggggccgtggggtgggagctggggcgagaggtgccgttggcccccgttgcttttcctctgggaaggatggcgcacgctgggagaacagggtacgataaccgggagatagtgatgaagtacatccattataagctgtcgcagaggggctacgagtgggatgcgggagatgtgggcgccgcgcccccgggggccgcccccgcaccgggcatcttctcctcccagcccgggcacacgccccatccagccgcatcccgggacccggtcgccaggacctcgccgctgcagaccccggctgcccccggcgccgccgcggggcctgcgctcagcccggtgccacctgtggtccacctgaccctccgccaggccggcgacgacttctcccgccgctaccgccgcgacttcgccgagatgtccagccagctgcacctgacgcccttcaccgcgcggggacgctttgccacggtggtggaggagctcttcagggacggggtgaactgggggaggattgtggccttctttgagttcggtggggtcatgtgtgtggagagcgtcaaccgggagatgtcgcccctggtggacaacatcgccctgtggatgactgagtacctgaaccggcacctgcacacctggatccaggataacggaggctgggatgcctttgtggaactgtacggccccagcatgcggcctctgtttgatttctcctggctgtctctgaagactctgctcagtttggccctggtgggagcttgcatcaccctgggtgcctatctgggccacaagtgaagtcaacatgcctgccccaaacaaatatgcaaaaggttcactaaagcagtagaaataatatgcattgtcagtgatgtaccatgaaacaaagctgcaggctgtttaagaaaaaataacacacatataaacatcacacacacagacagacacacacacacacaacaattaacagtcttcaggcaaaacgtcgaatcagctatttactgccaaagggaaatatcatttattttttacattattaagaaaaaaagatttatttatttaagacagtcccatcaaaactcctgtctttggaaatccgaccactaattgccaagcaccgcttcgtgtggctccacctggatgttctgtgcctgtaaacatagattcgctttccatgttgttggccggatcaccatctgaagagcagacggatggaaaaaggacctgatcattggggaagctggctttctggctgctggaggctggggagaaggtgttcattcacttgcatttctttgccctgggggctgtgatattaacagagggagggttcctgtggggggaagtccatgcctccctggcctgaagaagagactctttgcatatgactcacatgatgcatacctggtgggaggaaaagagttgggaacttcagatggacctagtacccactgagatttccacgccgaaggacagcgatgggaaaaatgcccttaaatcataggaaagtatttttttaagctaccaattgtgccgagaaaagcattttagcaatttatacaatatcatccagtaccttaagccctgattgtgtatattcatatattttggatacgcaccccccaactcccaatactggctctgtctgagtaagaaacagaatcctctggaacttgaggaagtgaacatttcggtgacttccgcatcaggaaggctagagttacccagagcatcaggccgccacaagtgcctgcttttaggagaccgaagtccgcagaacctgcctgtgtcccagcttggaggcctggtcctggaactgagccggggccctcactggcctcctccagggatgatcaacagggcagtgtggtctccgaatgtctggaagctgatggagctcagaattccactgtcaagaaagagcagtagaggggtgtggctgggcctgtcaccctggggccctccaggtaggcccgttttcacgtggagcatgggagccacgacccttcttaagacatgtatcactgtagagggaaggaacagaggccctgggcccttcctatcagaaggacatggtgaaggctgggaacgtgaggagaggcaatggccacggcccattttggctgtagcacatggcacgttggctgtgtggccttggcccacctgtgagtttaaagcaaggctttaaatgactttggagagggtcacaaatcctaaaagaagcattgaagtgaggtgtcatggattaattgacccctgtctatggaattacatgtaaaacattatcttgtcactgtagtttggttttatttgaaaacctgacaaaaaaaaagttccaggtgtggaatatgggggttatctgtacatcctggggcattaaaaaaaaaatcaatggtggggaactataaagaagtaacaaaagaagtgacatcttcagcaaataaactaggaaatttttttttcttccagtttagaatcagccttgaaacattgatggaataactctgtggcattattgcattatataccatttatctgtattaactttggaatgtactctgttcaatgtttaatgctgtggttgatatttcgaaagctgctttaaaaaaatacatgcatctcagcgtttttttgtttttaattgtatttagttatggcctatacactatttgtgagcaaaggtgatcgttttctgtttgagatttttatctcttgattcttcaaaagcattctgagaaggtgagataagccctgagtctcagctacctaagaaaaacctggatgtcactggccactgaggagctttgtttcaaccaagtcatgtgcatttccacgtcaacagaattgtttattgtgacagttatatctgttgtccctttgaccttgtttcttgaaggtttcctcgtccctgggcaattccgcatttaattcatggtattcaggattacatgcatgtttggttaaacccatgagattcattcagttaaaaatccagatggcaaatgaccagcagattcaaatctatggtggtttgacctttagagagttgctttacgtggcctgtttcaacacagacccacccagagccctcctgccctccttccgcgggggctttctcatggctgtccttcagggtcttcctgaaatgcagtggtgcttacgctccaccaagaaagcaggaaacctgtggtatgaagccagacctccccggcgggcctcagggaacagaatgatcagacctttgaatgattctaatttttaagcaaaatattattttatgaaaggtttacattgtcaaagtgatgaatatggaatatccaatcctgtgctgctatcctgccaaaatcattttaatggagtcagtttgcagtatgctccacgtggtaagatcctccaagctgctttagaagtaacaatgaagaacgtggacgtttttaatataaagcctgttttgtcttttgttgttgttcaaacgggattcacagagtatttgaaaaatgtatatatattaagaggtcacgggggctaattgctggctggctgccttttgctgtggggttttgttacctggttttaataacagtaaatgtgcccagcctcttggccccagaactgtacagtattgtggctgcacttgctctaagagtagttgatgttgcattttccttattgttaaaaacatgttagaagcaatgaatgtatataaaagcctcaactagtcatttttttctcctcttcttttttttcattatatctaattattttgcagttgggcaacagagaaccatccctattttgtattgaagagggattcacatctgcatcttaactgctctttatgaatgaaaaaacagtcctctgtatgtactcctctttacactggccagggtcagagttaaatagagtatatgcactttccaaattggggacaagggctctaaaaaaagccccaaaaggagaagaacatctgagaacctcctcggccctcccagtccctcgctgcacaaatactccgcaagagaggccagaatgacagctgacagggtctatggccatcgggtcgtctccgaagatttggcaggggcagaaaactctggcaggcttaagatttggaataaagtcacagaattaaggaagcacctcaatttagttcaaacaagacgccaacattctctccacagctcacttacctctctgtgttcagatgtggccttccatttatatgtgatctttgttttattagtaaatgcttatcatctaaagatgtagctctggcccagtgggaaaaattaggaagtgattataaatcgagaggagttataataatcaagattaaatgtaaataatcagggcaatcccaacacatgtctagctttcacctccaggatctattgagtgaacagaattgcaaatagtctctatttgtaattgaacttatcctaaaacaaatagtttataaatgtgaacttaaactctaattaattccaactgtacttttaaggcagtggctgtttttagactttcttatcacttatagttagtaatgtacacctactctatcagagaaaaacaggaaaggctcgaaatacaagccattctaaggaaattagggagtcagttgaaattctattctgatcttattctgtggtgtcttttgcagcccagacaaatgtggttacacactttttaagaaatacaattctacattgtcaagcttatgaaggttccaatcagatctttattgttattcaatttggatctttcagggattttttttttaaattattatgggacaaaggacatttgttggaggggtgggagggaggaagaatttttaaatgtaaaacattcccaagtttggatcagggagttggaagttttcagaataaccagaactaagggtatgaaggacctgtattggggtcgatgtgatgcctctgcgaagaaccttgtgtgacaaatgagaaacattttgaagtttgtggtacgacctttagattccagagacatcagcatggctcaaagtgcagctccgtttggcagtgcaatggtataaatttcaagctggatatgtctaatgggtatttaaacaataaatgtgcagttttaactaacaggatatttaatgacaaccttctggttggtagggacatctgtttctaaatgtttattatgtacaatacagaaaaaaattttataaaattaagcaatgtgaaactgaattggagagtgataatacaagtcctttagtcttacccagtgaatcattctgttccatgtctttggacaaccatgaccttggacaatcatgaaatatgcatctcactggatgcaaagaaaatcagatggagcatgaatggtactgtaccggttcatctggactgccccagaaaaataacttcaagcaaacatcctatcaacaacaaggttgttctgcataccaagctgagcacagaagatgggaacactggtggaggatggaaaggctcgctcaatcaagaaaattctgagactattaataaataagactgtagtgtagatactgagtaaatccatgcacctaaaccttttggaaaatctgccgtgggccctccagatagctcatttcattaagtttttccctccaaggtagaatttgcaagagtgacagtggattgcatttcttttggggaagctttcttttggtggttttgtttattataccttcttaagttttcaaccaaggtttgcttttgttttgagttactggggttatttttgttttaaataaaaataagtgtacaataagtgtttttgtattgaaagcttttgttatcaagattttcatacttttaccttccatggctctttttaagattgatacttttaagaggtggctgatattctgcaacactgtacacataaaaaatacggtaaggatactttacatggttaaggtaaagtaagtctccagttggccaccattagctataatggcactttgtttgtgttgttggaaaaagtcacattgccattaaactttccttgtctgtctagttaatattgtgaagaaaaataaagtacagtgtgagatactg

SEQ ID NO: 454 - DNA, 1206 bp, Homo sapiens
tttctgtgaagcagaagtctgggaatcgatctggaaatcctcctaatttttactccctctccccgcgactcctgattcattgggaagtttcaaatcagctataactggagagtgctgaagattgatgggatcgttgccttatgcatttgttttggttttacaaaaaggaaacttgacagaggatcatgctgtacttaaaaaatacaacatcacagaggaagtagactgatattaacaatacttactaataataacgtgcctcatgaaataaagatccgaaaggaattggaataaaaatttcctgcatctcatgccaagggggaaacaccagaatcaagtgttccgcgtgattgaagacaccccctcgtccaagaatgcaaagcacatccaataaaatagctggattataactcctcttctttctctgggggccgtggggtgggagctggggcgagaggtgccgttggcccccgttgcttttcctctgggaaggatggcgcacgctgggagaacagggtacgataaccgggagatagtgatgaagtacatccattataagctgtcgcagaggggctacgagtgggatgcgggagatgtgggcgccgcgcccccgggggccgcccccgcaccgggcatcttctcctcccagcccgggcacacgccccatccagccgcatcccgggacccggtcgccaggacctcgccgctgcagaccccggctgcccccggcgccgccgcggggcctgcgctcagcccggtgccacctgtggtccacctgaccctccgccaggccggcgacgacttctcccgccgctaccgccgcgacttcgccgagatgtccagccagctgcacctgacgcccttcaccgcgcggggacgctttgccacggtggtggaggagctcttcagggacggggtgaactgggggaggattgtggccttctttgagttcggtggggtcatgtgtgtggagagcgtcaaccgggagatgtcgcccctggtggacaacatcgccctgtggatgactgagtacctgaaccggcacctgcacacctggatccaggataacggaggctgggtaggtgcacttggtgatgtgagtctgggctgaggccacaggtccgagatgcgggggttggagtgcgggtgggctcctggggcaatgggaggctgtggagccggcgaaataaaatcagagttgttgct

SEQ ID NO: 455 - DNA, 2710 bp, Homo sapiens
gccacttgtcatggtgaaatggcaaatctgggcttcctgtggttccagaagcctgcgactggaaatccacaagcgagctggtggttgaagctggttaaagaacagcctaggtattccagaagtgtttgaggatcccttccatgaaggaagagaggaaagtttttaagtaaacctcccactcccatgtgtcttcagctttcttttgcaaaggagaaaatccttgaagtttggtaaagaccgagttagtctatctctctttgcctatctcgagttgggctggggagaggaggagataggttcttttgtctttttctgtcttctcccttccccacttccttccctccagtccccactcactcacatgcacacactaaccttggagccgatgggattgagtgactggcacttgggaccacagagaaatgtcagagtgtttggttacagactcaaggaaacctctcattttagagtgctcatttggttttgagcaaaattttggactgtgaagcaaggcattggtgaagacaaaatggcctcgccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatctttacagaccagttgaaatgcaaccttagtgtgatcaatctagatcctgagatcaaccctgagggattctgcatcctcctggacttcatgtacacatctcggctcaatttgcgggagggcaacatcatggctgtgatggccacggctatgtacctgcagatggagcatgttgtggacacttgccggaagtttattaaggccagtgaagcagagatggtttctgccatcaagcctcctcgtgaagagttcctcaacagccggatgctgatgccccaagacatcatggcctatcggggtcgtgaggtggtggagaacaacctgccactgaggagcgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggcactcccatgtgatagtgccaggccagtccctggtgagtacagccggccgactttggaggtgtcccccaatgtgtgccacagcaatatctattcacccaaggaaacaatcccagaagaggcacgaagtgatatgcactacagtgtggctgagggcctcaaacctgctgccccctcagcccgaaatgccccctacttcccttgtgacaaggccagcaaagaagaagagagaccctcctcggaagatgagattgccctgcatttcgagccccccaatgcacccctgaaccggaagggtctggttagtccacagagcccccagaaatctgactgccagcccaactcgcccacagagtcctgcagcagtaagaatgcctgcatcctccaggcttctggctcccctccagccaagagccccactgaccccaaagcctgcaactggaagaaatacaagttcatcgtgctcaacagcctcaaccagaatgccaaaccagaggggcctgagcaggctgagctgggccgcctttccccacgagcctacacggccccacctgcctgccagccacccatggagcctgagaaccttgacctccagtccccaaccaagctgagtgccagcggggaggactccaccatcccacaagccagccggctcaataacatcgttaacaggtccatgacgggctctccccgcagcagcagcgagagccactcaccactctacatgcaccccccgaagtgcacgtcctgcggctctcagtccccacagcatgcagagatgtgcctccacaccgctggccccacgttccctgaggagatgggagagacccagtctgagtactcagattctagctgtgagaacggggccttcttctgcaatgagtgtgactgccgcttctctgaggaggcctcactcaagaggcacacgctgcagacccacagtgacaaaccctacaagtgtgaccgctgccaggcctccttccgctacaagggcaacctcgccagccacaagaccgtccataccggtgagaaaccctatcgttgcaacatctgtggggcccagttcaaccggccagccaacctgaaaacccacactcgaattcactctggagagaagccctacaaatgcgaaacctgcggagccagatttgtacaggtggcccacctccgtgcccatgtgcttatccacactggtgagaagccctatccctgtgaaatctgtggcacccgtttccggcaccttcagactctgaagagccacctgcgaatccacacaggagagaaaccttaccattgtgagaagtgtaacctgcatttccgtcacaaaagccagctgcgacttcacttgcgccagaagcatggcgccatcaccaacaccaaggtgcaataccgcgtgtcagccactgacctgcctccggagctccccaaagcctgctgaagcatggagtgttgatgctttcgtctccagccccttctcagaatctacccaaaggatact

SEQ ID NO: 456 - DNA, 3569 bp, Homo sapiens
ataccatcgtcttgggcccggggagggagagccaccttcaggcccctcgagcctcgaaccggaacctccaaatccgagacgctctgcttatgaggacctcgaaatatgccggccagtgaaaaaatcttgtggctttgagggcttttggttggccaggggcagtaaaaatctcggagagctgacaccaagtcctcccctgccacgtagcagtggtaaagtccgaagctcaaattccgagaattgagctctgttgattcttagaactggggttcttagaagtggtgatgcaagaagtttctaggaaaggccggacaccaggttttgagcaaaattttggactgtgaagcaaggcattggtgaagacaaaatggcctcgccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatctttacagaccagttgaaatgcaaccttagtgtgatcaatctagatcctgagatcaaccctgagggattctgcatcctcctggacttcatgtacacatctcggctcaatttgcgggagggcaacatcatggctgtgatggccacggctatgtacctgcagatggagcatgttgtggacacttgccggaagtttattaaggccagtgaagcagagatggtttctgccatcaagcctcctcgtgaagagttcctcaacagccggatgctgatgccccaagacatcatggcctatcggggtcgtgaggtggtggagaacaacctgccactgaggagcgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggcactcccatgtgatagtgccaggccagtccctggtgagtacagccggccgactttggaggtgtcccccaatgtgtgccacagcaatatctattcacccaaggaaacaatcccagaagaggcacgaagtgatatgcactacagtgtggctgagggcctcaaacctgctgccccctcagcccgaaatgccccctacttcccttgtgacaaggccagcaaagaagaagagagaccctcctcggaagatgagattgccctgcatttcgagccccccaatgcacccctgaaccggaagggtctggttagtccacagagcccccagaaatctgactgccagcccaactcgcccacagagtcctgcagcagtaagaatgcctgcatcctccaggcttctggctcccctccagccaagagccccactgaccccaaagcctgcaactggaagaaatacaagttcatcgtgctcaacagcctcaaccagaatgccaaaccagaggggcctgagcaggctgagctgggccgcctttccccacgagcctacacggccccacctgcctgccagccacccatggagcctgagaaccttgacctccagtccccaaccaagctgagtgccagcggggaggactccaccatcccacaagccagccggctcaataacatcgttaacaggtccatgacgggctctccccgcagcagcagcgagagccactcaccactctacatgcaccccccgaagtgcacgtcctgcggctctcagtccccacagcatgcagagatgtgcctccacaccgctggccccacgttccctgaggagatgggagagacccagtctgagtactcagattctagctgtgagaacggggccttcttctgcaatgagtgtgactgccgcttctctgaggaggcctcactcaagaggcacacgctgcagacccacagtgacaaaccctacaagtgtgaccgctgccaggcctccttccgctacaagggcaacctcgccagccacaagaccgtccataccggtgagaaaccctatcgttgcaacatctgtggggcccagttcaaccggccagccaacctgaaaacccacactcgaattcactctggagagaagccctacaaatgcgaaacctgcggagccagatttgtacaggtggcccacctccgtgcccatgtgcttatccacactggtgagaagccctatccctgtgaaatctgtggcacccgtttccggcaccttcagactctgaagagccacctgcgaatccacacaggagagaaaccttaccattgtgagaagtgtaacctgcatttccgtcacaaaagccagctgcgacttcacttgcgccagaagcatggcgccatcaccaacaccaaggtgcaataccgcgtgtcagccactgacctgcctccggagctccccaaagcctgctgaagcatggagtgttgatgctttcgtctccagccccttctcagaatctacccaaaggatactgtaacactttacaatgttcatcccatgatgtagtgcctctttcatccactagtgcaaatcatagctgggggttgggggtggtgggggtcggggcctgggggactgggagccgcagcagctccccctcccccactgccataaaacattaagaaaatcatattgcttcttctcctatgtgtaaggtgaaccatgtcagcaaaaagcaaaatcattttatatgtcaaagcaggggagtatgcaaaagttctgacttgactttagtctgcaaaatgaggaatgtatatgttttgtgggaacagatgtttcttttgtatgtaaatgtgcattcttttaaaagacaagacttcagtatgttgtcaaagagagggctttaatttttttaaccaaaggtgaaggaatatatggcagagttgtaaatatataaatatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaacaaaaagaacaaaaaaatctgcagaaggaaaaatgtgtaattttgttctagttttcagtttgtatatacccgtacaacgtgtcctcacggtgccttttttcacggaagttttcaatgatgggcgagcgtgcaccatccctttttgaagtgtaggcagacacagggacttgaagttgttactaactaaactctctttgggaatgtttgtctcatcccattctgcgtcatgcttgtgttataactactccggagacagggtttggctgtgtctaaactgcattaccgcgttgtaaaatatagctgtacaaatataagaataaaatgttgaaaagtcaaactgg

SEQ ID NO: 457 - DNA, 454 bp, Homo sapiens
gttaaatcaatttctgtttgctttcttctcttctctgtaggttttgagcaaaattttggactgtgaagcaaggcattggtgaagacaaaatggcctcgccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatctttacagaccagttgaaatgcaaccttagtgtgatcaatctagatcctgagatcaaccctgagggattctgcatcctcctggacttcatgtacacatctcggctcaatttgcgggagggcaacatcatggctgtgatggccacggctatgtacctgcagatggagcatgttgtggacacttgccg

SEQ ID NO: 458 - DNA, 709 bp, Homo sapiens
tcctggcggctgccggggccggcagcttcctggaaagttacttcttgttggagccggcaataggcaaagtgtgttctgtgaaatccgcagagccgagattgactacgttccgggaatgagagggctgtgtcattcccctcattgcctgctgcattgacggcgtaacaggaaaaaaaaaaaaaaaaaaaaaaaggcatacacacaatgttagctaccgaggtgcaccaaaagttttatttgaatgtaactaaattaagggccgccacggtcataccacaaagcctccgtcgcgccttgcggggggcttcgaggtggatcgcccaggggcgggcagtccctggaagacaggttttgagcaaaattttggactgtgaagcaaggcattggtgaagacaaaatggcctcgccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatctttacagaccagttgaaatgcaaccttagtgtgatcaatctagatcctgagatcaaccctgagggattctgcatcctcctggacttcatgtacacatctcggctcaatttgcgggagggcaacatcatggct

SEQ ID NO: 459 - DNA, 2003 bp, Homo sapiens
aagcaaggcattggtgaagacaaaatggcctcgccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatctttacagaccagttgaaatgcaaccttagtgtgatcaatctagatcctgagatcaaccctgagggattctgcatcctcctggacttcatgtacacatctcggctcaatttgcgggagggcaacatcatggctgtgatggccacggctatgtacctgcagatggagcatgttgtggacacttgccggaagtttattaaggccagtgaagcagagatggtttctgccatcaagcctcctcgtgaagagttcctcaacagccggatgctgatgccccaagacatcatggcctatcggggtcgtgaggtggtggagaacaacctgccactgaggagcgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggcactcccatgtgatagtgccaggccagtccctggtgagtacagccggccgactttggaggtgtcccccaatgtgtgccacagcaatatctattcacccaaggaaacaatcccagaagaggcacgaagtgatatgcactacagtgtggctgagggcctcaaacctgctgccccctcagcccgaaatgccccctacttcccttgtgacaaggccagcaaagaagaagagagaccctcctcggaagatgagattgccctgcatttcgagccccccaatgcacccctgaaccggaagggtctggttagtccacagagcccccagaaatctgactgccagcccaactcgcccacagagtcctgcagcagtaagaatgcctgcatcctccaggcttctggctcccctccagccaagagccccactgaccccaaagcctgcaactggaagaaatacaagttcatcgtgctcaacagcctcaaccagaatgccaaaccagaggggcctgagcaggctgagctgggccgcctttccccacgagcctacacggccccacctgcctgccagccacccatggagcctgagaaccttgacctccagtccccaaccaagctgagtgccagcggggaggactccaccatcccacaagccagccggctcaataacatcgttaacaggtccatgacgggctctccccgcagcagcagcgagagccactcaccactctacatgcaccccccgaagtgcacgtcctgcggctctcagtccccacagcatgcagagatgtgcctccacaccgctggccccacgttccctgaggagatgggagagacccagtctgagtactcagattctagctgtggtgagaaaccctatcgttgcaacatctgtggggcccagttcaaccggccagccaacctgaaaacccacactcgaattcactctggagagaagccctacaaatgcgaaacctgcggagccagatttgtacaggtggcccacctccgtgcccatgtgcttatccacactggtgagaagccctatccctgtgaaatctgtggcacccgtttccggcaccttcagactctgaagagccacctgcgaatccacacaggagagaaaccttaccattgtgagaagtgtaacctgcatttccgtcacaaaagccagctgcgacttcacttgcgccagaagcatggcgccatcaccaacaccaaggtgcaataccgcgtgtcagccactgacctgcctccggagctccccaaagcctgctgaagcatggagtgttgatgctttcgtct

SEQ ID NO: 460 - DNA, 1347 bp, Homo sapiens
gaggcgattgcgattgggtgagacccagtaaggatggaaagtgtagaggagacaggaatccacggctttggaaaaaggaaggacaaaactcaccaaaccagagcagggcaggaagtaacaatgagaaactgaaaaagaaacggaatggaaagctatgagacaggatgaaatttggcatggggtctgcccaggcatgtccatgccaggtgcccagggctgcttccacgacgtgggtcccctgccagatttgtgagacaagaggagcagcagcggcaccgcccctcaccctggagggtcctgtacaatctcatcatgggactcctgcccttacccaggggccacagagcccccgagatggagcccaattaggtgcctgcacccgcccggtggacgtcagggactcggggggcaggcccctcccacctcctgacaccctggccagcgcgggggactttctctgcaccatgtagcatactggactcccagccctgcctgtcccgggggcgggccggggcagccactccagccccagcccagcctggggtgcactgacggagatgcggactcctgggtccctggccaagaagccaggagagggacggctgatggactcagcatcggaaggtggcggtgaccgagggggtggggactgagccgcccgcctctgccgcccaccaccatctcaggaaaggctgttgtgctggtgcccgttccagctgcaggggtgacactgggaggggggggctctcctctcggtgctccttcactctgggcctggcctcaggcccctggtgcttccccccctcctcctgggagggggcccgtgaagagcaaatgagccaaacgtgaccactagcctcctggagccagagagtggggctcgtttgccggttgctccagcccggcgcccagccatcttccctgagccagccggcgggtggtgggcatgcctgcctcaccttcatcagggggtggccaggaggggcccagactgtgaatcctgtgctctgcccgtgaccgccccccgccccatcaatcccattgcataggtttagagagagcacgtgtgaccactggcattcatttggggggtgggagattttggctgaagccgccccagccttagtccccagggccaagcgctggggggaagacggggagtcagggagggggggaaatctcggaagagggaggagtctgggagtggggagggatggcccagcctgtaagatactgtatatgcgctgctgtagataccggaatgaattttctgtacatgtttggttaattttttttgtacatgatttttgtatgtttccttttcaataaaatcagattggaacagtg

SEQ ID NO: 461 - DNA, 1538 bp, Homo sapiens
gaggcgattgcgattgggtgagacccagtaaggatggaaagtgtagaggagacaggaatccacggctttggaaaaaggaaggacaaaactcaccaaaccagagcagggcaggaagtaacaatgagaaactgaaaaagaaacggaatggaaagctatgagacaggatgaaatttggcatggggtctgcccaggcatgtccatgccaggtgcccagggctgcttccacgacgtgggtcccctgccagatttgtggtcctcagccctcgctctcgctggcggagcagcacctggagtcgcccgtgcccagcgccccgggggctctggcgggcggtcccacccaggcggccccgggagtccgcggggaggaggaacagtgggcccgggagatcggggcccagctgcggcggatggcggacgacctcaacgcacagtacgagcggcggagacaagaggagcagcagcggcaccgcccctcaccctggagggtcctgtacaatctcatcatgggactcctgcccttacccaggggccacagagcccccgagatggagcccaattaggtgcctgcacccgcccggtggacgtcagggactcggggggcaggcccctcccacctcctgacaccctggccagcgcgggggactttctctgcaccatgtagcatactggactcccagccctgcctgtcccgggggcgggccggggcagccactccagccccagcccagcctggggtgcactgacggagatgcggactcctgggtccctggccaagaagccaggagagggacggctgatggactcagcatcggaaggtggcggtgaccgagggggtggggactgagccgcccgcctctgccgcccaccaccatctcaggaaaggctgttgtgctggtgcccgttccagctgcaggggtgacactgggaggggggggctctcctctcggtgctccttcactctgggcctggcctcaggcccctggtgcttccccccctcctcctgggagggggcccgtgaagagcaaatgagccaaacgtgaccactagcctcctggagccagagagtggggctcgtttgccggttgctccagcccggcgcccagccatcttccctgagccagccggcgggtggtgggcatgcctgcctcaccttcatcagggggtggccaggaggggcccagactgtgaatcctgtgctctgcccgtgaccgccccccgccccatcaatcccattgcataggtttagagagagcacgtgtgaccactggcattcatttggggggtgggagattttggctgaagccgccccagccttagtccccagggccaagcgctggggggaagacggggagtcagggagggggggaaatctcggaagagggaggagtctgggagtggggagggatggcccagcctgtaagatactgtatatgcgctgctgtagataccggaatgaattttctgtacatgtttggttaattttttttgtacatgatttttgtatgtttccttttcaataaaatcagattggaacagtg

SEQ ID NO: 462 - DNA, 1843 bp, Homo sapiens
gcggcgcgagccacatgcgagcgggcgcctggcggcggcggcggcggcaccagcgatcccagcagcggccacgacgcggacgcgcctgcggcccggggagcagcagcagccacagccacagcagccgccactgcagttagagcggcagcagcagcgacagccacagcagcagccgccgcggagagcggcgctcggcgggcgcgccctcctgaaggaagccgcccgccccccaccgccgccccctccggcgtgttcatgcccccggggccccagggagcgccatggcccgcgcacgccaggagggcagctccccggagcccgtagagggcctggcccgcgacggcccgcgccccttcccgctcggccgcctggtgccctcggcagtgtcctgcggcctctgcgagcccggcctggctgccgcccccgccgcccccaccctgctgcccgctgcctacctctgcgcccccaccgccccacccgccgtcaccgccgccctggggggttcccgctggcctgggggtccccgcagccggccccgaggcccgcgcccggacggtcctcagccctcgctctcgctggcggagcagcacctggagtcgcccgtgcccagcgccccgggggctctggcgggcggtcccacccaggcggccccgggagtccgcggggaggaggaacagtgggcccgggagatcggggcccagctgcggcggatggcggacgacctcaacgcacagtacgagcggcggagacaagaggagcagcagcggcaccgcccctcaccctggagggtcctgtacaatctcatcatgggactcctgcccttacccaggggccacagagcccccgagatggagcccaattaggtgcctgcacccgcccggtggacgtcagggactcggggggcaggcccctcccacctcctgacaccctggccagcgcgggggactttctctgcaccatgtagcatactggactcccagccctgcctgtcccgggggcgggccggggcagccactccagccccagcccagcctggggtgcactgacggagatgcggactcctgggtccctggccaagaagccaggagagggacggctgatggactcagcatcggaaggtggcggtgaccgagggggtggggactgagccgcccgcctctgccgcccaccaccatctcaggaaaggctgttgtgctggtgcccgttccagctgcaggggtgacactgggaggggggggctctcctctcggtgctccttcactctgggcctggcctcaggcccctggtgcttccccccctcctcctgggagggggcccgtgaagagcaaatgagccaaacgtgaccactagcctcctggagccagagagtggggctcgtttgccggttgctccagcccggcgcccagccatcttccctgagccagccggcgggtggtgggcatgcctgcctcaccttcatcagggggtggccaggaggggcccagactgtgaatcctgtgctctgcccgtgaccgccccccgccccatcaatcccattgcataggtttagagagagcacgtgtgaccactggcattcatttggggggtgggagattttggctgaagccgccccagccttagtccccagggccaagcgctggggggaagacggggagtcagggagggggggaaatctcggaagagggaggagtctgggagtggggagggatggcccagcctgtaagatactgtatatgcgctgctgtagataccggaatgaattttctgtacatgtttggttaattttttttgtacatgatttttgtatgtttccttttcaataaaatcagattggaacagtgga

SEQ ID NO: 463 - DNA, 1827 bp, Homo sapiens
gaggcgattgcgattgggtgagacccagtaaggatggaaagtgtagaggagacaggaatccacggctttggaaaaaggaaggacaaaactcaccaaaccagagcagggcaggaagtaacaatgagaaactgaaaaagaaacggaatggaaagctatgagacaggatgaaatttggcatggggtctgcccaggcatgtccatgccaggtgcccagggctgcttccacgacgtgggtcccctgccagatttgtggccccagggagcgccatggcccgcgcacgccaggagggcagctccccggagcccgtagagggcctggcccgcgacggcccgcgccccttcccgctcggccgcctggtgccctcggcagtgtcctgcggcctctgcgagcccggcctggctgccgcccccgccgcccccaccctgctgcccgctgcctacctctgcgcccccaccgccccacccgccgtcaccgccgccctggggggttcccgctggcctgggggtccccgcagccggccccgaggcccgcgcccggacggtcctcagccctcgctctcgctggcggagcagcacctggagtcgcccgtgcccagcgccccgggggctctggcgggcggtcccacccaggcggccccgggagtccgcggggaggaggaacagtgggcccgggagatcggggcccagctgcggcggatggcggacgacctcaacgcacagtacgagcggcggagacaagaggagcagcagcggcaccgcccctcaccctggagggtcctgtacaatctcatcatgggactcctgcccttacccaggggccacagagcccccgagatggagcccaattaggtgcctgcacccgcccggtggacgtcagggactcggggggcaggcccctcccacctcctgacaccctggccagcgcgggggactttctctgcaccatgtagcatactggactcccagccctgcctgtcccgggggcgggccggggcagccactccagccccagcccagcctggggtgcactgacggagatgcggactcctgggtccctggccaagaagccaggagagggacggctgatggactcagcatcggaaggtggcggtgaccgagggggtggggactgagccgcccgcctctgccgcccaccaccatctcaggaaaggctgttgtgctggtgcccgttccagctgcaggggtgacactgggaggggggggctctcctctcggtgctccttcactctgggcctggcctcaggcccctggtgcttccccccctcctcctgggagggggcccgtgaagagcaaatgagccaaacgtgaccactagcctcctggagccagagagtggggctcgtttgccggttgctccagcccggcgcccagccatcttccctgagccagccggcgggtggtgggcatgcctgcctcaccttcatcagggggtggccaggaggggcccagactgtgaatcctgtgctctgcccgtgaccgccccccgccccatcaatcccattgcataggtttagagagagcacgtgtgaccactggcattcatttggggggtgggagattttggctgaagccgccccagccttagtccccagggccaagcgctggggggaagacggggagtcagggagggggggaaatctcggaagagggaggagtctgggagtggggagggatggcccagcctgtaagatactgtatatgcgctgctgtagataccggaatgaattttctgtacatgtttggttaattttttttgtacatgatttttgtatgtttccttttcaataaaatcagattggaacagtg

SEQ ID NO: 464 - DNA, 6325 bp, Homo sapiens
agtcgacgcgacgggtccgcccacaggcaaggaaggccgaccccgcgagtgcaggcgcgagcgctagcccgtgacgtctgagggggttggggggatgctgtgtgggtttcaagaagacgccacgcctccgccgccgccacgcccccgccgcctccaccgccggctgccgcgcccggaggaggtcgggatgttatcacttccgccggggcttctcactgtgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataaaaaagttatcagccatgggggatattatggggatggattaaatgccattgttgtgtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacaagttgatcaagaacttaatggaaaacaagatgaaccgaaaaatgaacagtaagtttggcatctagtccaaacaagactgaagaatgtgctgatggagcagtgctgtttctgcattcataatgcatttattggcccatatttttatgtaacctgttacaaaatagacttgactttttcataatggacttttgtattatacaagggactgttcactgctgtactggtttgcaaatttcttgaatttagctctttaatagctaactgtattattatcgttttatattttatattgctaaatagagaaccacactttatataaagtagtttttgcatttgtttattgaatgatgcatcttcttcggtgaaatatttatatgcataaatggcaaaggaaagaaataatatatatttttatgtcattgagcaatattttttaatgtgtacctgtcttatggaagaaatatgcaggtatataagaccacgattttctaaagtgcatattagaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaagtttaattaccgacaaaattatttctaaaacaacagattgatctgatattgtgtcatatacttgaaaggctcatacacagctggtaagcataataccttccaaatttgaaggtcatggctactcttcaacccttcctgtaaggtattttacaaaacagtggcctagagtagcaaaattgaagtggatgtgagctaacctttcaagatttagtctatcctagattgaacacacatgtggctgtgaccattctcatgtacttacaaaccttctgttacaaaagggaactttcctatattttttgtcctcctcagtcctaaacttggcatgctaacttaaaaccagttataggagagagatgctggaggattcccaggatgaaacattcctcagcagcctcctgacttaactcagatccagcagctcttggcagatcctgaactaatgtcattacagtgaattgagccaaaacgattattgcttgctcacattttaggaacacttgttgttgaagaagcaaactaacaataacaagttaggcattccttctgaatttaccatataaggattatgtataaacaattatattgaatttgtcattagattctatatttgtagacgatttaacgtagtctttcatctgtacatctttatcttgctcaaaatgggctgaggtttttaataggtggttttctaccacattaagtacttggttcttcagtttaaaaaatatgaagaataacttcaactcttttttgcattattttgatttttgattttgcagtcattgctcctaactgtagatacatgttgcaaaagtgatgtttttctgaattttttttaaaagtagaagactattctgttaaacattaaaattcagagacaacagtgataacacctgggatataatgaaaatgaggtgctgtgaatcagtaaactaaagggatacctgctttaacctgcaccttaatggaatctggtatagagatgtacccacaataaatgttttataagatttaagatcataatagtaggttagaggaagagcatttattaagtctgttgtttctaatctatagctaagttaacatttcccatattattccattttaatttcccattactgaccaaggtgaaagtatatgtgattgtacttttatctttctgttgggatcatggatctaatttaactggcttaatttgatgcttctgtcactaggctctaagtgccccttttttagtcagaagtttttcatgtgaaataatttgattctgtgttctgcttgatcatactcctaagcaagcaccaagggaagacgttctattcaccccacaatttaagcttaacaatctttaactcagagggagatatgaagaaatatgattctaagtagggtctagcagaggcattggaaagtgataaaagtaggaagtaagagaaagcaaacctttataaagagataaagacatagttgttacctaagatgccactgtatgtgtgccctctctttttttttttttttttttggagacagagactcactctgtcacccattctggagtgcagtggcgcaatcctggctcactgcaacctctgcctcccgggttcaagcatttctcctgcctcagcctcctgagtagctgggattacaggcacacgccacaatgcccggctaatttttgtatttttagtagagacggggtttcgccatgctaggctggtctcgaactcctgacctcatgatctgcctgtctcagcctcccaaatgcttggattacaggcttgagccaccacgcccggccatgtgtgtccttttaagggaagtaccatatgtgactgctgatggtaacatttcttgtatgcagcaggaaaacctgcaggctatacgcaaggtatgtgaataaagactgtggattgaagggggaaaagttgataatacatacccatgataagaattcatattttctctttctttgtctcttcatacagaagcaagttcgagcagagaaggttagcagttacagcacttaaaagtttaggattgagggtttttggttggtttttttgttttttcatatttcactgttgctgaacattgatttagtcttccaaaatggacatcactagtaagtgcactgaatactgaaatatgctgattggcaagcatatatctgtagctagaatttttttaaccgtaattccagaatttaaaaaggtaagagatctgctttttgatagaggccttttaaaaagactatataacatttctatttggctgtttatgtgaatgctcagggaatttggacatgtgttttatacagaagtggctttttatatttcttcaagtgataaattagcattaggacatatcagatagaacaggccagtttcctgatgagattggtagagatgttacggtaggttcatccttcctttttccatgttatatgtggagaagtgttaaacttgctcaagcaaatgggagtaggagataggctgaaaatagagattgctacaccattctattttgttttcatgcctgttttttctccaatcctatatggacatttgagaaatggaccacaaatctgagagggatagagtaaaaagaggcattaatgtatgtactcacaagttagacctattttgctgttaaaataggtctggtcttgttataggtcataggaattgtgtagtttgagttgctgcgagaaagagtcaagaacttagacttgaatgggaaggccaactggtgagggaagtggggtattatctactcaaatgttctaagctaatacaaaagaattacctggcaagcatccccctctgcccttcttgaaattctgaatgaacttagaatcagatcaatggtgagacccagttatgtaactttcctttgaagttctaaaggataattgaaaataaagtagtctggcatgtttaacagtaaggagtgacactaaaatttgaatataacagtatgttgcaactatttataatagacctatttatgttttgagaactaagtaaaatgctatgaaaaattcacataaagcacgtaagcaccaaatgaaaatcatttcgtgctttcaaattaatgatactaggcttgtaggatgtcttagaatcatgtttaacaagaagttaaaatatttgcattttgaaatttttatgcagtttggctaaggaggaacttggaaaataacattcatcagcttctacactgcactttttgtatgtggactttgtaaagtttaatgtccgtttaacagttgcttgtttatttgtgtaaacctagctagtaaatattgatgatgttcagggccactgacttgcacagcccttggagcactattcacacagaacacaattcagagtttgttaagacattaacacactttgatatctattccaaaaatacttttgttaccacaggttcattgctgtcatttagacaaaattaatgtactgtgatattttcctactcttaagatgatgttgcccagccgagtactgtcagaaattcagttctgatgtctgtgtgtgcaagatattaatgtggtccctgtaagaaataccagagttggtcatgatttactaaggagatgtaatattttctttgacctgttaggaatataacttgtgtcttgatttgttgcacatcatattttttgcaacattaatgaatttaaataaattaattggaacgtt

SEQ ID NO: 465 - DNA, 1509 bp, Homo sapiens
ctgtttgtatttggcagtttggccccccaccccgtcgcttttccgtttctggtagttgtgctcgggatggaaccttgcccctcctccgctcccccacccttttaccctggtgtgggtgaagtggctgggctacgatggttcagtatttatgaccagcgtccgtcctggtacagaacaaagaaacttggacttctggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataaaaaagttatcagccatgggggatattatggggatggattaaatgccattgttgtgtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacaagttgatcaagaacttaatggaaaacaagatgaaccgaaaaatgaacagtaagtttggcatctagtccaaacaagactgaagaatgtgctgatggagcagtgctgtttctgcattcataatgcatttattggcccatatttttatgtaacctgttacaaaatagacttgactttttcataatggacttttgtattatacaagggactgttcactgctgtactggtttgcaaatttcttgaatttagctctttaatagctaactgtattattatcgttttatattttatattgctaaatagagaaccacactttatataaagtagtttttgcatttgtttattgaatgatgcatcttcttcggtg

SEQ ID NO: 466 - DNA, 1234 bp, Homo sapiens
ggactcggcttgttgtgttgctgcctgagtgccggagacggtcctgctgctgccgcagtcctgccagctgtccgacaatgtcgtcccacctagtcgagccgccgccgcccctgcacaacaacaacaacaactgcgaggaaaatgagcagtctctgcccccgccggccggcctcaacagttcctgggtggagctacccatgaacagcagcaatggcaatgataatggcaatgggaaaaatggggggctggaacacgtaccatcctcatcctccatccacaatggagacatggagaagattcttttggatgcacaacatgaatcaggacagagtagttccagaggcagttctcactgtgacagcccttcgccacaagaagatgggcagatcatgtttgatgtggaaatgcacaccagcagggaccatagctctcagtcagaagaagaagttgtagaaggagagaaggaagtcgaggctttgaagaaaagtgcggactgggtatcagactggtccagtagacccgaaaacattccacccaaggagttccacttcagacaccctaaacgttctgtgtctttaagcatgaggaaaagtggagccatgaagaaagggggtattttctccgcagaatttctgaaggtgttcattccatctctcttcctttctcatgttttggctttggggctaggcatctatattggaaagcgactgagcacaccctgccagcacctactgagggaaaggaaaagcccctggaaatgcgtgtgacctgtgaagtggtgtattgtcacagtagcttatttgaacttgagaccattgtaagcatgacccaacctaccaccctgtttttacatatccaattccagtaactctcaaattcaatattttattcaaactctgttgaggcattttactaaccttataccctttttggcctgaagacattttagaatttcctaacagagtttactgttgtttagaaatttgcaagggcttcttttccgcaaatgccaccagcagattataattttgtcagcaatgctattatctctaattagtgccaccagactagacctgtatcattcatggtataaattttactcttgcaacataactaccatctctctcttaaaacgagatcaggttagcaaatgatgtaaaagaagctttattgtctagttgttttttttcccccaagacaaaggcaagtttccctaagtttgagttgatagtta

SEQ ID NO: 467 - DNA, 3610 bp, Homo sapiens
gcgcgtcagcctgactcgagcgtctccacgtccggggcccgcaggggagcgcccctgccccgtccggtcgcttgttgtgttgtcatcacgtggcctgggcgggccctgacgtcaggggcaggggagggacggcgcaggcgcagaaaagggggcggcggactcggcttgttgtgttgctgcctgagtgccggagacggtcctgctgctgccgcagtcctgccagctgtccgacaatgtcgtcccacctagtcgagccgccgccgcccctgcacaacaacaacaacaactgcgaggaaaatgagcagtctctgcccccgccggccggcctcaacagttcctgggtggagctacccatgaacagcagcaatggcaatgataatggcaatgggaaaaatggggggctggaacacgtaccatcctcatcctccatccacaatggagacatggagaagattcttttggatgcacaacatgaatcaggacagagtagttccagaggcagttctcactgtgacagcccttcgccacaagaagatgggcagatcatgtttgatgtggaaatgcacaccagcagggaccatagctctcagtcagaagaagaagttgtagaaggagagaaggaagtcgaggctttgaagaaaagtgcggactgggtatcagactggtccagtagacccgaaaacattccacccaaggagttccacttcagacaccctaaacgttctgtgtctttaagcatgaggaaaagtggagccatgaagaaagggggtattttctccgcagaatttctgaaggtgttcattccatctctcttcctttctcatgttttggctttggggctaggcatctatattggaaagcgactgagcacaccctctgccagcacctactgagggaaaggaaaagcccctggaaatgcgtgtgacctgtgaagtggtgtattgtcacagtagcttatttgaacttgagaccattgtaagcatgacccaacctaccaccctgtttttacatatccaattccagtaactctcaaattcaatattttattcaaactctgttgaggcattttactaaccttataccctttttggcctgaagacattttagaatttcctaacagagtttactgttgtttagaaatttgcaagggcttcttttccgcaaatgccaccagcagattataattttgtcagcaatgctattatctctaattagtgccaccagactagacctgtatcattcatggtataaattttactcttgcaacataactaccatctctctcttaaaacgagatcaggttagcaaatgatgtaaaagaagctttattgtctagttgttttttttcccccaagacaaaggcaagtttccctaagtttgagttgatagttattaaaaagaaaacaaaacaaaaaaaaaaggcaaggcacaacaaaaaaatatcctgggcaataaaaaaaatattttaaaccagctttggagccacttttttgtctaagcctcctaatagcgtcttttaatttataggaggcaaactgtataaatgataggtatgaaatagaataagaagtaaaatacatcagcagattttcatactagtatgttgtaatgctgtcttttctatggtgtagaatctttctttctgataaggaacgtctcaggcttagaaatatatgaaattgctttttgagatttttgcgtgtgtgtttgatattttttacgataattagctgcatgtgaatttttcatgaccttctttacattttttattttttatttctttatttttttttctctaagaagaggctttggaatgagttccaatttgtgatgttaatacaggcttcttgttttaggaagcatcacctatactctgaagcctttaaactctgaagagaattgtttcagagttattccaagcacttgtgcaacttggaaaaacagacttgggttgtgggaacagttgacagcgttctgaaaagatgccatttgtttccttctgatctctcactgaataatgtttactgtacagtcttcccaaggtgattcctgcgactgcaggcactggtcattttctcatgtagctgtcttttcagttatggtaaactcttaaagttcagaacactcaacagattccttcagtgatatacttgttcgttcatttctaaaatgtgaagctttaggaccaaattgttagaaagcatcaggatgaccagttatctcgagtagattttcttggatttcagaacatctagcatgactctgaaggataccacatgttttatatataaataattactgtttatgatatagacattgatattgactatttagagaaccgttgttaattttaaaactagcaatctataaagtgcaccaggtcaacttgaataaaaacactatgacagacaggtttgccagtttgcagaaactaactcttttctcacatcaacatttgtaaaattgatgtgttatagtggaaaataacatatagattaaacaaaatttttatcttttttcaagaatatagctggctatctttaagaaagatgatatatcctagttttgaaagtaattttcttttttctttctagcatttgatgtctaaataattttggacatctttttcctagaccatgtttctgtcttactcttaaacctggtaacacttgatttgccttctataacctatttatttcaagtgttcatatttgaatttctttgggaagaaagtaaatctgatggctcactgatttttgaaaagcctgaataaaattggaaagactggaaagttaggagaactgactagctaaactgctacagtatgcaatttctattacaattggtattacaggggggaaaagtaaaattacactttacctgaaagtgacttcttacagctagtgcattgtgctctttccaagttcagcagcagttctatcagtggtgccactgaaactgggtatatttatgatttctttcagcgttaaaaagaaacatagtgttgccctttttcttaaagcatcagtgaaattatggaaaattacttaaaacgtgaatacatcatcacagtagaatttattatgagagcatgtagtatgtatctgtagccctaacacatgggatgaacgttttactgctacacccagatttgtgttgaacgaaaacattgtggtttggaaaggagaattcaacaattaatagttgaaattgtgaggttaatgtttaaaaagctttacacctgtttacaatttggggacaaaaaggcaggcttcatttttcatatgtttgatgaaaactggctcaagatgtttgtaaatagaatcaagagcaaaactgcacaaacttgcacattggaaagtgcaacaagttcccgtgattgcagtaaaaatatttactattctaaaaaaatgagaattgaagacttagccagtcagataagttttttcatgaacccgttgtggaaattattggaattaactgagccaaagtgattatgcattcttcatctattttagttagcactttgtatcgttatatacagtttacaatacatgtataacttgtagctataaacattttgtgccattaaagctctcacaaaactttt

SEQ ID NO: 468 - DNA, 1352 bp, Homo sapiens
gtggctccaccccttcaactttttgtccaagaaaacttttcgtgtttgcctgtagctgatgtgcagttgtttctgctcccaaatcaacagggtttaatgaaaaccctagaaagtagaaacccgtgggagagaaaagaaaaaagacaagttcacaaggttcctgggtggagctacccatgaacagcagcaatggcaatgataatggcaatgggaaaaatggggggctggaacacgtaccatcctcatcctccatccacaatggagacatggagaagattcttttggatgcacaacatgaatcaggacagagtagttccagaggcagttctcactgtgacagcccttcgccacaagaagatgggcagatcatgtttgatgtggaaatgcacaccagcagggaccatagctctcagtcagaagaagaagttgtagaaggagagaaggaagtcgaggctttgaagaaaagtgcggactgggtatcagactggtccagtagacccgaaaacattccacccaaggagttccacttcagacaccctaaacgttctgtgtctttaagcatgaggaaaagtggagccatgaagaaagggggtattttctccgcagaatttctgaaggtgttcattccatctctcttcctttctcatgttttggctttggggctaggcatctatattggaaagcgactgagcacaccctctgccagcacctactgagggaaaggaaaagcccctggaaatgcgtgtgacctgtgaagtggtgtattgtcacagtagcttatttgaacttgagaccattgtaagcatgacccaacctaccaccctgtttttacatatccaattccagtaactctcaaattcaatattttattcaaactctgttgaggcattttactaaccttataccctttttggcctgaagacattttagaatttcctaacagagtttactgttgtttagaaatttgcaagggcttcttttccgcaaatgccaccagcagattataattttgtcagcaatgctattatctctaattagtgccaccagactagacctgtatcattcatggtataaattttactcttgcaacataactaccatctctctcttaaaacgagatcaggttagcaaatgatgtaaaagaagctttattgtctagttgttttttttcccccaagacaaaggcaagtttccctaagtttgagttgatagttattaaaaagaaaacaaaacaaaaaaaaaaggcaaggcacaacaaaaaaatatcctgggcaataaaaaaaatattttaaaccagctttggagccacttttttgtctaagcctcctaatagcgtcttttaatttatagga

SEQ ID NO: 469 - DNA, 739 bp, Homo sapiens
ctctgttgcctcctggggtcttgggcccggggccgtttgggctcgcggtccgggagcggcgcgggtagcgcggatccccctggttcctgggtggagctacccatgaacagcagcaatggcaatgataatggcaatgggaaaaatggggggctggaacacgtaccatcctcatcctccatccacaatggagacatggagaagattcttttggatgcacaacatgaatcaggacagagtagttccagaggcagttctcactgtgacagcccttcgccacaagaagatgggcagatcatgtttgatgtggaaatgcacaccagcagggaccatagctctcagtcagaagaagaagttgtagaaggagagaaggaagtcgaggctttgaagaaaagtgcggactgggtatcagactggtccagtagacccgaaaacattccacccaaggagttccacttcagacaccctaaacgttctgtgtctttaagcatgaggaaaagtggagccatgaagaaagggggtattttctccgcagaatttctgaaggtgttcattccatctctcttcctttctcatgttttggctttggggctaggcatctatattggaaagcgactgagcacaccctctgccagcacctactgagggaaaggaaaagcccctggaaatgcgtgtgacctgtgaagtggtgtattgtcacagtagcttatttgaacttgagaccattgtaagcatgacccaa

SEQ ID NO: 470 - DNA, 915 bp, Homo sapiens
ctgtcaagaggaggggcgcctgccttgctccgggcctctctgttgcctcctggggtcttgggcccggggccgtttgggctcgcggtccgggagcggcgcgggttcctgggtggagctacccatgaacagcagcaatggcaatgataatggcaatgggaaaaatggggggctggaacacgtaccatcctcatcctccatccacaatggagacatggagaagattcttttggatgcacaacatgaatcaggacagagtagttccagaggcagttctcactgtgacagcccttcgccacaagaagatgggcagatcatgtttgatgtggaaatgcacaccagcagggaccatagctctcagtcagaagaagaagttgtagaaggagagaaggaagtcgaggctttgaagaaaagtgcggactgggtatcagactggtccagtagacccgaaaacattccacccaaggagttccacttcagacaccctaaacgttctgtgtctttaagcatgaggaaaagtggagccatgaagaaagggggtattttctccgcagaatttctgaaggtgttcattccatctctcttcctttctcatgttttggctttggggctaggcatctatattggaaagcgactgagcacaccctctgccagcacctactgagggaaaggaaaagcccctggaaatgcgtgtgacctgtgaagtggtgtattgtcacagtagcttatttgaacttgagaccattgtaagcatgacccaacctaccaccctgtttttacatatccaattccagtaactctcaaattcaatattttattcaaactctgttgaggcattttactaaccttataccctttttggcctgaagacattttagaatttcctaacagagtttactgttgtttagaaatttgcaa

SEQ ID NO: 471 - DNA, 1321 bp, Homo sapiens
atgatcactggagtctcgcgggtccctcgggctgcacagggacaagtaaaggctacatccagatgccgggaatgcactgacgcccattcctggaaactgggctcccactcagcccctgggagcagcagccgccagcccctcgggacctccatctccaccctgctgagccacccgggttgggccaggatcccggcagacttcactgggacccatgctggagtaagaataaaaagtcccagaggaggccaggcacggtggctcacacctgtaatcccagcactgtggatggccgaggcagactcacgaggctgatcccgtcctccactgagacctgaaaaatggcttcggggcaaggcccaggtcctcccaggcaggagtgcggagagcctgccctgccctctgcttctgaggagcaggtagcccaggacacagaggaggttttccgcagctacgttttttaccgccatcagcaggaacaggaggctgaaggggtggctgcccctgccgacccagagatggtcaccttacctctgcaacctagcagcaccatggggcaggtgggacggcagctcgccatcatcggggacgacatcaaccgacgctatgactcagagttccagaccatgttgcagcacctgcagcccacggcagagaatgcctatgagtacttcaccaagattgccaccagcctgtttgagagtggcatcaattggggccgtgtggtggctcttctgggcttcggctaccgtctggccctacacgtctaccagcatggcctgactggcttcctaggccaggtgacccgcttcgtggtcgacttcatgctgcatcactgcattgcccggtggattgcacagaggggtggctgggtggcagccctgaacttgggcaatggtcccatcctgaacgtgctggtggttctgggtgtggttctgttgggccagtttgtggtacgaagattcttcaaatcatgactcccaagggtgccctttggggtcccggttcagacccctgcctggacttaagcgaagtctttgccttctctgttcccttgcaggggtcccccctcaagagtacagaagctttagcaagtgtgcactccagcttcggagggcccctgcgtgggggccagtcaggctgcagaggcacctcaacattgcatggtgctagtgggccctctctctgggcccaggggctgtggccgtctcctccctcagctctctgggacctccttagccctgtctgctaggcgctggggagactgataacttggggaggcaagagactgggagccacttctccccagaaagtgtttaacggt

SEQ ID NO: 472 - DNA, 2132 bp, Homo sapiens
gtctgcatccggtggccacagagcaacttcctctagagggagctgattggagccgggtgccgctggcacctctatgatcactggagtctcgcgggtccctcgggctgcacagggacaagtaaaggctacatccagatgccgggaatgcactgacgcccattcctggaaactgggctcccactcagcccctgggagcagcagccgccagcccctcgggacctccatctccaccctgctgagccacccgggttgggccaggatcccggcaggctgatcccgtcctccactgagacctgaaaaatggcttcggggcaaggcccaggtcctcccaggcaggagtgcggagagcctgccctgccctctgcttctgaggagcaggtagcccaggacacagaggaggttttccgcagctacgttttttaccgccatcagcagcaacctagcagcaccatggggcaggtgggacggcagctcgccatcatcggggacgacatcaaccgacgctatgactcagagttccagaccatgttgcagcacctgcagcccacggcagagaatgcctatgagtacttcaccaagattgccaccagcctgtttgagagtggcatcaattggggccgtgtggtggctcttctgggcttcggctaccgtctggccctacacgtctaccagcatggcctgactggcttcctaggccaggtgacccgcttcgtggtcgacttcatgctgcatcactgcattgcccggtggattgcacagaggggtggctgggtggcagccctgaacttgggcaatggtcccatcctgaacgtgctggtggttctgggtgtggttctgttgggccagtttgtggtacgaagattcttcaaatcatgactcccaagggtgccctttggggtcccggttcagacccctgcctggacttaagcgaagtctttgccttctctgttcccttgcaggggtcccccctcaagagtacagaagctttagcaagtgtgcactccagcttcggagggcccctgcgtgggggccagtcaggctgcagaggcacctcaacattgcatggtgctagtgggccctctctctgggcccaggggctgtggccgtctcctccctcagctctctgggacctccttagccctgtctgctaggcgctggggagactgataacttggggaggcaagagactgggagccacttctccccagaaagtgtttaacggttttagctttttataatacccttgtgagagcccattcccaccattctacctgaggccaggacgtctggggtgtggggattggtgggtctatgttccccaggattcagctattctggaagatcagcaccctaagagatgggactaggacctgagcctggtcctggccgtccctaagcatgtgtcccaggagcaggacctactaggagaggggggccaaggtcctgctcaactctacccctgctcccattcctccctccggccatactgcctttgcagttggactctcagggattctgggcttggggtgtggggtggggtggagtcgcagaccagagctgtctgaactcacgtgtcagaagcctccaagcctgcctcccaaggtcctctcagttctctcccttcctctctccttatagacacttgctcccaacccattcactacaggtgaaggctctcacccccatccctgggggccttgggtgagtggcctgctaaggctcctccttgcccagactacagggcttaggacttggtttgttatatcagggaaaaggagtagggagttcatctggagggttctaagtgggagaaggactatcaacaccactaggaatcccagaggtgggatcctccctcatggctctggcacagtgtaatccaggggtgtagatgggggaactgtgaatacttgaactctgttcccccaccctccatgctcctcacctgtctaggtctcctcagggtggggggtgacagtgccttctctattgggcacagcctagggtcttgggggtcaggggggagaagttcttgattcagccaaatgcagggaggggaggcagatggagcccataggccaccccctatcctctgagtgtttggaaataaactgtgcaatcccctcaccctg

SEQ ID NO: 473 - DNA, 2136 bp, Homo sapiens
gccgggtgccgctggcacctctatgatcactggagtctcgcgggtccctcgggctgcacagggacaagtaaaggctacatccagatgccgggaatgcactgacgcccattcctggaaactgggctcccactcagcccctgggagcagcagccgccagcccctcgggacctccatctccaccctgctgagccacccgggttgggccaggatcccggcaggctgatcccgtcctccactgagacctgaaaaatggcttcggggcaaggcccaggtcctcccaggcaggagtgcggagagcctgccctgccctctgcttctgaggagcaggtagcccaggacacagaggaggttttccgcagctacgttttttaccgccatcagcaggaacaggaggctgaaggggtggctgcccctgccgacccagagatggtcaccttacctctgcaacctagcagcaccatggggcaggtgggacggcagctcgccatcatcggggacgacatcaaccgacgctatgactcagagttccagaccatgttgcagcacctgcagcccacggcagagaatgcctatgagtacttcaccaagattgccaccagcctgtttgagagtggcatcaattggggccgtgtggtggctcttctgggcttcggctaccgtctggccctacacgtctaccagcatggcctgactggcttcctaggccaggtgacccgcttcgtggtcgacttcatgctgcatcactgcattgcccggtggattgcacagaggggtggctgggtggcagccctgaacttgggcaatggtcccatcctgaacgtgctggtggttctgggtgtggttctgttgggccagtttgtggtacgaagattcttcaaatcatgactcccaagggtgccctttggggtcccggttcagacccctgcctggacttaagcgaagtctttgccttctctgttcccttgcaggggtcccccctcaagagtacagaagctttagcaagtgtgcactccagcttcggagggcccctgcgtgggggccagtcaggctgcagaggcacctcaacattgcatggtgctagtgggccctctctctgggcccaggggctgtggccgtctcctccctcagctctctgggacctccttagccctgtctgctaggcgctggggagactgataacttggggaggcaagagactgggagccacttctccccagaaagtgtttaacggttttagctttttataatacccttgtgagagcccattcccaccattctacctgaggccaggacgtctggggtgtggggattggtgggtctatgttccccaggattcagctattctggaagatcagcaccctaagagatgggactaggacctgagcctggtcctggccgtccctaagcatgtgtcccaggagcaggacctactaggagaggggggccaaggtcctgctcaactctacccctgctcccattcctccctccggccatactgcctttgcagttggactctcagggattctgggcttggggtgtggggtggggtggagtcgcagaccagagctgtctgaactcacgtgtcagaagcctccaagcctgcctcccaaggtcctctcagttctctcccttcctctctccttatagacacttgctcccaacccattcactacaggtgaaggctctcacccccatccctgggggccttgggtgagtggcctgctaaggctcctccttgcccagactacagggcttaggacttggtttgttatatcagggaaaaggagtagggagttcatctggagggttctaagtgggagaaggactatcaacaccactaggaatcccagaggtgggatcctccctcatggctctggcacagtgtaatccaggggtgtagatgggggaactgtgaatacttgaactctgttcccccaccctccatgctcctcacctgtctaggtctcctcagggtggggggtgacagtgccttctctattgggcacagcctagggtcttgggggtcaggggggagaagttcttgattcagccaaatgcagggaggggaggcagatggagcccataggccaccccctatcctctgagtgtttggaaataaactgtgcaatcccctca

SEQ ID NO: 474 - DNA, 2117 bp, Homo sapiens
cgcgggtccctcgggctgcacagggacaagtaaaggctacatccagatgccgggaatgcactgacgcccattcctggaaactgggctcccactcagcccctgggagcagcagccgccagcccctcgggacctccatctccaccctgctgagccacccgggttgggccaggatcccggcaggctgatcccgtcctccactgagacctgaaaaatggcttcggggcaaggcccaggtcctcccaggcaggagtgcggagagcctgccctgccctctgcttctgaggagcaggtagcccaggacacagaggaggttttccgcagctacgttttttaccgccatcagcaggaacaggaggctgaaggggtggctgcccctgccgacccagagatggtcaccttacctctgcaacctagcagcaccatggggcaggtgggacggcagctcgccatcatcggggacgacatcaaccgacgctatgactcagagttccagaccatgttgcagcacctgcagcccacggcagagaatgcctatgagtacttcaccaagattgccaccaggccagcagcaacacccacagcctgtttgagagtggcatcaattggggccgtgtggtggctcttctgggcttcggctaccgtctggccctacacgtctaccagcatggcctgactggcttcctaggccaggtgacccgcttcgtggtcgacttcatgctgcatcactgcattgcccggtggattgcacagaggggtggctgggtggcagccctgaacttgggcaatggtcccatcctgaacgtgctggtggttctgggtgtggttctgttgggccagtttgtggtacgaagattcttcaaatcatgactcccaagggtgccctttggggtcccggttcagacccctgcctggacttaagcgaagtctttgccttctctgttcccttgcaggggtcccccctcaagagtacagaagctttagcaagtgtgcactccagcttcggagggcccctgcgtgggggccagtcaggctgcagaggcacctcaacattgcatggtgctagtgggccctctctctgggcccaggggctgtggccgtctcctccctcagctctctgggacctccttagccctgtctgctaggcgctggggagactgataacttggggaggcaagagactgggagccacttctccccagaaagtgtttaacggttttagctttttataatacccttgtgagagcccattcccaccattctacctgaggccaggacgtctggggtgtggggattggtgggtctatgttccccaggattcagctattctggaagatcagcaccctaagagatgggactaggacctgagcctggtcctggccgtccctaagcatgtgtcccaggagcaggacctactaggagaggggggccaaggtcctgctcaactctacccctgctcccattcctccctccggccatactgcctttgcagttggactctcagggattctgggcttggggtgtggggtggggtggagtcgcagaccagagctgtctgaactcacgtgtcagaagcctccaagcctgcctcccaaggtcctctcagttctctcccttcctctctccttatagacacttgctcccaacccattcactacaggtgaaggctctcacccccatccctgggggccttgggtgagtggcctgctaaggctcctccttgcccagactacagggcttaggacttggtttgttatatcagggaaaaggagtagggagttcatctggagggttctaagtgggagaaggactatcaacaccactaggaatcccagaggtgggatcctccctcatggctctggcacagtgtaatccaggggtgtagatgggggaactgtgaatacttgaactctgttcccccaccctccatgctcctcacctgtctaggtctcctcagggtggggggtgacagtgccttctctattgggcacagcctagggtcttgggggtcaggggggagaagttcttgattcagccaaatgcagggaggggaggcagatggagcccataggccaccccctatcctctgagtgtttggaaataaactgtgcaatcccctc

SEQ ID NO: 475 - DNA, 929 bp, Homo sapiens
cggcaggcccgggtcaggggcctcgagatcgggcttgggcccagagcatgttccagatcccagagtttgagccgagtgagcaggaagactccagctctgcagagaggggcctgggccccagccccgcaggggacgggccctcaggctccggcaagcatcatcgccaggccccaggcctcctgtgggacgccagtcaccagcaggagcagccaaccagcagcagccatcatggaggcgctggggctgtggagatccggagtcgccacagctcctaccccgcggggacggaggacgacgaagggatgggggaggagcccagcccctttcggggccgctcgcgctcggcgccccccaacctctgggcagcacagcgctatggccgcgagctccggaggatgagtgacgagtttgtggactcctttaagaagggacttcctcgcccgaagagcgcgggcacagcaacgcagatgcggcaaagctccagctggacgcgagtcttccagtcctggtgggatcggaacttgggcaggggaagctccgccccctcccagtgaccttcgctccacatcccgaaactccacccgttcccactgccctgggcagccatcttgaatatgggcggaagtacttccctcaggcctatgcaaaaagaggatccgtgctgtctcctttggagggagggctgacccagattcccttccggtgcgtgtgaagccacggaaggcttggtcccatcggaagttttgggttttccgcccacagccgccggaagtggctccgtggccccgccctcaggctccgggctttcccccaggcgcctgcgctaagtcgcgagccaggtttaaccgttgcgtcaccgggacccgagcccccgcgatgccctgggggccgtgctcactaccaaatgttaataaagcccgcgtctgtgc

SEQ ID NO: 476 - DNA, 1157 bp, Homo sapiens
gggcttggggtgagacctgtgcgccgtcaccacgggcggggcggggcctgggtccaccggggttctgaggggagactgaggtcctgagccgacagcctcagctccctgccaggccagacccggcagacagatgagggcccaggaggcctggcgggcctgggggcgctacggtgggagaggaagccaggggtacctgcctctgccttccagggccaccgttggccccagctgtgccttgactacgtaacatcttgtcctcacagcccagagcatgttccagatcccagagtttgagccgagtgagcaggaagactccagctctgcagagaggggcctgggccccagccccgcaggggacgggccctcaggctccggcaagcatcatcgccaggccccaggcctcctgtgggacgccagtcaccagcaggagcagccaaccagcagcagccatcatggaggcgctggggctgtggagatccggagtcgccacagctcctaccccgcggggacggaggacgacgaagggatgggggaggagcccagcccctttcggggccgctcgcgctcggcgccccccaacctctgggcagcacagcgctatggccgcgagctccggaggatgagtgacgagtttgtggactcctttaagaagggacttcctcgcccgaagagcgcgggcacagcaacgcagatgcggcaaagctccagctggacgcgagtcttccagtcctggtgggatcggaacttgggcaggggaagctccgccccctcccagtgaccttcgctccacatcccgaaactccacccgttcccactgccctgggcagccatcttgaatatgggcggaagtacttccctcaggcctatgcaaaaagaggatccgtgctgtctcctttggagggagggctgacccagattcccttccggtgcgtgtgaagccacggaaggcttggtcccatcggaagttttgggttttccgcccacagccgccggaagtggctccgtggccccgccctcaggctccgggctttcccccaggcgcctgcgctaagtcgcgagccaggtttaaccgttgcgtcaccgggacccgagcccccgcgatgccctgggggccgtgctcactaccaaatgttaataaagcccgcgtctgtgccgcc

SEQ ID NO: 477 - DNA, 634 bp, Homo sapiens
actagggcccggagcccggggtgctggagggaggcggcaggcccgggtcaggggcctcgagatcgggcttgggcccagagcatgttccagatcccagagtttgagccgagtgagcaggaagactccagctctgcagagaggggcctgggccccagccccgcaggggacgggccctcaggctccggcaagcatcatcgccaggccccaggcctcctgtgggacgccagtcaccagcaggagcagccaaccagcagcagccatcatggaggcgctggggctgtggagatccggagtcgccacagctcctaccccgcggggacggaggacgacgaagggatgggggaggagcccagcccctttcggggccgctcgcgctcggcgccccccaacctctgggcagcacagcgctatggccgcgagctccggaggatgagtgacgagtttgtggactcctttaagaagggacttcctcgcccgaagagcgcgggcacagcaacgcagatgcggcaaagctccaggcgcctgcgctaagtcgcgagccaggtttaaccgttgcgtcaccgggacccgagcccccgcgatgccctgggggccgtgctcactaccaaatgttaataaagcccgcgtctgtgcc

SEQ ID NO: 478 - DNA, 1038 bp, Homo sapiens
tagtcgggcggggttgtgagacgccgcgctcagcttccatcgctgggcggtcaacaagtgcgggcctggctcagcgcgggggggcgcggagaccgcgaggcgaccgggagcggctgggttcccggctgcgcgcccttcggccaggccgggagccgcgccagtcggagcccccggcccagcgtggtccgcctccctctgggcgtccacctgcccggagtactgccagcgggcatgaccgacccaccaggggcgccgccgccggcgctcgcaggccgcggatgaagaagaaaacccggcgccgctcgacccggagcgaggagttgacccggagcgaggagttgaccctgagtgaggaagcgacctggagtgaagaggcgacccagagtgaggaggcgacccagggcgaagagatgaatcggagccaggaggtgacccgggacgaggagtcgacccggagcgaggaggtgaccagggaggaaatggcggcagctgggctcaccgtgactgtcacccacagcaatgagaagcacgaccttcatgttacctcccagcagggcagcagtgaaccagttgtccaagacctggcccaggttgttgaagaggtcataggggttccacagtcttttcagaaactcatatttaagggaaaatctctgaaggaaatggaaacaccgttgtcagcacttggaatacaagatggttgccgggtcatgttaattgggaaaaagaacagtccacaggaagaggttgaactaaagaagttgaaacatttggagaagtctgtggagaagatagctgaccagctggaagagttgaataaagagcttactggaatccagcagggttttctgcccaaggatttgcaagctgaagctctctgcaaacttgataggagagtaaaagccacaatagagcagtttatgaagatcttggaggagattgacacactgatcctgccagaaaattttcctactctcacactggttctcaatgaaaaatagtgtctttgtgattttgagtaaagctcctatctgtttt

SEQ ID NO: 479 - DNA, 1268 bp, Homo sapiens
gcaggccggggcggggctgggaagtagtcgggcggggttgtgagacgccgcgctcagcttccatcgctgggcggtcaacaagtgcgggcctggctcagcgcgggggggcgcggagaccgcgaggcgaccgggagcggctgggttcccggctgcgcgcccttcggccaggccgggagccgcgccagtcggagcccccggcccagcgtggtccgcctccctctgggcgtccacctgcccggagtactgccagcgggcatgaccgacccaccaggggcgccgccgccggcgctcgcaggccgcggatgaagaagaaaacccggcgccgctcgacccggagcgaggagttgacccggagcgaggagttgaccctgagtgaggaagcgacctggagtgaagaggcgacccagagtgaggaggcgacccagggcgaagagatgaatcggagccaggaggtgacccgggacgaggagtcgacccggagcgaggaggtgaccagggaggaaatggcggcagctgggctcaccgtgactgtcacccacagcaatgagaagcacgaccttcatgttacctcccagcagggcagcagtgaaccagttgtccaagacctggcccaggttgttgaagaggtcataggggttccacagtcttttcagaaactcatatttaagggaaaatctctgaaggaaatggaaacaccgttgtcagcacttggaatacaagatggttgccgggtcatgttaattgggaaaaagaacagtccacaggaagaggttgaactaaagaagttgaaacatttggagaagtctgtggagaagatagctgaccagctggaagagttgaataaagagcttactggaatccagcagggttttctgcccaaggatttgcaagctgaagctctctgcaaacttgataggagagtaaaagccacaatagagcagtttatgaagatcttggaggagattgacacactgatcctgccagaaaatttcaaagacagtagattgaaaaggaaaggcttggtaaaaaaggttcaggcattcctagccgagtgtgacacagtggagcagaacatctgccaggagactgagcggctgcagtctacaaactttgccctggccgagtgaggtgtagcagaaaaaggctgtgctgccctgaagaatggcgccaccagctctgccgtctctggagcggaatttacctgatttcttcagggctgctgggggcaactggccatttgccaattttcctactctcacactggttct

SEQ ID NO: 480 - DNA, 3865 bp, Homo sapiens
aggccggggcggggctgggaagtagtcgggcggggttgtgagacgccgcgctcagcttccatcgctgggcggtcaacaagtgcgggcctggctcagcgcgggggggcgcggagaccgcgaggcgaccgggagcggctgggttcccggctgcgcgcccttcggccaggccgggagccgcgccagtcggagcccccggcccagcgtggtccgcctccctctgggcgtccacctgcccggagtactgccagcgggcatgaccgacccaccaggggcgccgccgccggcgctcgcaggccgcggatgaagaagaaaacccggcgccgctcgacccggagcgaggagttgacccggagcgaggagttgaccctgagtgaggaagcgacctggagtgaagaggcgacccagagtgaggaggcgacccagggcgaagagatgaatcggagccaggaggtgacccgggacgaggagtcgacccggagcgaggaggtgaccagggaggaaatggcggcagctgggctcaccgtgactgtcacccacagcaatgagaagcacgaccttcatgttacctcccagcagggcagcagtgaaccagttgtccaagacctggcccaggttgttgaagaggtcataggggttccacagtcttttcagaaactcatatttaagggaaaatctctgaaggaaatggaaacaccgttgtcagcacttggaatacaagatggttgccgggtcatgttaattgggaaaaagaacagtccacaggaagaggttgaactaaagaagttgaaacatttggagaagtctgtggagaagatagctgaccagctggaagagttgaataaagagcttactggaatccagcagggttttctgcccaaggatttgcaagctgaagctctctgcaaacttgataggagagtaaaagccacaatagagcagtttatgaagatcttggaggagattgacacactgatcctgccagaaaatttcaaagacagtagattgaaaaggaaaggcttggtaaaaaaggttcaggcattcctagccgagtgtgacacagtggagcagaacatctgccaggagactgagcggctgcagtctacaaactttgccctggccgagtgaggtgtagcagaaaaaggctgtgctgccctgaagaatggcgccaccagctctgccgtctctggagcggaatttacctgatttcttcagggctgctgggggcaactggccatttgccaattttcctactctcacactggttctcaatgaaaaatagtgtctttgtgattttgagtaaagctcctatctgttttctccttctgtctctgtggttgtactgtccagcaatccaccttttctggagagggccacctctgcccaaattttcccagctgtttggacctctgggtgctttctttgggctggtgagagctctaatttgccttgggccagtttcaggtttataggccccctcagtcttcagatacatgagggcttctttgctcttgtgatcgtgtagtcccatagctgtaaaaccagaatcaccaggaggttgcacctagtcaggaatattgggaatggcctagaacaaggtgtttggcacataagtagaccacttatccctcattgtgacctaattccagagcatctggctgggttgttgggttctagactttgtcctcacctcccagtgaccctgactagccacaggccatgagataccagggggccgttccttggatggagcctgtggttgatgcaaggcttccttgtccccaagcaagtcttcagaaggttagaacccagtgttgactgagtctgtgcttgaaaccaggccagagccatggattaggaagggcaaagagaaggcaccagaatgagtaaagcaggcaggtggtgaagccaaccataaacttctcaggagtgacatgtgcttccttcaaaggcatttttgttaaccatatccttctgagttctatgtttccttcacagctgttctatccattttgtggactgtcccccacccccaccccatcattgtttttaaaaaattaaggcctggcgcagcagctcatgcctataatcccagcactttgggaggctgaggcgggcggatcacttgaggccaggagtttgagaccagcccaggcaacatagcaaaaccccattctgctttaaaaaaaaaaaaaaaaaaaattagcttggcgtagtggcatgtgcctataatcccagctactggggaggctgaggcacaagaatcatttgaacctgggaggtagaggttgctgtgagccgagattacgcccctgcactccagcctgggtcacagagtgagactccatctcagaaaaaaaaaaaattgagtcaggtgcagtagctccttcctgtagtcccagctacttgggaggctgaggctagaggatcacttgagcccaggagtttgagtctagtctgggcaacatagcaagaccccatctctaaaatttaagtaagtaaaagtagataaataaaaagaaaaaaaaactgtttatgtgctcatcataaagtagaagagtggtttgcttttttttttttttttggattaatgaggaaatcattctgtggctctagtcataatttatgcttaataacattgatagtagccctttgcgctataactctacctaaagactcacatcatttggcagagagagagtcgttgaagtcccaggaattcaggactgggcaggttaagacctcagacaaggtagtagaggtagacttgtggacaaggctcgggtcccagcccaccgcaccccaactttaatcagagtggttcactattgatctatttttgtgtgatagctgtgtggcgtgggccacaacatttaatgagaagttactgtgcaccaaactgccgaacaccattctaaactattcatatatattagtcatttaattcttacataacttgagaggtagacagatatccttattttagagatgaggaaaccaagagaacttaggtcattagcgcaaggttgtagagtaagcggcaaagccaagacacaaagctgggtggtttggtttcagagccagtgcttttcccctctactgtactgcctctcaaccaacacagggttgcacaggcccattctctgatttttttcctcttgtcctctgcctctccctctagctcccacttcctctctgctctagttcattttctttagagcagcccgagtgatcatgaagtgcaaatcttgccatgtcagtcccctgcttagaaccctccaatggctcactttctctttaggcaaaagtctttaccccatgccttctcccatctcatctcaaccccctcatttgttggctgtctgctgtcagccactcttctttcaggtcctcagatgcactgcaccctctcctgcctgggggtctttgctcctgctactacctctgcttgaacagctcctcaccttccttcctccaaccctacccttgtataggtgacttttgttcatccttcagaattcaactcacatgtctcttgcatggagaaccctcacctactgtgttgagaccctgtccagcccccaggtgggatcctctctcgacttcccatacatttctttcacagcatttacatagtccatgatagtttacttgtgggattatttggttaatctttgcctttaacaccagggttccttgggtgaaggagcttctttatcttggtaacagcattatttcaagcataacttgtaatatagttatattacatatataacatatatatatataacataacatatataacatatataacaagcataacttgttatatagtcttgtatatagtaagacctcaataaatatttgg

SEQ ID NO: 481 - DNA, 2571 bp, Homo sapiens
gcggagctccgcatccaaccccgggccgcggccaacttctctggactggaccagaagtttctagccggccagttgctacctccctttatctcctccttcccctctggcagcgaggaggctatttccagacacttccacccctctctggccacgtcacccccgcctttaattcataaaggtgcccggcgccggcttcccggacacgtcggcggcggagaggggcccacggcggcggcccggccagagactcggcgcccggagccagcgccccgcacccgcgccccagcgggcagaccccaacccagcatgagcgccgccacccactcgcccatgatgcaggtggcgtccggcaacggtgaccgcgaccctttgccccccggatgggagatcaagatcgacccgcagaccggctggcccttcttcgtggaccacaacagccgcaccactacgtggaacgacccgcgcgtgccctctgagggccccaaggagactccatcctctgccaatggcccttcccgggagggctctaggctgccgcctgctagggaaggccaccctgtgtacccccagctccgaccaggctacattcccattcctgtgctccatgaaggcgctgagaaccggcaggtgcaccctttccatgtctatccccagcctgggatgcagcgattccgaactgaggcggcagcagcggctcctcagaggtcccagtcacctctgcggggcatgccagaaaccactcagccagataaacagtgtggacaggtggcagcggcggcggcagcccagcccccagcctcccacggacctgagcggtcccagtctccagctgcctctgactgctcatcctcatcctcctcggccagcctgccttcctccggcaggagcagcctgggcagtcaccagctcccgcgggggtacatctccattccggtgatacacgagcagaacgttacccggccagcagcccagccctccttccaccaagcccagaagacgcactacccagcgcagcagggggagtaccagacccaccagcctgtgtaccacaagatccagggggatgactgggagccccggcccctgcgggcggcatccccgttcaggtcatctgtccagggtgcatcgagccgggagggctcaccagccaggagcagcacgccactccactccccctcgcccatccgtgtgcacaccgtggtcgacaggcctcagcagcccatgacccatcgagaaactgcacctgtttcccagcctgaaaacaaaccagaaagtaagccaggcccagttggaccagaactccctcctggacacatcccaattcaagtgatccgcaaagaggtggattctaaacctgtttcccagaagcccccacctccctctgagaaggtagaggtgaaagttccccctgctccagttccttgtcctcctcccagccctggcccttctgctgtcccctcttcccccaagagtgtggctacagaagagagggcagcccccagcactgcccctgcagaagctacacctccaaaaccaggagaagccgaggctcccccaaaacatccaggagtgctgaaagtggaagccatcctggagaaggtacaggggctggagcaggctgtagacaactttgaaggcaagaagactgacaaaaagtacctgatgatcgaagagtatttgaccaaagagctgctggccctggattcagtggaccccgagggacgagccgatgtgcgtcaggccaggagagacggtgtcaggaaggttcagaccatcttggaaaaacttgaacagaaagccattgatgtcccaggtcaagtccaggtctatgaactccagcccagcaaccttgaagcagatcagccactgcaggcaatcatggagatgggtgccgtggcagcagacaagggcaagaaaaatgctggaaatgcagaagatccccacacagaaacccagcagccagaagccacagcagcagcgacttcaaaccccagcagcatgacagacacccctggtaacccagcagcaccgtagcctctgccctgtaaaaatcagactcggaaccgatgtgtgctttagggaattttaagttgcatgcatttcagagactttaagtcagttggtttttattagctgcttggtatgcagtaacttgggtggaggcaaaacactaataaaagggctaaaaaggaaaatgatgcttttcttctatattcttactctgtacaaataaagaagttgcttgttgtttgagaagtttaaccccgttgcttgttgttctgcagccctgtctacttgggcacccccaccacctgttagctgtggttgtgcactgtcttttgtagctctggactggaggggtagatggggagtcaattacccatcacataaatatgaaacatttatcagaaatgttgccattttaatgagatgattttcttcatctcataattaaaatacctgactttagagagagtaaaatgtgccaggagccataggaatatctgtatgttggatgactttaatgctacattttaaaaaaagaaaataaagtaataatataactcaaaa

SEQ ID NO: 482 - DNA, 1146 bp, Homo sapiens
tcatgtggcacatgtgataccatgtgaggtatctggtgttactaagtcgtcacgtatttcgatgaagggtccacaggctcagaaaagatggaacgagtgactgtggagaagggtagaacatgggcctgcccagagcgcgaaggcagatacagaagagctgcccgtgaaggatgcaggagactccatcctctgccaatggcccttcccgggagggctctaggctgccgcctgctagggaaggccaccctgtgtacccccagctccgaccaggctacattcccattcctgtgctccatgaaggcgctgagaaccggcaggtgcaccctttccatgtctatccccagcctgggatgcagcgattccgaactgaggcggcagcagcggctcctcagaggtcccagtcacctctgcggggcatgccagaaaccactcagccagataaacagtgtggacaggtggcagcggcggcggcagcccagcccccagcctcccacggacctgagcggtcccagtctccagctgcctctgactgctcatcctcatcctcctcggccagcctgccttcctccggcaggagcagcctgggcagtcaccagctcccgcgggggtacatctccattccggtgatacacgagcagaacgttacccggccagcagcccagccctccttccaccaagcccagaagacgcactacccagcgcagcagggggagtaccagacccaccagcctgtgtaccacaagatccagggggatgactgggagccccggcccctgcgggcggcatccccgttcaggtcatctgtccagggtgcatcgagccgggagggctcaccagccaggagcagcacgccactccactccccctcgcccatccgtgtgcacaccgtggtcgacaggcctcagcccatgacccatcgagaaactgcacctgtttcccagcctgaaaacaaaccagaaagtaagccaggcccagttggaccagaactccctcctggacacatcccaattcaagtgatccgcaaagaggtggattctaaacctgtttcccagaagcccccacctccctctgagaaggtagaggtgaaagttccccctgctccagttccttgtcctcctcccagccctggcccttctgctgtcccct

SEQ ID NO: 483 - DNA, 1358 bp, Homo sapiens
atggacgggtccggggagcagcccagaggcggggggcccaccagctctgagcagatcatgaagacaggggcccttttgcttcagggtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccggaactgatcagaaccatcatgggctggacattggacttcctccgggagcggctgttgggctggatccaagaccagggtggttgggtgagactcctcaagcctcctcacccccaccaccgcgccctcaccaccgcccctgccccaccgtccctgccccccgccactcctctgggaccctgggccttctggagcaggtcacagtggtgccctctccccatcttcagatcatcagatgtggtctataatgcgttttccttacgtgtctgatcaatccccgattcatctaccctgctgacctcccagtgacccctgacctcactgtgaccttgacttgattagtgccttctgccctccctggagcctccactgcctctggaattgctcaagttcattgatgaccctctgaccctagctctttcctttttttttttttccccactgagaaggggtctcgctatgttgcccaggttggtctcgaactcctggcctcaagcgatcctcccgcctcagcctctcaaagtgctgggattacaggtgtgagccaccatgcctggcctgagtccagctctttaatgcccgttcatctcagtcccctgcccgcaatcctgccttctggcctcctccgtccctgatcccgcctctgcctgcccaggggctgcccctggccgagtcactgaagcgactgatgtccctgtctccaggacggcctcctctcctactttgggacgcccacgtggcagaccgtgaccatctttgtggcgggagtgctcaccgcctcactcaccatctggaagaagatgggctgaggcccccagctgccttggactgtgtttttcctccataaattatggcatttttctgggaggggtggggattgggggacgtgggcatttttcttacttttgtaattattggggggtgtggggaagagtggtcttgagggggtaataaacctccttcgggacaca

SEQ ID NO: 484 - DNA, 793 bp, Homo sapiens
gctgcggccgcccgcgcggacccggcgagaggcggcggcgggagcggcggtgatggacgggtccggggagcagcccagaggcggggggcccaccagctctgagcagatcatgaagacaggggcccttttgcttcagggtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccggaactgatcagaaccatcatgggctggacattggacttcctccgggagcggctgttgggctggatccaagaccagggtggttgggacggcctcctctcctactttgggacgcccacgtggcagaccgtgaccatctttgtggcgggagtgctcaccgcctcactcaccatctggaagaagatgggctgaggcccccagctgccttggactgtgtttttcctccataaattatggcatttttctgggaggggtggggattgggggacgtgggcatttttcttacttttgtaattattggggggtgtggggaagagtggtcttgagggggtaataaacctccttcgggacaca

SEQ ID NO: 485 - DNA, 433 bp, Homo sapiens
atggacgggtccggggagcagcccagaggcggggggcccaccagctctgagcagatcatgaagacaggggcccttttgcttcaggggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccggaactgatcagaaccatcatgggctggacattggacttcctccgggagcggctgttgggctggatccaagaccagggtggttgggacggcctcctctcctactttgggacgcccacgtggcagaccgtgaccatctttgtggcgggagtgctcaccgcctcactcaccatctggaagaagatgggctgag

SEQ ID NO: 486 - DNA, 735 bp, Homo sapiens
gcggccgcccgcgcggacccggcgagaggcggcggcgggagcggcggtgatggacgggtccggggagcagcccagaggcggggtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccggaactgatcagaaccatcatgggctggacattggacttcctccgggagcggctgttgggctggatccaagaccagggtggttgggacggcctcctctcctactttgggacgcccacgtggcagaccgtgaccatctttgtggcgggagtgctcaccgcctcactcaccatctggaagaagatgggctgaggcccccagctgccttggactgtgtttttcctccataaattatggcatttttctgggaggggtggggattgggggacgtgggcatttttcttacttttgtaattattggggggtgtggggaagagtggtcttgagggggtaataaacctccttcgggac

SEQ ID NO: 487 - DNA, 540 bp, Homo sapiens
atggacgggtccggggagcagcccagaggcggggggcccaccagctctgagcagatcatgaagacaggggcccttttgcttcagggtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccggaactgatcagaaccatcatgggctggacattggacttcctccgggagcggctgttgggctggatccaagaccagggtggttggaccgtgaccatctttgtggcgggagtgctcaccgcctcactcaccatctggaagaagatgggctga

SEQ ID NO: 488 - DNA, 866 bp, Homo sapiens
tcacgtgacccgggcgcgctgcggccgcccgcgcggacccggcgagaggcggcggcgggagcggcggtgatggacgggtccggggagcagcccagaggcggggggcccaccagctctgagcagatcatgaagacaggggcccttttgcttcagggtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgccagcaaactggtgctcaaggctggcgtgaaatggcgtgatctgggctcactgcaacctctgcctcctgggttcaagcgattcacctgcctcagcatcccaaggagctgggattacaggccctgtgcaccaaggtgccggaactgatcagaaccatcatgggctggacattggacttcctccgggagcggctgttgggctggatccaagaccagggtggttggaccgtgaccatctttgtggcgggagtgctcaccgcctcactcaccatctggaagaagatgggctgaggcccccagctgccttggactgtgtttttcctccataaattatggcatttttctgggaggggtggggattgggggacgtgggcatttttcttacttttgtaattattggggggtgtggggaagagtggtcttgagggggtaataaacctccttcgggac

SEQ ID NO: 489 - DNA, 953 bp, Homo sapiens
gcagacacgaagcctcccgggtggcttacagacgctgccagcatcgccgccgccagaggagaaatgtctgaagtaagacccctctccagagacatcttgatggagaccctcctgtatgagcagctcctggaacccccgaccatggaggttcttggcatgactgactctgaagaggacctggaccctatggaggacttcgattctttggaatgcatggagggcagtgacgcattggccctgcggctggcctgcatcggggacgagatggacgtgagcctcagggccccgcgcctggcccagctctccgaggtggccatgcacagcctgggtctggctttcatctacgaccagactgaggacatcagggatgttcttagaagtttcatggacggtttcaccacacttaaggagaacataatgaggttctggagatccccgaaccccgggtcctgggtgtcctgcgaacaggtgctgctggcgctgctgctgctgctggcgctgctgctgccgctgctcagcgggggcctgcacctgctgctcaagtgaggccccggcggctcagggcggggctggccccacccccatgaccactgccctggaggtggcggcctgctgctgttatctttttaactgttttctcatgatgcctttttatatttaaaccccgagatagtgctggaacactgctgaggttttatactcaggttttttgttttttttttattccagttttcgttttttctaaaagatgaattcctatggctctgcaattgtcaccggttaactgtggcctgtgcccaggaagagccattcactcctgcccctgcccacacggcaggtagcagggggagtgctggtcacacccctgtgtgatatgtgatgccctcggcaaagaatctactggaatagattccgaggagcaggagtgctcaataaaatgttggtttccagca

SEQ ID NO: 490 - DNA, 2610 bp, Homo sapiens
gcaggaggccgcggctgcggagcggccgccctcgatccgggcgatggaggaggaagcaagcgagggggctggttcctgagcttcgcaattcctgtgtcgccttctgggctcccagcctgccgggtcgcatgatccctccggccggagctggtttttttgccagccaccgcgaggccggctgagttaccggcatccccgcagccacctcctctcccgacctgtgatacaaaagatcttccgggggctgcacctgcctgcctttgcctaaggcggatttgaatctctttctctcccttcagaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttggcctcagaattcacaaaatttccacaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtcccttcccctccctggctcccatgaccatactgagggaccaactgggcccaagacagatgccccagagctgtttatggcctcagctgcctcacttcctacaagagcagcctgtggcatctttgccttgggctgctcctcatggtgggttcaggggactcagccctgaggtgaaagggagctatcaggaacagctatgggagccccagggtcttccctacctcaggcaggaagggcaggaaggagagcctgctgcatggggtggggtagggctgactagaagggccagtcctgcctggccaggcagatctgtgccccatgcctgtccagcctgggcagccaggctgccaaggccagagtggcctggccaggagctcttcaggcctccctctctcttctgctccacccttggcctgtctcatccccaggggtcccagccaccccgggctctctgctgtacatatttgagactagtttttattccttgtgaagatgatatactatttttgttaagcgtgtctgtatttatgtgtgaggagctgctggcttgcagtgcgcgtgcacgtggagagctggtgcccggagattggacggcctgatgctccctcccctgccctggtccagggaagctggccgagggtcctggctcctgaggggcatctgcccctcccccaacccccaccccacacttgttccagctctttgaaatagtctgtgtgaaggtgaaagtgcagttcagtaataaactgtgtttactcagtgaacaaaga

SEQ ID NO: 491 - DNA, 2383 bp, Homo sapiens
gggcgatggaggaggaagcaagcgagggggctggttcctgagcttcgcaattcctgtgtcgccttctgggctcccagcctgccgggtcgcatgatccctccggccggagctggtttttttgccagccaccgcgaggccggctgagttaccggcatccccgcagccacctcctctcccgacctgtgatacaaaagatcttccgggggctgcacctgcctgcctttgcctaaggcggatttgaatctctttctctcccttcagaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttggcctcagaattcacaaaatttccacaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtcccttcccctccctggctcccatgaccatactgagggaccaactgggcccaagacagatgccccagagctgtttatggcctcagctgcctcacttcctacaagagcagcctgtggcatctttgccttgggctgctcctcatggtgggttcaggggactcagccctgaggtgaaagggagctatcaggaacagctatgggagccccagggtcttccctacctcaggcaggaagggcaggaaggagagcctgctgcatggggtggggtagggctgactagaagggccagtcctgcctggccaggcagatctgtgccccatgcctgtccagcctgggcagccaggctgccaaggccagagtggcctggccaggagctcttcaggcctccctctctcttctgctccacccttggcctgtctcatccccaggggtcccagccaccccgggctctctgctgtacatatttgagactagtttttattccttgtgaagatgatatactatttttgttaagcgtgtctgtatttatgtgtgaggagctgctggcttgcagtgcgcgtgcacgtggagagctggtgcccggagattggacggcctgatgctccctcccctgccctggtccagggaagctggccgagggtcctggctcctgaggggcatctgcccctcccccaacccccaccccacacttgttccagctctttgaaatagtctgtgtgaaggtgaaagtgcagttcagtaataaactgtgtttactcagtgaacaaaga

SEQ ID NO: 492 - DNA, 2578 bp, Homo sapiens
ggagtggggcgggggggactgcccagggagtgactttccgaggaaggcatttcggagaagacgggggtagaaaaggctggtgggagattcagagtccactggtgctttcgatttgacttaagtgaagtatcttggaacctagacccagaccttcgtaagacccacaaagaaaccagttctggtacctggagggggaatggaatttttagggtaaatggcatgcatattaattatttttttttcctgaagctctttctctcccttcagaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttggcctcagaattcacaaaatttccacaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtcccttcccctccctggctcccatgaccatactgagggaccaactgggcccaagacagatgccccagagctgtttatggcctcagctgcctcacttcctacaagagcagcctgtggcatctttgccttgggctgctcctcatggtgggttcaggggactcagccctgaggtgaaagggagctatcaggaacagctatgggagccccagggtcttccctacctcaggcaggaagggcaggaaggagagcctgctgcatggggtggggtagggctgactagaagggccagtcctgcctggccaggcagatctgtgccccatgcctgtccagcctgggcagccaggctgccaaggccagagtggcctggccaggagctcttcaggcctccctctctcttctgctccacccttggcctgtctcatccccaggggtcccagccaccccgggctctctgctgtacatatttgagactagtttttattccttgtgaagatgatatactatttttgttaagcgtgtctgtatttatgtgtgaggagctgctggcttgcagtgcgcgtgcacgtggagagctggtgcccggagattggacggcctgatgctccctcccctgccctggtccagggaagctggccgagggtcctggctcctgaggggcatctgcccctcccccaacccccaccccacacttgttccagctctttgaaatagtctgtgtgaaggtgaaagtgcagttcagtaataaactgtgtttactcagtgaacaaaga

SEQ ID NO: 493 - DNA, 820 bp, Homo sapiens
ctttgcgtctcgggctcgcgcgcgttgccgcggcaccggaagtgactgagcttgcaagttcccctgtctcttcaggggaaactgaggccggcttgttcgggagagacggcgcgagcagtcagccagctctttctctcccttcagaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgg

SEQ ID NO: 494 - DNA, 2588 bp, Homo sapiens
ggtggcaggaggccgcggctgcggagcggccgccctcgatccgggcgatggaggaggaagcaagcgagggggctggttcctgagcttcgcaattcctgtgtcgccttctgggctcccagcctgccgggtcgcatgatccctccggccggagctggtttttttgccagccaccgcgaggccggctgagttaccggcatccccgcagccacctcctctcccgacctgtgatacaaaagatcttccgggggctgcacctgcctgcctttgcctaaggcggatttgaataatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttggcctcagaattcacaaaatttccacaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtcccttcccctccctggctcccatgaccatactgagggaccaactgggcccaagacagatgccccagagctgtttatggcctcagctgcctcacttcctacaagagcagcctgtggcatctttgccttgggctgctcctcatggtgggttcaggggactcagccctgaggtgaaagggagctatcaggaacagctatgggagccccagggtcttccctacctcaggcaggaagggcaggaaggagagcctgctgcatggggtggggtagggctgactagaagggccagtcctgcctggccaggcagatctgtgccccatgcctgtccagcctgggcagccaggctgccaaggccagagtggcctggccaggagctcttcaggcctccctctctcttctgctccacccttggcctgtctcatccccaggggtcccagccaccccgggctctctgctgtacatatttgagactagtttttattccttgtgaagatgatatactatttttgttaagcgtgtctgtatttatgtgtgaggagctgctggcttgcagtgcgcgtgcacgtggagagctggtgcccggagattggacggcctgatgctccctcccctgccctggtccagggaagctggccgagggtcctggctcctgaggggcatctgcccctcccccaacccccaccccacacttgttccagctctttgaaatagtctgtgtgaaggtgaaagtgcagttcagtaataaactgtgtttactcagtg

SEQ ID NO: 495 - DNA, 1157 bp, Homo sapiens
gaaaccttgaaccccattgagaagtccctttagggtttcggacgcctccacctcaccctgggctggtgcttaaatagaaaaaagaaaaacaaaaaccaactaaatccataccagccacctccgggagagtactcctggctcccagtaggaggcggagagccaaggggcgtgcaagagagagggggctgggctcccgggtggcaggaggccgcggctgcggagcggccgccctcgatccgggcgatggaggaggaagcaagcgagggggctggttcctgagcttcgcaattcctgtgtcgccttctgggctcccagcctgccgggtcgcatgatccctccggccggagctggtttttttgccagccaccgcgaggccggctgagttaccggcatccccgcagccacctcctctcccgacctgtgatacaaaagatcttccgggggctgcacctgcctgcctttgcctaaggcggatttgaataatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgg

SEQ ID NO: 496 - DNA, 381 bp, Homo sapiens
tttcggagaagacgggggtagaaaaggctggtgggagattcagagtccactggtgctttcgatttgacttaagtgaagtatcttggaacctagacccagaccttcctctttctctcccttcagaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccag

SEQ ID NO: 497 - DNA, 781 bp, Homo sapiens
ctttgcgtctcgggctcgcgcgcgttgccgcggcaccggaagtgactgagcttgcaagttcccctgtctcttcaggggaaactgaggccggcttgttcgggagagacggcgcgagcagtcagccagaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttgg

SEQ ID NO: 498 - DNA, 894 bp, Homo sapiens
ggcttgttcgggagagacggcgcgagcagtcagccaggtaggccggcagccaggtaggccggcccgggtccgcggcgcggaactcggccgcgaagagctcttgcgtctggaagctaccgggccgatgaagggggatgtggccccccacggctcgcggggctcgcagaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgggatacttttgtggaactctatgggaacaatgcagcagccgagagccgaaagg

SEQ ID NO: 499 - DNA, 914 bp, Homo sapiens
ccggaagtgactgagcttgcaagttcccctgtctcttcaggggaaactgaggccggcttgttcgggagagacggcgcgagcagtcagccaggtaggccggcagccaggtaggccggcccgggtccgcggcgcggaactcggccgcgaagagctcttgcgtctggaagctaccgggccgatgaagggggatgtggccccccacggctcgcggggctcgcagctctttctctcccttcagaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgg

SEQ ID NO: 500 - DNA, 1249 bp, Homo sapiens
cgggccaagaaaaccagcgaaggcccggccccccagcagaggccggaccatggttgaccagttgcgggagcgcaccaccatggccgacccgctgcgggagcgcaccgagctgttgctggccgactacctggggtactgcgcccgggaacccggcacccccgagccggcgccatccacgcccgaggccgccgtgctgcgctccgcggccgccaggttacggcagattcaccggtcctttttctccgcctacctcggctaccccgggaaccgcttcgagctggtggcgctgatggcggattccgtgctctccgacagccccggccccacctggggcagagtggtgacgctcgtgaccttcgcagggacgctgctggagagagggccgctggtgaccgcccggtggaagaagtggggcttccagccgcggctaaaggagcaggagggcgacgtcgcccgggactgccagcgcctggtggccttgctgagctcgcggctcatggggcagcaccgcgcctggctgcaggctcagggcggctgggatggcttttgtcacttcttcaggaccccctttccactggctttttggagaaaacagctggtccaggcttttctgtcatgcttgttaacaacagccttcatttatctctggacacgattattatgagttttaaaacttttaacccgcttctacctgcccaactgtgaccaactaaatgacagatgtgtgagaacaagaactgagggaaagcaccttcccccaccccagacgtttttatctgaatgcatacaaggagtcctgaggtggtgatttggccagtgttttaacttgtgacaagtactcaggtgtgaggacaagaatgcaaatggctcttccttgagtgaaagaaatggggagtctagagcctctttatgccaaagaaccgcagaagaaactgcattccattaaatgggaaatacagtgctatttgctaaaacttggataagagtgcgaacctctcatctctccacaacttcatgtgctgctgactaattttaaacatggccacagctggggcaaaataatccccaaagtagaaaaagtcccagtttaacaaagaatgtaatgttaaaatcacttataaggaattctttgaaaccaaatcctttgaaatctaattcctgggacttctaggtttttatagttaacatactaatttcttcaataattgttaactgcaaagttttaataaatttgtacctttaaaaaaaa

SEQ ID NO: 501 - DNA, 1522 bp, Homo sapiens
acttcgctccgcgcagccgcctggtctgcagtttgttggagctctgcgtccagcgccgctgccgctgccgccgccgccgccgccgccgccgccgccgccgccgccgccactaccaccacttgattcttgcagccaccctgcgaaccctgccacactgcgatcgcatcatcgcggtattcggttcgctgcgttcccgccgccaccgcctcggcgccctttcttggcccttgttcccccaaatgtctgactctgactctcggactgagaaacgcaagaaaaaaagaccaaatggcaaagcaaccttctgatgtaagttctgagtgtgaccgagaaggtagacaattgcagcctgcggagaggcctccccagctcagacctggggcccctacctccctacagacagagccacaagacaggagcccagcacccatgagttgtgacaaatcaacacaaaccccaagtcctccttgccaggccttcaaccactatctcagtgcaatggcttccatgaggcaggctgaacctgcagatatgcgcccagagatatggatcgcccaagagttgcggcgtattggagacgagtttaacgcttactatgcaaggagggtatttttgaataattaccaagcagccgaagaccacccacgaatggttatcttacgactgttacgttacattgtccgcctggtgtggagaatgcattgacaggttctttgcggagccgagataccatgcagacattttgcttgttcaaaccaacaagacccagcaccgcggtctcctggtgccattattatgcagccagcggttctcttgtggagggggcaggtgacgtttcagaagacaccgagctggatgggactacctttctgttcatcaccacacagcagaatttctaatggaagtttgttgtgaatgtaaaggagggagcattctttgctttttaatatacaaaccatggttttttggagcaggattttgtgtaagaatggtgtttacatgcagtgtgttttccccctcaccttcaataaggtttttcaaaaaggaaatggaaactttttaaccaatttgtgaataacttttgtattaaaattttaagaacctacggcctattctcagaggattatgtaacccctgcagtggaaactgagccagctaacttaaaaagctgccttagtttatttttagagattacagaatttttaaacagggagacgtgtgatatactccctcccttccctactattgcctctctgacctttttaaattatttttaataccaaaagagttcttttgaaatggaactgattaaaagggcagagggtctgttgccagcctgcattgatataccagtcccatttgtaaatatttacgtacctttataaattcagttgcatctgtggcaaaatttcagactatttttgcgtctttcctcatcactttttgtgatgcaactccagtctggactcagatgcatagatttggtccagtgtattttcatgataaagtgaaattgagtcag

SEQ ID NO: 502 - DNA, 722 bp, Homo sapiens
acttcgctccgcgcagccgcctggtctgcagtttgttggagctctgcgtccagcgccgctgccgctgccgccgccgccgccgccgccgccgccgccgccgccgccgccactaccaccacttgattcttgcagccaccctgcgaaccctgccacactgcgatcgcatcatcgcggtattcggttcgctgcgttcccgccgccaccgcctcggcgccctttcttggcccttgttcccccaaatgtctgactctgactctcggactgagaaacgcaagaaaaaaagaccaaatggcaaagcaaccttctgatgtaagttctgagtgtgaccgagaaggtagacaattgcagcctgcggagaggcctccccagctcagacctggggcccctacctccctacagacagagccacaagacaggagcccagcacccatgagttgtgacaaatcaacacaaaccccaagtcctccttgccaggccttcaaccactatctcagtgcaatggtagtcatcctagaggatataggtgatctttcactgtgctttggatttatatttactggcttagatttgtatggccaccaccatagtcaagatacagaacaactcaaccacaaggatttctcatgatacctttttatagccacagccacctctctccctcttccttgagcattttgtcatatggtcattggtgattaaataaaatgtattttaatattgac

SEQ ID NO: 503 - DNA, 807 bp, Homo sapiens
acttcgctccgcgcagccgcctggtctgcagtttgttggagctctgcgtccagcgccgctgccgctgccgccgccgccgccgccgccgccgccgccgccgccgccgccactaccaccacttgattcttgcagccaccctgcgaaccctgccacactgcgatcgcatcatcgcggtattcggttcgctgcgttcccgccgccaccgcctcggcgccctttcttggcccttgttcccccaaatgtctgactctgactctcggactgagaaacgcaagaaaaaaagaccaaatggcaaagcaaccttctgatgtaagttctgagtgtgaccgagaaggtagacaattgcagcctgcggagaggcctccccagctcagacctggggcccctacctccctacagacagagccacaaggtaatcctgaaggcaatcacggaggtgaaggggacagctgcccccacggcagccctcagggcccgctggccccacctgccagccctggcccttttgctaccagatccccgcttttcatctttatgagaagatcctccctgctgtctcgatcctccagtgggtatttctcttttgacacagacaggagcccagcacccatgagttgtgacaaatcaacacaaaccccaagtcctccttgccaggccttcaaccactatctcagtgcaatggcttccatgaggcaggctgaacctgcagatatgcgcccagagatatggatcgcccaagagttgcggcgtattggagacgagtttaacgcttactatgcaaggaggatgcctcttccacctgattaa

SEQ ID NO: 504 - DNA, 482 bp, Homo sapiens
gcggccggggcagcgcgggccagaggcgcggcgtgcggagccctcggctgcccggcggagcgcggcggcgggctggcgggaaggcgcgggctttgcgctgcgccggggactctgaacccgagtcccgggctttgtctcctgcgctgctttcgtggtgacggtcagggggcgcccggtcggcgaagggcgcgggccggacgccgcggggcttggtccctggcccggacgctgcgctctgaagggaaggcgcggacaaaaaaagaccaaatggcaaagcaaccttctgatgtaagttctgagtgtgaccgagaaggtagacaattgcagcctgcggagaggcctccccagctcagacctggggcccctacctccctacagacagagccacaaggtaatcctgaaggcaatcacggaggtgaaggggacagctgcccccacggcagccctcagggcccgctggccccacctgccagccctggccc

SEQ ID NO: 505 - DNA, 546 bp, Homo sapiens
acttcgctccgcgcagccgcctggtctgcagtttgttggagctctgcgtccagcgccgctgccgctgccgccgccgccgccgccgccgccgccgccgccgccgccgccactaccaccacttgattcttgcagccaccctgcgaaccctgccacactgcgatcgcatcatcgcggtattcggttcgctgcgttcccgccgccaccgcctcggcgccctttcttggcccttgttcccccaaatgtctgactctgactctcggactgagaaacgcaagaaaaaaagaccaaatggcaaagcaaccttctgatgtaagttctgagtgtgaccgagaaggtagacaattgcagcctgcggagaggcctccccagctcagacctggggcccctacctccctacagacagagccacaagcttccatgaggcaggctgaacctgcagatatgcgcccagagatatggatcgcccaagagttgcggcgtattggagacgagtttaacgcttactatgcaaggaggctggcaaaactcctggcatcctccacctga

SEQ ID NO: 506 - DNA, 3649 bp, Homo sapiens
gccgcctggtctgcagtttgttggagctctgcgtccagcgccgctgccgctgccgccgccgccgccgccgccgccgccgccgccgccgccgccactaccaccacttgattcttgcagccaccctgcgaaccctgccacactgcgatcgcatcatcgcggtattcggttcgctgcgttcccgccgccaccgcctcggcgccctttcttggcccttgttcccccaaatgtctgactctgactctcggactgagaaacgcaagaaaaaaagaccaaatggcaaagcaaccttctgatgtaagttctgagtgtgaccgagaaggtagacaattgcagcctgcggagaggcctccccagctcagacctggggcccctacctccctacagacagagccacaaggtaatcctgaaggcaatcacggaggtgaaggggacagctgcccccacggcagccctcagggcccgctggccccacctgccagccctggcccttttgctaccagatccccgcttttcatctttatgagaagatcctccctgctgtctcgatcctccagtgggtatttctcttttgacacagacaggagcccagcacccatgagttgtgacaaatcaacacaaaccccaagtcctccttgccaggccttcaaccactatctcagtgcaatggcttccatgaggcaggctgaacctgcagatatgcgcccagagatatggatcgcccaagagttgcggcgtattggagacgagtttaacgcttactatgcaaggagggtatttttgaataattaccaagcagccgaagaccacccacgaatggttatcttacgactgttacgttacattgtccgcctggtgtggagaatgcattgacaggttctttgcggagccgagataccatgcagacattttgcttgttcaaaccaacaagacccagcaccgcggtctcctggtgccattattatgcagccagcggttctcttgtggagggggcaggtgacgtttcagaagacaccgagctggatgggactacctttctgttcatcaccacacagcagaatttctaatggaagtttgttgtgaatgtaaaggagggagcattctttgctttttaatatacaaaccatggttttttggagcaggattttgtgtaagaatggtgtttacatgcagtgtgttttccccctcaccttcaataaggtttttcaaaaaggaaatggaaactttttaaccaatttgtgaataacttttgtattaaaattttaagaacctacggcctattctcagaggattatgtaacccctgcagtggaaactgagccagctaacttaaaaagctgccttagtttatttttagagattacagaatttttaaacagggagacgtgtgatatactccctcccttccctactattgcctctctgacctttttaaattatttttaataccaaaagagttcttttgaaatggaactgattaaaagggcagagggtctgttgccagcctgcattgatataccagtcccatttgtaaatatttacgtacctttataaattcagttgcatctgtggcaaaatttcagactatttttgcgtctttcctcatcactttttgtgatgcaactccagtctggactcagatgcatagatttggtccagtgtattttcatgataaagtgaaattgagtcagaacaagagttaatatctgcctgtatcttgcacagttcgagcgatctgttattaactgggaagcatttggtgttggttttcattccatttcgacgagcatgttattgggaagtattctgaagaggcaatagcagtaataacaacagacttaagtgctacgcccctttgtgctgctggcttttctggttgcaggctttcccatggtcacaggatgcactgtcagcatcaggtcccagagggccaccgtgtccattacagcagagtccagctgcagcatccagctcacgccctcatgggaattggcacaggcctggggcagggcttctgatggccatttgcttggcctcctgcattttagtccaactcacagtccactagcttcactcctttaaattcactttgaaacaggcctcatcccacttccaccagcaccatagaagaataattctgggcagaagtctgttttttttcatttttccaggacagttggatattgtcaggccacttgtgaccccagccatgtagtgagggtgctctttctctgtgcctgctccttatgagtgcagtggaaggaagccacacactggtcagtcatttcagaggcagcagatgcccagggagacccaagaaagagtcaggttagggagcagtgaaagtgaggagggaagacaattctgtgaactctgtaactcttaaaatttttgaaaactccatcgttaaacaacttttaaaagaaataactaaattttcaaatgagtaagcagtgccaccaactagtgttttgcccgatagaagagccagcatgttcacgttatttaaattaggtggaaaaatctaaacatttttatcttcataatttaaaaaatatatatgtatatattgcatattcactttttcctttaggtagagatgatttcaatccaaatactcttactttaaaaaatttcctttccccaagaatctccttgggactttgacttatttttaaagctgtgttggagctcatcttgttccctgatgtgtctcgagcccattggtagggtcatacaaagcccacggttacaagcagtggtaggattgcagccgtgggcctgctggacacacacatacaccaaagatgtatttggatctgggcaccccctcccaggatccctgtactcacgtgccagtctcctgactagagcactttactctgtttcctcagccctgcagcccctgggagcacacactgggtgcagccctgggccaggcacgggaggccctgccctgtgctgcccaggggctgtgtgcaccacatgagcacatttccctctggcctggcggcctccaggctggctgtggaaacagttcctgaggaaattagagattctatgaattgtaggagtattaaagaccaggctgttggcaccagaacttaaagcgatgactggatgtctctgtactgtatgtatctggttatcaagatgcctctgtgcagaaagtatgcctcccgtgggtatacgtttttaccttttttaaaaaacatttttgtagaaaaaataattaaatcccctttttggaaacttactgcaggttttgtgccttgacaacctctccctatgtgaggtttgtaaaaagtgtcctgtgacttaacacagaaacgcaataaacacacacaaaatagtttcatgagtgattcttcagatgcccttcccaactggttagttgatcaagaattttgggggtgggggttgcggagaaatcaagtttaaaattccttctgattaaaaaaatatagtggaatacaattgtctgccgtttccccttcttaatgtatatattgtgagtatttattagattcgtaggtcatattacttatcaactgagccaaatgtctgtgtgcaattgtgtttcctttaccttgtaaaattttgtacagcataaataagtaaaaaaatcactgtttttctcaactttttcaaaa

SEQ ID NO: 507 - DNA, 572 bp, Homo sapiens
gacgcgcgtcctccagcgactccgggaacccaaggcctccttcacctcgctcaaaattcacccgaaaatgcgctgagactttggcatggggctgcgctgtgtcccactgacgttacagaagcgcttatgaatttaaaaactgctccaggcggccggacggcgggacaacgcctcctcacttgctcctctacgaaaaaaagaccaaatggcaaagcaaccttctgatgtaagttctgagtgtgaccgagaaggtagacaattgcagcctgcggagaggcctccccagctcagacctggggcccctacctccctacagacagagccacaaggtaatcctgaaggcaatcacggaggtgaaggggacagctgcccccacggcagccctcagggcccgctggccccacctgccagccctggcccttttgctaccagatccccgcttttcatctttatgagaagatcctccctgctgtctcgatcctccagtgggtatttctcttttgacacagacaggagcccagcacccatgagttgtgacaaatcaacacaaaccccaagtcctccttgccagg

SEQ ID NO: 508 - DNA, 2030 bp, Homo sapiens
gtgagatgggcttgcctctagagacttatctttggaactttcccagtgatctgtggaccacaatgtgatttttgttttgttttgttctgatgcagcttccatgaggcaggctgaacctgcagatatgcgcccagagatatggatcgcccaagagttgcggcgtattggagacgagtttaacgcttactatgcaaggagggtaatgatgttttctttacccgcttttctgctcacaccctccccttccacactatatttttttaaaaagacagtgacttcttgtaactacatgctaattctggaaatgattactgttgcctagttgtgacctttcattgtttctcctttcccatttttcatttgttttatgactaagtaatggcacttaaataaaataatacagtaggaggcagcaaaggaattttatgagcacagactttaaaacaatgctaaaaaagggattatttatagactttgagatagtctagaaatactattaacataggtttcaatccatgtagtgtgtttctgtactccccttgtgcattttaggtcaaagttaaaggtaatttttaaacaacatcttttgtcacttagcgcatgggagcgatgccagcactcatgtaaaagactctcctgcaatttgcagggtggcccgaggaagcagggagccattgcccttgcagagcccattgctgtctttggacatttaattgttgaaatgtattaggaggccgctaatcaatagcctgtaatttgggctgtaaaaactttatattatagataattgccacttattttgagctatgttcttgattttttaaaaattttagcctatgtcatcttctgtagttagtagaagcggtgttttttgtttgttttacctgggggcaatgtaggtgaccatttggacacctttttcacatgggacacttttgtttgtttgtttgtttgtttgtgtgtgtgtttgtttttgagacggagtcttgctctgtcaccaggctgaaagattgcaccattgcactctagcctccacaagagcgaaactccatctaaaaaaaaaaatagttcaaaacactggatgatgctgtggatagtgacaccgtgatcttcaaagccacagacacccgtcttgatacttgttagattaaaaacagtccattgtctggaatcacacttaatggtccattgttaaatattgggggcagaaatctgggaaggtaatgggaggccgttttgggaaataatgaattcaaattacctgctgtcttcacaagggaattatcctctcttggcaagcgagtgtatctcactgtgctgctttaggatggatattaaccttttaaatgttgagtgtctttatttgcttaatgctattacaatgccttgtctaaagtgttagtcttttattgccacgagccttgcaaagcctgacaggatattttcccgtttttccagttagagaaatagaggaagttgtcgtgtagttgtcatgtattcagtccacttaagggcagtggggaagcgtttgagacggagctgtggaggctgaatccttgaaggaggaggtgagagaggcacaggtgagcgcaaagtcccagtgcatgtcccctcttctctcccgatgcagtgtcattcccaggtgaacctgccgggctgaacggcctggcccctctattcagtcggagttttactactccagtggattttggtaacttcatttggaaataatttcagacttacaaaaatgttgcaagaatgacacaaagaaccacccttttatatctgccccacttgttttcatgttttccctctttgcacacatgtacaatttatttcagaaaaaactacagacatgatactgcttttcctacactaaaaatacttcagtgtatatttcccaaaaataggagtaatcccttatgtaaccacagtgtaattatcaaaattcacaaatagtgttacaaaactattatctgatctatggaccttattcagattttaccacttgtcccaacaatgcccttctc

SEQ ID NO: 509 - DNA, 438 bp, Homo sapiens
atggcaaagcaaccttctgatgtaagttctgagtgtgaccgagaaggtagacaattgcagcctgcggagaggcctccccagctcagacctggggcccctacctccctacagacagagccacaagacaggagcccagcacccatgagttgtgacaaatcaacacaaaccccaagtcctccttgccaggccttcaaccactatctcagtgcaatggttagagaaatagaggaagttgtcgtgtagttgtcatgtattcagtccacttaagggcagtggggaagcgtttgagacggagctgtggaggctgaatccttgaaggaggaggtgagagaggcacaggtatttttgaataattaccaagcagccgaagaccacccacgaatggttatcttacgactgttacgttacattgtccgcctggtgtggagaatgcattga

SEQ ID NO: 510 - DNA, 883 bp, Homo sapiens
atggcaaagcaaccttctgatgtaagttctgagtgtgaccgagaaggtagacaattgcagcctgcggagaggcctccccagctcagacctggggcccctacctccctacagacagagccacaaggtaatcctgaaggcaatcacggaggtgaaggggacagctgcccccacggcagccctcagggcccgctggccccacctgccagccctggcccttttgctaccagatccccgcttttcatctttatgagaagatcctccctgctgtctcgatcctccagtgggtatttctcttttgacacagacaggagcccagcacccatgagttgtgacaaatcaacacaaaccccaagtcctccttgccaggccttcaaccactatctcagtgcaatggctaactgggactagaaacagctccatcacccagcttccatgaggcaggctgaacctgcagatatgcgcccagagatatggatcgcccaagagttgcggcgtattggagacgagtttaacgcttactatgcaaggaggatgcctcttccacctgattaagaaccactgtagcagacgcagacttattggacactaggcgggaggccagctctgcagacagcaggtctcaggaagacggtcaaggcatggctgctgatgatccgcttatgggtatttttgaataattaccaagcagccgaagaccacccacgaatggttatcttacgactgttacgttacattgtccgcctggtgtggagaatgcattgacaggttctttgcggagccgagataccatgcagacattttgcttgttcaaaccaacaagacccagcaccgcggtctcctggtgccattattatgcagccagcggttctcttgtggagggggc

SEQ ID NO: 511 - DNA, 618 bp, Homo sapiens
atggcaaagcaaccttctgatgtaagttctgagtgtgaccgagaaggtagacaattgcagcctgcggagaggcctccccagctcagacctggggcccctacctccctacagacagagccacaaggtaatcctgaaggcaatcacggaggtgaaggggacagctgcccccacggcagccctcagggcccgctggccccacctgccagccctggcccttttgctaccagatccccgcttttcatctttatgagaagatcctccctgctgtctcgatcctccagtgggtatttctcttttgacacagacaggagcccagcacccatgagttgtgacaaatcaacacaaaccccaagtcctccttgccaggccttcaaccactatctcagtgcaatggttagagaaatagaggaagttgtcgtgtagttgtcatgtattcagtccacttaagggcagtggggaagcgtttgagacggagctgtggaggctgaatccttgaaggaggaggtgagagaggcacaggtatttttgaataattaccaagcagccgaagaccacccacgaatggttatcttacgactgttacgttacattgtccgcctggtgtggagaatgcattga

SEQ ID NO: 512 - DNA, 656 bp, Homo sapiens
aagcaaccttctgatgtaagttctgagtgtgaccgagaaggtagacaattgcagcctgcggagaggcctccccagctcagacctggggcccctacctccctacagacagagccacaagacaggagcccagcacccatgagttgtgacaaatcaacacaaaccccaagtcctccttgccaggccttcaaccactatctcagtgcaatggatgactccgctggatcctccctcagaattgcccttcatagggaagttcagtggccactcaagtggttagcaaaatcaagctaactgggactagaaacagctccatcacccagtaaagagaaagaaaacatggatctgcctaggaagtcacctctgcctgagtctgctacttgcaggattggagcttttgctgcagattacagctttgaagtcactttacctcaagagcagtttatattttattgtgctttaaaaaaaaaatttagtgccaggtttatggagtgaagtgctttcataaatgctgaaactacattttctgtgggtaaaaatgcagctcatcagaatttcccctttgaagaattttttatgttcacataaaattgccaagttaaaaatttgatctccctacagagtaagagctttcatttcaaataaaaccattttataga

SEQ ID NO: 513 - DNA, 459 bp, Homo sapiens
atggcaaagcaaccttctgatgtaagttctgagtgtgaccgagaaggtagacaattgcagcctgcggagaggcctccccagctcagacctggggcccctacctccctacagacagagccacaagcttccatgaggcaggctgaacctgcagatatgcgcccagagatatggatcgcccaagagttgcggcgtattggagacgagtttaacgcttactatgcaaggaggatgcctcttccacctgattaagaaccactgtagcagacgcagacttattggacactaggcgggaggccagctctgcagacagcaggtctcaggaagacggtcaaggcatggctgctgatgatccgcttatgggtatttttgaataattaccaagcagccgaagaccacccacgaatggttatcttacgactgttacgttacattgtccgcctggtgtggagaatgcattga

SEQ ID NO: 514 - DNA, 3605 bp, Homo sapiens
atcacccggcgccgggccctccctctgcccccccctttctcctccctccttccttccctcccttcctccctctctccctccctcccagctcctgcaccaggaaacggcccggatcccggcagcggcctgacccggctccacgctggccaggaggatgaaaggccccagctgggggctccttgccaccagtgctgtgtcttaagagctgccatcccggctggccgcccggatggcgaccccagcctcggccccagacacacgggctctggtggcagactttgtaggttataagctgaggcagaagggttatgtctgtggagctggccccggggagggcccagcagctgacccgctgcaccaagccatgcgggcagctggagatgagttcgagacccgcttccggcgcaccttctctgatctggcggctcagctgcatgtgaccccaggctcagcccaacaacgcttcacccaggtctccgatgaactttttcaagggggccccaactggggccgccttgtagccttctttgtctttggggctgcactgtgtgctgagagtgtcaacaaggagatggaaccactggtgggacaagtgcaggagtggatggtggcctacctggagacgcagctggctgactggatccacagcagtgggggctgggcggagttcacagctctatacggggacggggccctggaggaggcgcggcgtctgcgggaggggaactgggcatcagtgaggacagtgctgacgggggccgtggcactgggggccctggtaactgtaggggccttttttgctagcaagtgaaagtccagggccaggtggggctaggtgtggctgggggccaggagagcaggaacagaacagagaaatgcccttggaagaagtggagttggtggatgggtgggcatggaacaggatgggcagagaaagggtagtgtgtgagggagctgagtaggccaggtaggcgattggaagagtgagcaggacacagaggggaggggaatgttttggcaagtttaggggcacaggagatgtagtcgttccagggctgggggaggtgggagggatcacgcctataggtgtgggcacatgaaacgacctggaacttgcttcacagccctgaggaaggtggacttacataagcagctgtattccattagatgagtgggatttagggaacgcagaaggcacatccctttggaatggaagcttaggggttctcaggtgatagggagaggtggctgttaacagtgggctgcttggacacgcgtgtgcatgtgcacgcatgctggtgtgcatgctgggctgcctggcaaatctggtggtgatgggattcctcaaggagaaaacattccctcttgcaatggcaagaactaggggcagttctctgtccctcctcccaacccctcctttcccctgcccttgtcctgatgcctcaaggcttagagagaaacattgtatccagaccgagggctctgctgcttctttccagaaagtgattggcaaggctttggagagaagagcagttctgcagctggccttgttccttcatcatcccccttccttgtgcattatgcacttgctgctgcctcctgggctctgatagaagggcagggctgttgagcctggatgggtggaggcttaggtagccggacctgcctgccaccctcctctcccactcaggcacaatggtgcctaaagtgtttccaatctctgggacctctgtacccaaactgaaactctaaattggggccctaactaattttccttttgaggttgtgggcataagtgctgatctagaatacagtctgggtcccacactgtgtctcagtgagactgttgatgccttgagatgaccatttcagatctgaatcccatgggtgtgagggtgatgggtactccaggactggcctatgctgtgttgtgggctttggttcggctttatcaggggccaggcatatgggttctagagtacctaccatgacctagaagcatttatgatttatttgaagccacactgtttgcatgggtgttacttgtctgtacctcagagtctgaggatgttaactttggaactcgcagtcctctagaacagcttcagattatggctttttcttttgaggaagaaattattcactccagatgcatgccctgagccagacctcactgctgcactttccaaggtgctaagattgctgctctccaatgctaactttctgacacagtgctctagaaccctgcctgtggtcctgagcactgatcaccttagctagaccatggttgactcttcttggagattttcacttggtcctagaatgtggcaacgtagttgtgctcgccagaacgtgggaccaaattggcctcaggtgttgagtccagacttctgcttttgagagagggctgcactttttcatggtatttctaggggaggtggtaggctgcatgtgccacttggtcttgttgtgagtatgctgacaccagaaactcagagccagcttgtggcaagcagttggggtggggggtctctgacttgctcaggacaaactaggccagtggttttcaaactgcttggcagagccctgaagtttcctaggggttgcctcaggagtccttggggagatgaagggggtggggagctgagcaggctgggcaatttgccctcaaacagaacagctccccttgtagctgtcttacatattggggttcagggtaagattttatttgcattaaggggtttgctgctgaaaaaaagttggaaaaccactgactagaccatcggctccaaattggagtctgtgcttccttccccaggtatggagcacactcttcaccctaccctctaccacaggacacatatccctgttagcattccccgggacctttagccaagaggagctgcagggaccatggccaggttaccaaaatgccctgctctgaagccttgacacctgggtggaaagagaggctgttttctgaaagggtaaagggcttggtctggattcccagaagcatagcttagatgggaccacagtgggcaattttgacctgtcctgcccttcttagcttgaagggaaaccccagagactcttctgtcagggaaaactagggactctcttctagagccatatagttccttgggattagctcttggccaagaaggctgagtatggttcccaatttttaaatccatttcattttttaaaaaataagggaaataaatgtaattgccatttttcaaagattaagtaggaggagaggggtttcttgctctccagagcccaaagggacaaatagggactttgtttaggccaaggaaggagcggaagtagggcaactcggtcctgcgattattaatcccactccccacttattctagggcacacaaacactattttacttttttaaaatcataaaacggcagaacagatttggttagtttagaagaaaagaaagctctataaatataaatctatattcctgtatttttatttaataatttataaataccaagttcatttgacttttatttttgtgtaatatgtaatgatcgtattaaaaacaataaataaagcccagaagtttaatgagaaggactgaa

SEQ ID NO: 515 - DNA, 548 bp, Homo sapiens
gatccacatggtacatgacattcttcctgttttcttcacaagacaaggatgatgtttaaatgggcatttgtttgcggaatgacttggagagttcctctctttcagccatcttttctcaaagactaaggctgtggacaggatgggcatgaagactgtcaaggagcccgagtgagggaagcagaccaaccatggtcttggagaaaagaaaatagggtttccatcccttctggagggagaaggaatagcagagatgaacatgaatgaagaaggaaacaaatggaaataaacaaaatgaagggctccacgctggccaggaggatgaaaggccccagctgggggctccttgccaccagtgctgtgtcttaagagctgccatcccggctggccgcccggatggcgaccccagcctcggccccagacacacgggctctggtggcagactttgtaggttataagctgaggcagaagggttatgtctgtggagctggccccggggagggcccagcagctgacccgctgcaccaagccatgcgggcagctggagatga

SEQ ID NO: 516 - DNA, 545 bp, Homo sapiens
agctgggcctttgggctgcactagggggaaccgggaatagagatggtgtcggcaggaagcccttggccttgggtttcccgggaggacagtcattaaacatggattcggccacacagctggtagagcgttgggggcaggggcctaggcccagagctgcaaccctagcccttcccaggccagaacctgatccctggccttcccctcctggttctgatctccccctcccctttccagggctccacgctggccaggaggatgaaaggccccagctgggggctccttgccaccagtgctgtgtcttaagagctgccatcccggctggccgcccggatggcgaccccagcctcggccccagacacacgggctctggtggcagactttgtaggttataagctgaggcagaagggttatgtctgtggagctggccccggggagggcccagcagctgacccgctgcaccaagccatgcgggcagctggagatgagttcgagacccgcttccggcgcaccttctctgatctggcggctcagctgcatgtgacccc

SEQ ID NO: 517 - DNA, 631 bp, Homo sapiens
aggaaacggcccggatcccggcagcggcctgacccgtgagatccctaacctggcaggcgggcggggttggagactggctgaggtggggggctccacgctggccaggaggatgaaaggccccagctgggggctccttgccaccagtgctgtgtcttaagagctgccatcccggctggccgcccggatggcgaccccagcctcggccccagacacacgggctctggtggcagactttgtaggttataagctgaggcagaagggttatgtctgtggagctggccccggggagggcccagcagctgacccgctgcaccaagccatgcgggcagctggagatgagttcgagacccgcttccggcgcaccttctctgatctggcggctcagctgcatgtgaccccaggctcagcccaacaacgcttcacccaggtctccgatgaactttttcaagggggccccaactggggccgccttgtagccttctttgtctttggggctgcactgtgtgctgagagtgtcaacaaggagatggaaccactggtgggacaagtgcaggagtggatggtggcctacctggagacgcagctggctgactggatccacagcagtgggggctgggcggagttcacagct

SEQ ID NO: 518 - DNA, 596 bp, Homo sapiens
atcccggcagcggcctgacccgtgagatccctaacctggcaggcgggcggggttggagactggctgagggctccacgctggccaggaggatgaaaggccccagctgggggctccttgccaccagtgctgtgtcttaagagctgccatcccggctggccgcccggatggcgaccccagcctcggccccagacacacgggctctggtggcagactttgtaggttataagctgaggcagaagggttatgtctgtggagctggccccggggagggcccagcagctgacccgctgcaccaagccatgcgggcagctggagatgagttcgagacccgcttccggcgcaccttctctgatctggcggctcagctgcatgtgaccccaggctcagcccaacaacgcttcacccaggtctccgatgaactttttcaagggggccccaactggggccgccttgtagccttctttgtctttggggctgcactgtgtgctgagagtgtcaacaaggagatggaaccactggtgggacaagtgcaggagtggatggtggcctacctggagacgcagctggctgactggatccacagcagtgggggctgg

SEQ ID NO: 519 - DNA, 1033 bp, Homo sapiens
gcaatctacaaggattctaatttctccacatcctgcatttaagacttgcaaagctgaattaatcacaggatgaggaagtggcttctctgaaacattttcctctttcacattttaaactttctctttcatacatgacatgaaacacagcctacgcacgaaagtgactaggaggaaggatattataaagtgatgcaaacagaaattccaccagcctccatgtatcatcatgtgtcataactcagtcaagctcagtgagcattctcagcacattgcctcaacagcttcaaggtgagccagctcaagactttgctctccaccaggcagaagatgacagactgtgaatttggatatatttacaggctggctcaggactatctgcagtgcgtcctacagataccacaacctggatcaggtccaagcaaaacgtccagagtgctacaaaatgttgcgttctcagtccaaaaagaagtggaaaagaatctgaagtcatgcttggacaatgttaatgttgtgtccgtagacactgccagaacactattcaaccaagtgatggaaaaggagtttgaagacggcatcattaactggggaagaattgtaaccatatttgcatttgaaggtattctcatcaagaaacttctacgacagcaaattgccccggatgtggatacctataaggagatttcatattttgttgcggagttcataatgaataacacaggagaatggataaggcaaaacggaggctgggaaaatggctttgtaaagaagtttgaacctaaatctggctggatgacttttctagaagttacaggaaagatctgtgaaatgctatctctcctgaagcaatactgttgaccagaaaggacactccatattgtgaaaccggcctaatttttctgactgatatggaaacgattgccaacacatacttctacttttaaataaacaactttgatgatgtaacttgaccttccagagttatggaaattttgtccccatgtaatgaataaattgtatgtatttttctctatat

SEQ ID NO: 520 - DNA, 809 bp, Homo sapiens
acagcttcaaggtgagccagctcaagactttgctctccaccaggcagaagatgacagactgtgaatttggatatatttacaggctggctcaggactatctgcagtgcgtcctacagataccacaacctggatcaggtccaagcaaaacgtccagagtgctacaaaatgttgcgttctcagtccaaaaagaagtggaaaagaatctgaagtcatgcttggacaatgttaatgttgtgtccgtagacactgccagaacactattcaaccaagtgatggaaaaggagtttgaagacggcatcattaactggggaagaattgtaaccatatttgcatttgaaggtattctcatcaagaaacttctacgacagcaaattgccccggatgtggatacctataaggagatttcatattttgttgcggagttcataatgaataacacaggagaatggataaggcaaaacggaggctgggggaaatggcacaatcacacacctatgctggtagagtcagtggcccacaagaagaggaaaatggctttgtaaagaagtttgaacctaaatctggctggatgacttttctagaagttacaggaaagatctgtgaaatgctatctctcctgaagcaatactgttgaccagaaaggacactccatattgtgaaaccggcctaatttttctgactgatatggaaacgattgccaacacatacttctacttttaaataaacaactttgatgatgtaacttgaccttccagagttatggaaattttgtccccatgtaatgaataaattgtatgtatttttctcta

SEQ ID NO: 521 - DNA, 2493 bp, Homo sapiens
gagaaaacccgcgggcctggccgggtgcaggccacccttgccggcggatcggaatccccgcccacaccgtggtctttccagcaccgcagacacctgccggctcctcccgagcggagctcagggctgacaaagcgcggtcagagcggccgcttactggggctcgcccgctccttagagcactggcaatgatgtgcggatcctcgctgctgctgctgggaaactgttgagtggctgaatgaccccaggggaccctgggagagctctgaagccctcagccaccaagtggctgggctggcaagggttcattcattcattcaacaaatacgaatgtgcagcggtgctggggtcatgatggctcggtgggcagcgaggggccgggccggctggaggagcacagtgcggattctgtcgccactgggacactgtgaaccaggagtgagtcggagctgccgcgctgcccaggccatggactgtgaggtcaacaacggttccagcctcagggatgagtgcatcacaaacctactggtgtttggcttcctccaaagctgttctgacaacagcttccgcagagagctggacgcactgggccacgagctgccagtgctggctccccagtgggagggctacgatgagctgcagactgatggcaaccgcagcagccactcccgcttgggaagaatagaggcagattctgaaagtcaagaagacatcatccggaatattgccaggcacctcgcccaggtcggggacagcatggaccgtagcatccctccgggcctggtgaacggcctggccctgcagctcaggaacaccagccggtcggaggaggaccggaacagggacctggccactgccctggagcagctgctgcaggcctaccctagagacatggagaaggagaagaccatgctggtgctggccctgctgctggccaagaaggtggccagtcacacgccgtccttgctccgtgatgtctttcacacaacagtgaattttattaaccagaacctacgcacctacgtgaggagcttagccagaaatgggatggactgaacggacagttccagaagtgtgactggctaaagctcgatgtggtcacagctgtatagctgcttccagtgtagacggagccctggcatgtcaacagcgttcctagagaagacaggctggaagatagctgtgacttctattttaaagacaatgttaaacttataacccactttaaaatatctacattaatatacttgaatgaaaatgtccatttacacgtatttgaatggccttcatatcatccacacatgaatctgcacatctgtaaatctacacacggtgcctttatttccactgtgcaggttcccacttaaaaattaaattggaaagcaggtttcaaggaagtagaaacaaaatacaatttttttggtaaaaaaaaattactgtttattaaagtacaaccatagaggatggtcttacagcaggcagtatcctgtttgaggaaagcaagaatcagagaaggaacataccccttacaaatgaaaaattccactcaaaatagggactatctatcttaatactaaggaaccaacaatcttcctgtttaaaaaaccacatggcacagagattctgaactaaagtgctgcactcaaatgatgggaagtccggccccagtacacaggggcttgactttttcaacttcgtttcctttgttggagtcaaaaagaaccacttgtggttctaaaaggtgtgaaggtgatttaagggcccaggtcagccactgtttgtttacaaaatcaggtaactaactgcatacactttttctctttccatgacatcaagactttgctaaagacatgaagccacgggtgccagaagctactgcgatgccccgggagttagccccctggtaatagctgtaaacttccaatttctagccatacgctcagctcatccatgcctcagaagtgcatctggagagaacaggtttctaagcataaaagatgaaagagcagttggactttttaaaaattcagcaaagtggttccctctcttagggacagtcaaaaccaagtcacttaggtagtaccaaaataaataaggaaaagcttagctttagaaacagtgcaacactggtctgctgttccagtggtaagctatgtcccaggaatcagtttaaaagcacgacagtggatgctgggtccatatcacacacattgctgtgaacaggaaactcctgtgaccacaacatgaggccactggagacgcatatgagtaagggcactgacggactcatgatttcttcttaccagatgctttcctgttctttaagagtttaaaatcatcagaaaggaaaaacaaactctatattgttcagcatgcaatacataccacgctagggctggctcaattgaaagtgggcaaaagcttacaaatactaaaaagaagtgctgccgcgcagtgtggaggccactgtttggaaataaatcttcctaacactac

SEQ ID NO: 522 - DNA, 854 bp, Homo sapiens
ggacgcgcccgcgcccccgcggctggagggtggtcgccactgggacactgtgaaccaggagtgagtcggagctgccgcgctgcccaggccatggactgtgaggtcaacaacggttccagcctcagggatgagtgcatcacaaacctactggtgtttggcttcctccaaagctgttctgacaacagcttccgcagagagctggacgcactgggccacgagctgccagtgctggctccccagtgggagggctacgatgagctgcagactgatggcaaccgcagcagccactcccgcttgggaagaatagaggcaggggcgtcagacaataacacagcaagtgctgaggaagaaacggaggcggcagggagcgtggcagttgagcgtggccttcatggagctgcgacagtgattctgaaagtcaagaagacatcatccggaatattgccaggcacctcgcccaggtcggggacagcatggaccgtagcatccctccgggcctggtgaacggcctggccctgcagctcaggaacaccagccggtcggaggaggaccggaacagggacctggccactgccctggagcagctgctgcaggcctaccctagagacatggagaaggagaagaccatgctggtgctggccctgctgctggccaagaaggtggccagtcacacgccgtccttgctccgtgatgtctttcacacaacagtgaattttattaaccagaacctacgcacctacgtgaggagcttagccagaaatgggatggactgaacggacagttccagaagtgtgactggctaaagctcgatgtggtcacagctgtatagctgcttccagtgtagacggagccct

SEQ ID NO: 523 - DNA, 1879 bp, Homo sapiens
ggaagcgcgcggggcgccataaggaggaagcgggtagtcgaccgtgtccgcgcgcctgggagacgctgcctcggcccggacgcgcccgcgcccccgcggctggagggtgattctgaaagtcaagaagacatcatccggaatattgccaggcacctcgcccaggtcggggacagcatggaccgtagcatccctccgggcctggtgaacggcctggccctgcagctcaggaacaccagccggtcggaggaggaccggaacagggacctggccactgccctggagcagctgctgcaggcctaccctagagacatggagaaggagaagaccatgctggtgctggccctgctgctggccaagaaggtggccagtcacacgccgtccttgctccgtgatgtctttcacacaacagtgaattttattaaccagaacctacgcacctacgtgaggagcttagccagaaatgggatggactgaacggacagttccagaagtgtgactggctaaagctcgatgtggtcacagctgtatagctgcttccagtgtagacggagccctggcatgtcaacagcgttcctagagaagacaggctggaagatagctgtgacttctattttaaagacaatgttaaacttataacccactttaaaatatctacattaatatacttgaatgaaaatgtccatttacacgtatttgaatggccttcatatcatccacacatgaatctgcacatctgtaaatctacacacggtgcctttatttccactgtgcaggttcccacttaaaaattaaattggaaagcaggtttcaaggaagtagaaacaaaatacaatttttttggtaaaaaaaaattactgtttattaaagtacaaccatagaggatggtcttacagcaggcagtatcctgtttgaggaaagcaagaatcagagaaggaacataccccttacaaatgaaaaattccactcaaaatagggactatctatcttaatactaaggaaccaacaatcttcctgtttaaaaaaccacatggcacagagattctgaactaaagtgctgcactcaaatgatgggaagtccggccccagtacacaggggcttgactttttcaacttcgtttcctttgttggagtcaaaaagaaccacttgtggttctaaaaggtgtgaaggtgatttaagggcccaggtcagccactgtttgtttacaaaatcaggtaactaactgcatacactttttctctttccatgacatcaagactttgctaaagacatgaagccacgggtgccagaagctactgcgatgccccgggagttagccccctggtaatagctgtaaacttccaatttctagccatacgctcagctcatccatgcctcagaagtgcatctggagagaacaggtttctaagcataaaagatgaaagagcagttggactttttaaaaattcagcaaagtggttccctctcttagggacagtcaaaaccaagtcacttaggtagtaccaaaataaataaggaaaagcttagctttagaaacagtgcaacactggtctgctgttccagtggtaagctatgtcccaggaatcagtttaaaagcacgacagtggatgctgggtccatatcacacacattgctgtgaacaggaaactcctgtgaccacaacatgaggccactggagacgcatatgagtaagggcactgacggactcatgatttcttcttaccagatgctttcctgttctttaagagtttaaaatcatcagaaaggaaaaacaaactctatattgttcagcatgcaatacataccacgctagggctggctcaattgaaagtgggcaaaagcttacaaatactaaaaagaagtgctgccgcgcagtgtgga

SEQ ID NO: 524 - DNA, 2126 bp, Homo sapiens
ggaggaagcgcgcggggcgccataaggaggaagcgggtagtcgaccgtgtccgcgcgcctgggagacgctgcctcggcccggacgcgcccgcgcccccgcggctggagggtggtcaacaacggttccagcctcagggatgagtgcatcacaaacctactggtgtttggcttcctccaaagctgttctgacaacagcttccgcagagagctggacgcactgggccacgagctgccagtgctggctccccagtgggagggctacgatgagctgcagactgatggcaaccgcagcagccactcccgcttgggaagaatagaggcagattctgaaagtcaagaagacatcatccggaatattgccaggcacctcgcccaggtcggggacagcatggaccgtagcatccctccgggcctggtgaacggcctggccctgcagctcaggaacaccagccggtcggaggaggaccggaacagggacctggccactgccctggagcagctgctgcaggcctaccctagagacatggagaaggagaagaccatgctggtgctggccctgctgctggccaagaaggtggccagtcacacgccgtccttgctccgtgatgtctttcacacaacagtgaattttattaaccagaacctacgcacctacgtgaggagcttagccagaaatgggatggactgaacggacagttccagaagtgtgactggctaaagctcgatgtggtcacagctgtatagctgcttccagtgtagacggagccctggcatgtcaacagcgttcctagagaagacaggctggaagatagctgtgacttctattttaaagacaatgttaaacttataacccactttaaaatatctacattaatatacttgaatgaaaatgtccatttacacgtatttgaatggccttcatatcatccacacatgaatctgcacatctgtaaatctacacacggtgcctttatttccactgtgcaggttcccacttaaaaattaaattggaaagcaggtttcaaggaagtagaaacaaaatacaatttttttggtaaaaaaaaattactgtttattaaagtacaaccatagaggatggtcttacagcaggcagtatcctgtttgaggaaagcaagaatcagagaaggaacataccccttacaaatgaaaaattccactcaaaatagggactatctatcttaatactaaggaaccaacaatcttcctgtttaaaaaaccacatggcacagagattctgaactaaagtgctgcactcaaatgatgggaagtccggccccagtacacaggggcttgactttttcaacttcgtttcctttgttggagtcaaaaagaaccacttgtggttctaaaaggtgtgaaggtgatttaagggcccaggtcagccactgtttgtttacaaaatcaggtaactaactgcatacactttttctctttccatgacatcaagactttgctaaagacatgaagccacgggtgccagaagctactgcgatgccccgggagttagccccctggtaatagctgtaaacttccaatttctagccatacgctcagctcatccatgcctcagaagtgcatctggagagaacaggtttctaagcataaaagatgaaagagcagttggactttttaaaaattcagcaaagtggttccctctcttagggacagtcaaaaccaagtcacttaggtagtaccaaaataaataaggaaaagcttagctttagaaacagtgcaacactggtctgctgttccagtggtaagctatgtcccaggaatcagtttaaaagcacgacagtggatgctgggtccatatcacacacattgctgtgaacaggaaactcctgtgaccacaacatgaggccactggagacgcatatgagtaagggcactgacggactcatgatttcttcttaccagatgctttcctgttctttaagagtttaaaatcatcagaaaggaaaaacaaactctatattgttcagcatgcaatacataccacgctagggctggctcaattgaaagtgggcaaaagcttacaaatactaaaaagaagtgctgccgcgcagtgtggaggccactgtttggaaataaatcttcctaacact

SEQ ID NO: 525 - DNA, 2167 bp, Homo sapiens
ggaggaagcgcgcggggcgccataaggaggaagcgggtagtcgaccgtgtccgcgcgcctgggagacgctgcctcggcccggacgcgcccgcgcccccgcggctggagggtggtcgccactgggacactgtgaaccaggagtgagtcggagctgccgcgctgcccaggccatggactgtgaggtcaacaacggttccagcctcagggatgagtgcatcacaaacctactggtgtttggcttcctccaaagctgttctgacaacagcttccgcagagagctggacgcactgggccacgagctgccagtgctggctccccagtgggagggctacgatgagctgcagactgatggcaaccgcagcagccactcccgcttgggaagaatagaggcagattctgaaagtcaagaagacatcatccggaatattgccaggcacctcgcccaggtcggggacagcatggaccgtagcatccctccgggcctggtgaacggcctggccctgcagctcaggaacaccagccggtcggaggaggaccggaacagggacctggccactgccctggagcagctgctgcaggcctaccctagagacatggagaaggagaagaccatgctggtgctggccctgctgctggccaagaaggtggccagtcacacgccgtccttgctccgtgatgtctttcacacaacagtgaattttattaaccagaacctacgcacctacgtgaggagcttagccagaaatgggatggactgaacggacagttccagaagtgtgactggctaaagctcgatgtggtcacagctgtatagctgcttccagtgtagacggagccctggcatgtcaacagcgttcctagagaagacaggctggaagatagctgtgacttctattttaaagacaatgttaaacttataacccactttaaaatatctacattaatatacttgaatgaaaatgtccatttacacgtatttgaatggccttcatatcatccacacatgaatctgcacatctgtaaatctacacacggtgcctttatttccactgtgcaggttcccacttaaaaattaaattggaaagcaggtttcaaggaagtagaaacaaaatacaatttttttggtaaaaaaaaattactgtttattaaagtacaaccatagaggatggtcttacagcaggcagtatcctgtttgaggaaagcaagaatcagagaaggaacataccccttacaaatgaaaaattccactcaaaatagggactatctatcttaatactaaggaaccaacaatcttcctgtttaaaaaaccacatggcacagagattctgaactaaagtgctgcactcaaatgatgggaagtccggccccagtacacaggggcttgactttttcaacttcgtttcctttgttggagtcaaaaagaaccacttgtggttctaaaaggtgtgaaggtgatttaagggcccaggtcagccactgtttgtttacaaaatcaggtaactaactgcatacactttttctctttccatgacatcaagactttgctaaagacatgaagccacgggtgccagaagctactgcgatgccccgggagttagccccctggtaatagctgtaaacttccaatttctagccatacgctcagctcatccatgcctcagaagtgcatctggagagaacaggtttctaagcataaaagatgaaagagcagttggactttttaaaaattcagcaaagtggttccctctcttagggacagtcaaaaccaagtcacttaggtagtaccaaaataaataaggaaaagcttagctttagaaacagtgcaacactggtctgctgttccagtggtaagctatgtcccaggaatcagtttaaaagcacgacagtggatgctgggtccatatcacacacattgctgtgaacaggaaactcctgtgaccacaacatgaggccactggagacgcatatgagtaagggcactgacggactcatgatttcttcttaccagatgctttcctgttctttaagagtttaaaatcatcagaaaggaaaaacaaactctatattgttcagcatgcaatacataccacgctagggctggctcaattgaaagtgggcaaaagcttacaaatactaaaaagaagtgctgccgcgcagtgtggaggcc

SEQ ID NO: 526 - DNA, 700 bp, Homo sapiens
cactgtctgaaacagtcgcgtaaggggtcgccactgggacactgtgaaccaggagtgagtcggagctgccgcgctgcccaggccatggactgtgaggtcaacaacggttccagcctcagggatgagtgcatcacaaacctactggtgtttggcttcctccaaagctgttctgacaacagcttccgcagagagctggacgcactgggccacgagctgccagtgctggctccccagtgggagggctacgatgagctgcagactgatggcaaccgcagcagccactcccgcttgggaagaatagaggcagattctgaaagtcaagaagacatcatccggaatattgccaggcacctcgcccaggtcggggacagcatggaccgtagcatccctccgggcctggtgaacggcctggccctgcagctcaggaacaccagccggtcggaggaggaccggaacagggacctggccactgccctggagcagctgctgcaggcctaccctagagacatggagaaggagaagaccatgctggtgctggccctgctgctggccaagaaggtggccagtcacacgccgtccttgctccgtgatgtctttcacacaacagtgaattttattaaccagaacctacgcacctacgtgaggagcttagccagaaatgggatggactgaacggacagttccagaagtgtgactggct

SEQ ID NO: 527 - DNA, 3039 bp, Homo sapiens
gtggccgctctaggcagcggggaggtcgcggggttgaggggggttgtgaaaggagagcggcctctcctctatggtcacggggccggggcacgcttcccccactctgtcttgttacttccggtagcgaagcctctccctcttcctctgctcccgcggggtctgtgctgagaataatggcccggttggcccgggacgagtggaatgattaatgatgttttgcagcagttttctacgtctgaaattttttatgtctctggaacccagaatttgctaagagatggaggaacctcagaaaagctatgtgaacacaatggaccttgagagagatgaacctctcaaaagcaccggccctcagatttctgttagtgaattttcttgccactgctgctacgacatcctggttaaccccaccaccttgaactgtgggcacagcttctgccgtcactgccttgctttatggtgggcatcttcaaagaaaacagaatgtccagaatgcagagaaaaatgggaaggtttccccaaagtcagtattctcctcagggatgccattgaaaagttatttcctgatgccattagactgagatttgaagacattcagcagaataatgacatagtccaaagtcttgcagcctttcagaaatatgggaatgatcagattcctttagctcctaacacaggccgagcgaatcagcagatgggagggggattcttttccggtgtgctcacagctttaactggagtggcagtggtcctgctcgtctatcactggagcagcagggaatctgaacacgacctcctggtccacaaggctgtggccaaatggacggcggaagaagttgtcctctggctggagcagctgggcccttgggcatctctttacagggaaaggtttttatctgaacgagtaaatggaaggttgcttttaactttgacagaggaagaattttccaagacgccctataccatagaaaacagcagccacaggagagccatcctcatggagctagaacgtgtcaaagcattaggcgtgaagcccccccagaatctctgggaatataaggctgtgaacccaggcaggtccctgttcctgctatacgccctcaagagctcccccaggctgagtctgctctacctgtacctgtttgactacaccgacaccttcctacctttcatccacaccatctgccctctgcaagaagacagctctggggaggacatcgtcaccaagcttctggatcttaaggagcctacgtggaagcagtggagagagttcctggtcaaatactccttccttccataccagctgattgctgagtttgcttgggactggttggaggtccattactggacatcacggtttctcatcatcaatgctatgttactctcagttctggaattattctccttttggagaatctggtcgagaagtgaactgaagaccgtgcctcagaggatgtggagccatttctggaaagtatcaacgcaggggctttttgtggccatgttctggcccctcatccctcagtttgtttgcaactgtttgttttactgggccctgtactttaacccaattattaacattgatcttgtggtcaaggaactccggcggctggaaacccaggtgttgtgactggcactgcccaggctgagactcttcaagtcccgctgacgtctgagctttgatgcttaagaggggtgaggcagggagcggacttcctattttctaccctcagtaaaacaaggtgctgctttgtatatcaaaagctccaaccatgtcctctccccctcagcctgtgggtggcacgagcaaggactgacatccgcacagggaggattgtctgtttggctgacacagcagcagcccttcccacccagccaccttcctcacagggactaggaggctcagtccccaacggctggcaagactcagggtcctcagtggacatggtgtgggtgacatcagaagggtgccacatcagtcccctccccaacctcagtgactgacagaggatccggatctcagagcctgagaccaggtttattggggcctggcctgtcctctaagtcaagtttaggaaaacaaggataagattctgtcataggcatagagagttgcacataaaaaataccgaagaaaacccaaaattcaatcaacaattctgtcttattgaagagttgctaggattcagagtaaaactcaaaggattcagtttgagcctagaatgatggttagacttgtagtcactgggcttttgttttgctttatggaaatcattgaaggtctggatccctttctctgaatggagagattgagagggatgtcgggcagttcccattagatttagtggccttcatgttattcagaattgttttggtgatacctcacccctgtaatcccagcactttgggtgggtgaggcaggcggatcacttgaagccaggacttcaagaccagcttggccaacatggtgaaacctcatctctactaaaaatacaaaaattagccaagtgtgatggcacatacctgtaatcccagctacttggaattggaaatcgcctgaacccaggaggcggaggttgcagggagggagactgcaccactgcacttcagcctgggtgacagagggagactctgtcttaaaaaaaaaaaaaaaatcatctgtaaaataaattccgggatagtcgttttgttcaaggaaatgttttgtaaattgagctcacactatataatctttattgtcctatcctgatgtataatacagcaggtataattacaccaagcgctatagttataaatatggcatgaagtgaactatggccttttatttccttccagtgtgaacacagcaggtgtgagatgtcatcttggaagacaggccttgcagaaataggcctacatccaaaatattatcttgtgactccatgaaccattcattaaccctttgtatctttgagtgaaaattttactcaaaagttgcatctggaagttcgaagaaattacttgaaataaaaataaagatttctatatagataaaaccta

SEQ ID NO: 528 - DNA, 1448 bp, Homo sapiens
gcagcagttttctacgtctgaaattttttatgtctctggaacccagaatttgctaagagatggaggaacctcagaaaagctatgtgaacacaatggaccttgagagagatgaacctctcaaaagcaccggccctcagatttctgttagtgaattttcttgccactgctgctacgacatcctggttaaccccaccaccttgaactgtgggcacagcttctgccgtcactgccttgctttatggtgggcatcttcaaagaaaacagaatgtccagaatgcagagaaaaatgggaaggtttccccaaagtcagtattctcctcaggtggtcctgctcgtctatcactggagcagcagggaatctgaacacgacctcctggtccacaaggctgtggccaaatggacggcggaagaagttgtcctctggctggagcagctgggcccttgggcatctctttacagggaaaggtttttatctgaacgagtaaatggaaggttgcttttaactttgacagaggaagaattttccaagacgccctataccatagaaaacagcagccacaggagagccatcctcatggagctagaacgtgtcaaagcattaggcgtgaagcccccccagaatctctgggaatataaggctgtgaacccaggcaggtccctgttcctgctatacgccctcaagagctcccccaggctgagtctgctctacctgtacctgtttgactacaccgacaccttcctacctttcatccacaccatctgccctctgcaagaagacagctctggggaggacatcgtcaccaagcttctggatcttaaggagcctacgtggaagcagtggagagagttcctggtcaaatactccttccttccataccagctgattgctgagtttgcttgggactggttggaggtccattactggacatcacggtttctcatcatcaatgctatgttactctcagttctggaattattctccttttggagaatctggtcgagaagtgaactgaagaccgtgcctcagaggatgtggagccatttctggaaagtatcaacgcaggggctttttgtggccatgttctggcccctcatccctcagtttgtttgcaactgtttgttttactgggccctgtactttaacccaattattaacattgatcttgtggtcaaggaactccggcggctggaaacccaggtgttgtgactggcactgcccaggctgagactcttcaagtcccgctgacgtctgagctttgatgcttaagaggggtgaggcagggagcggacttcctattttctaccctcagtaaaacaaggtgctgctttgtatatcaaaagctccaaccatgtcctctccccctcagcctgtgggtggcacgagcaaggactgacatccgcacagggaggattgtctgtttggctgacacagcagcagcccttcccac

SEQ ID NO: 529 - DNA, 4555 bp, Homo sapiens
aatcggaataggcaagcttccggcgggaagtgagccagggcttggcgcggcggccgtggttgcggcgcgggaagtttggatcctggttccgtccgctaggagtctgcgtgcgaggattatggctgctgttcctcaaaataatctacaggagcaactagaacgtcactcagccagaacacttaataataaattaagtctttcaaaaccaaaattttcaggtttcacttttaaaaagaaaacatcttcagataacaatgtatctgtaactaatgtgtcagtagcaaaaacacctgtattaagaaataaagatgttaatgttaccgaagacttttccttcagtgaacctctacccaacaccacaaatcagcaaagggtcaaggacttctttaaaaatgctccagcaggacaggaaacacagagaggtggatcaaaatcattattgccagatttcttgcagactccgaaggaagttgtatgcactacccaaaacacaccaactgtaaagaaatcccgggatactgctctcaagaaattagaatttagttcttcaccagattctttaagtaccatcaatgattgggatgatatggatgactttgatacttctgagacttcaaaatcatttgttacaccaccccaaagtcactttgtaagagtaagcactgctcagaaatcaaaaaagggtaagagaaacttttttaaagcacagctttatacaacaaacacagtaaagactgatttgcctccaccctcctctgaaagcgagcaaatagatttgactgaggaacagaaggatgactcagaatggttaagcagcgatgtgatttgcatcgatgatggccccattgctgaagtgcatataaatgaagatgctcaggaaagtgactctctgaaaactcatttggaagatgaaagagataatagcgaaaagaagaagaatttggaagaagctgaattacattcaactgagaaagttccatgtattgaatttgatgatgatgattatgatacggattttgttccaccttctccagaagaaattatttctgcttcttcttcctcttcaaaatgccttagtacgttaaaggaccttgacacctctgacagaaaagaggatgttcttagcacatcaaaagatcttttgtcaaaacctgagaaaatgagtatgcaggagctgaatccagaaaccagcacagactgtgacgctagacagataagtttacagcagcagcttattcatgtgatggagcacatctgtaaattaattgatactattcctgatgataaactgaaacttttggattgtgggaacgaactgcttcagcagcggaacataagaaggaaacttctaacggaagtagattttaataaaagtgatgccagtcttcttggctcattgtggagatacaggcctgattcacttgatggccctatggagggtgattcctgccctacagggaattctatgaaggagttaaatttttcacaccttccctcaaattctgtttctcctggggactgtttactgactaccaccctaggaaagacaggattctctgccaccaggaagaatctttttgaaaggcctttattcaatacccatttacagaagtcctttgtaagtagcaactgggctgaaacaccaagactaggaaaaaaaaatgaaagctcttatttcccaggaaatgttctcacaagcactgctgtgaaagatcagaataaacatactgcttcaataaatgacttagaaagagaaacccaaccttcctatgatattgataattttgacatagatgactttgatgatgatgatgactgggaagacataatgcataatttagcagccagcaaatcttccacagctgcctatcaacccatcaaggaaggtcggccaattaaatcagtatcagaaagactttcctcagccaagacagactgtcttccagtgtcatctactgctcaaaatataaacttctcagagtcaattcagaattatactgacaagtcagcacaaaatttagcatccagaaatctgaaacatgagcgtttccaaagtcttagttttcctcatacaaaggaaatgatgaagatttttcataaaaaatttggcctgcataattttagaactaatcagctagaggcgatcaatgctgcactgcttggtgaagactgttttatcctgatgccgactggaggtggtaagagtttgtgttaccagctccctgcctgtgtttctcctggggtcactgttgtcatttctcccttgagatcacttatcgtagatcaagtccaaaagctgacttccttggatattccagctacatatctgacaggtgataagactgactcagaagctacaaatatttacctccagttatcaaaaaaagacccaatcataaaacttctatatgtcactccagaaaagatctgtgcaagtaacagactcatttctactctggagaatctctatgagaggaagctcttggcacgttttgttattgatgaagcacattgtgtcagtcagtggggacatgattttcgtcaagattacaaaagaatgaatatgcttcgccagaagtttccttctgttccggtgatggctcttacggccacagctaatcccagggtacagaaggacatcctgactcagctgaagattctcagacctcaggtgtttagcatgagctttaacagacataatctgaaatactatgtattaccgaaaaagcctaaaaaggtggcatttgattgcctagaatggatcagaaagcaccacccatatgattcagggataatttactgcctctccaggcgagaatgtgacaccatggctgacacgttacagagagatgggctcgctgctcttgcttaccatgctggcctcagtgattctgccagagatgaagtgcagcagaagtggattaatcaggatggctgtcaggttatctgtgctacaattgcatttggaatggggattgacaaaccggacgtgcgatttgtgattcatgcatctctccctaaatctgtggagggttactaccaagaatctggcagagctggaagagatggggaaatatctcactgcctgcttttctatacctatcatgatgtgaccagactgaaaagacttataatgatggaaaaagatggaaaccatcatacaagagaaactcacttcaataatttgtatagcatggtacattactgtgaaaatataacggaatgcaggagaatacagcttttggcctactttggtgaaaatggatttaatcctgatttttgtaagaaacacccagatgtttcttgtgataattgctgtaaaacaaaggattataaaacaagagatgtgactgacgatgtgaaaagtattgtaagatttgttcaagaacatagttcatcacaaggaatgagaaatataaaacatgtaggtccttctggaagatttactatgaatatgctggtcgacattttcttggggagtaagagtgcaaaaatccagtcaggtatatttggaaaaggatctgcttattcacgacacaatgccgaaagactttttaaaaagctgatacttgacaagattttggatgaagacttatatatcaatgccaatgaccaggcgatcgcttatgtgatgctcggaaataaagcccaaactgtactaaatggcaatttaaaggtagactttatggaaacagaaaattccagcagtgtgaaaaaacaaaaagcgttagtagcaaaagtgtctcagagggaagagatggttaaaaaatgtcttggagaacttacagaagtctgcaaatctctggggaaagtttttggtgtccattacttcaatatttttaataccgtcactctcaagaagcttgcagaatctttatcttctgatcctgaggttttgcttcaaattgatggtgttactgaagacaaactggaaaaatatggtgcggaagtgatttcagtattacagaaatactctgaatggacatcgccagctgaagacagttccccagggataagcctgtccagcagcagaggccccggaagaagtgccgctgaggagctcgacgaggaaatacccgtatcttcccactactttgcaagtaaaaccagaaatgaaaggaagaggaaaaagatgccagcctcccaaaggtctaagaggagaaaaactgcttccagtggttccaaggcaaagggggggtctgccacatgtagaaagatatcttccaaaacgaaatcctccagcatcattggatccagttcagcctcacatacttctcaagcgacatcaggagccaatagcaaattggggattatggctccaccgaagcctataaatagaccgtttcttaagccttcatatgcattctcataacaaccgaatctcaatgtacatagaccctctttcttgtttgtcagcatctgaccatctgtgactataaagctgttattcttgttataccatttgaagtttttactcgtctctattaatatttaaataaatgctggggggtgatagttcttctttttaaaataaacattttcttttgaataagca

SEQ ID NO: 530 - DNA, 3505 bp, Homo sapiens
gaagatgctcaggaaagtgactctctgaaaactcatttggaagatgaaagagataatagcgaaaagaagaagaatttggaagaagctgaattacattcaactgagaaagttccatgtattgaatttgatgatgatgattatgatacggattttgttccaccttctccagaagaaattatttctgcttcttcttcctcttcaaaatgccttagtacgttaaaggaccttgacacctctgacagaaaagaggatgttcttagcacatcaaaagatcttttgtcaaaacctgagaaaatgagtatgcaggagctgaatccagaaaccagcacagactgtgacgctagacagataagtttacagcagcagcttattcatgtgatggagcacatctgtaaattaattgatactattcctgatgataaactgaaacttttggattgtgggaacgaactgcttcagcagcggaacataagaaggaaacttctaacggaagtagattttaataaaagtgatgccagtcttcttggctcattgtggagatacaggcctgattcacttgatggccctatggagggtgattcctgccctacagggaattctatgaaggagttaaatttttcacaccttccctcaaattctgtttctcctggggactgtttactgactaccaccctaggaaagacaggattctctgccaccaggaagaatctttttgaaaggcctttattcaatacccatttacagaagtcctttgtaagtagcaactgggctgaaacaccaagactaggaaaaaaaaatgaaagctcttatttcccaggaaatgttctcacaagcactgctgtgaaagatcagaataaacatactgcttcaataaatgacttagaaagagaaacccaaccttcctatgatattgataattttgacatagatgactttgatgatgatgatgactgggaagacataatgcataatttagcagccagcaaatcttccacagctgcctatcaacccatcaaggaaggtcggccaattaaatcagtatcagaaagactttcctcagccaagacagactgtcttccagtgtcatctactgctcaaaatataaacttctcagagtcaattcagaattatactgacaagtcagcacaaaatttagcatccagaaatctgaaacatgagcgtttccaaagtcttagttttcctcatacaaaggaaatgatgaagatttttcataaaaaatttggcctgcataattttagaactaatcagctagaggcgatcaatgctgcactgcttggtgaagactgttttatcctgatgccgactggaggtggtaagagtttgtgttaccagctccctgcctgtgtttctcctggggtcactgttgtcatttctcccttgagatcacttatcgtagatcaagtccaaaagctgacttccttggatattccagctacatatctgacaggtgataagactgactcagaagctacaaatatttacctccagttatcaaaaaaagacccaatcataaaacttctatatgtcactccagaaaagatctgtgcaagtaacagactcatttctactctggagaatctctatgagaggaagctcttggcacgttttgttattgatgaagcacattgtgtcagtcagtggggacatgattttcgtcaagattacaaaagaatgaatatgcttcgccagaagtttccttctgttccggtgatggctcttacggccacagctaatcccagggtacagaaggacatcctgactcagctgaagattctcagacctcaggtgtttagcatgagctttaacagacataatctgaaatactatgtattaccgaaaaagcctaaaaaggtggcatttgattgcctagaatggatcagaaagcaccacccatatgattcagggataatttactgcctctccaggcgagaatgtgacaccatggctgacacgttacagaagtggattaatcaggatggctgtcaggttatctgtgctacaattgcatttggaatggggattgacaaaccggacgtgcgatttgtgattcatgcatctctccctaaatctgtggagggttactaccaagaatctggcagagctggaagagatggggaaatatctcactgcctgcttttctatacctatcatgatgtgaccagactgaaaagacttataatgatggaaaaagatggaaaccatcatacaagagaaactcacttcaataatttgtatagcatggtacattactgtgaaaatataacggaatgcaggagaatacagcttttggcctactttggtgaaaatggatttaatcctgatttttgtaagaaacacccagatgtttcttgtgataattgctgtaaaacaaaggattataaaacaagagatgtgactgacgatgtgaaaagtattgtaagatttgttcaagaacatagttcatcacaaggaatgagaaatataaaacatgtaggtccttctggaagatttactatgaatatgctggtcgacattttcttggggagtaagagtgcaaaaatccagtcaggtatatttggaaaaggatctgcttattcacgacacaatgccgaaagactttttaaaaagctgatacttgacaagattttggatgaagacttatatatcaatgccaatgaccaggcgatcgcttatgtgatgctcggaaataaagcccaaactgtactaaatggcaatttaaaggtagactttatggaaacagaaaattccagcagtgtgaaaaaacaaaaagcgttagtagcaaaagtgtctcagagggaagagatggttaaaaaatgtcttggagaacttacagaagtctgcaaatctctggggaaagtttttggtgtccattacttcaatatttttaataccgtcactctcaagaagcttgcagaatctttatcttctgatcctgaggttttgcttcaaattgatggtgttactgaagacaaactggaaaaatatggtgcggaagtgatttcagtattacagaaatactctgaatggacatcgccagctgaagacagttccccagggataagcctgtccagcagcagaggccccggaagaagtgccgctgaggagctcgacgaggaaatacccgtatcttcccactactttgcaagtaaaaccagaaatgaaaggaagaggaaaaagatgccagcctcccaaaggtctaagaggagaaaaactgcttccagtggttccaaggcaaagggggggtctgccacatgtagaaagatatcttccaaaacgaaatcctccagcatcattggatccagttcagcctcacatacttctcaagcgacatcaggagccaatagcaaattggggattatggctccaccgaagcctataaatagaccgtttcttaagccttcatatgcattctcataacaaccgaatctcaatgtacatagaccctctttcttgtttgtcagcatctgaccatctgtgactataa

SEQ ID NO: 531 - DNA, 2011 bp, Homo sapiens
ttattttcctagacaagtcagcacaaaatttagcatccagaaatctgaaacatgagcgtttccaaagtcttagttttcctcatacaaaggaaatgatgaagatttttcataaaaaatttggcctgcataattttagaactaatcagctagaggcgatcaatgctgcactgcttggtgaagactgttttatcctgatgccgactgtagattccagctacatatctgacaggtgataagactgactcagaagctacaaatatttacctccagttatcaaaaaaagacccaatcataaaacttctatatgtcactccagaaaagatctgtgcaagtaacagactcatttctactctggagaatctctatgagaggaagctcttggcacgttttgttattgatgaagcacattgtgtcagtcagtggggacatgattttcgtcaagattacaaaagaatgaatatgcttcgccagaagtttccttctgttccggtgatggctcttacggccacagctaatcccagggtacagaaggacatcctgactcagctgaagattctcagacctcaggtgtttagcatgagctttaacagacataatctgaaatactatgtattaccgaaaaagcctaaaaaggtggcatttgattgcctagaatggatcagaaagcaccacccatatgattcagggataatttactgcctctccaggcgagaatgtgacaccatggctgacacgttacagagagatgggctcgctgctcttgcttaccatgctggcctcagtgattctgccagagatgaagtgcagcagaagtggattaatcaggatggctgtcaggttatctgtgctacaattgcatttggaatggggattgacaaaccggacgtgcgatttgtgattcatgcatctctccctaaatctgtggagggttactaccaagaatctggcagagctggaagagatggggaaatatctcactgcctgcttttctatacctatcatgatgtgaccagactgaaaagacttataatgatggaaaaagatggaaaccatcatacaagagaaactcacttcaataatttgtatagcatggtacattactgtgaaaatataacggaatgcaggagaatacagcttttggcctactttggtgaaaatggatttaatcctgatttttgtaagaaacacccagatgtttcttgtgataattgctgtaaaacaaaggattataaaacaagagatgtgactgacgatgtgaaaagtattgtaagatttgttcaagaacatagttcatcacaaggaatgagaaatataaaacatgtaggtccttctggaagatttactatgaatatgctggtcgacattttcttggggagtaagagtgcaaaaatccagtcaggtatatttggaaaaggatctgcttattcacgacacaatgccgaaagactttttaaaaagctgatacttgacaagattttggatgaagacttatatatcaatgccaatgaccaggcgatcgcttatgtgatgctcggaaataaagcccaaactgtactaaatggcaatttaaaggtagactttatggaaacagaaaattccagcagtgtgaaaaaacaaaaagcgttagtagcaaaagtgtctcagagggaagagatggttaaaaaatgtcttggagaacttacagaagtctgcaaatctctggggaaagtttttggtgtccattacttcaatatttttaataccgtcactctcaagaagcttgcagaatctttatcttctgatcctgaggttttgcttcaaattgatggtgttactgaagacaaactggaaaaatatggtgcggaagtgatttcagtattacagaaatactctgaatggacatcgccagctgaagacagttccccagggataagcctgtccagcagcagaggccccggaagaagtgccgctgaggagctcgacgaggaaatacccgtatcttcccactactttgcaagtaaaaccagaaatg

SEQ ID NO: 532 - DNA, 3428 bp, Homo sapiens
cagcaactatgaaataatcgtagtatgagaggcagagatcggggcgagacaatggggatgtgggcgcgggagccccgttccggcttagcagcacctcccagccccgcagaataaaaccgatcgcgccccctccgcgcgcgccctcccccgagtgcggagcgggaggaggcggcggcggccgaggaggaggaggaggaggccccggaggaggaggcgttggaggtcgaggcggaggcggaggaggaggaggccgaggcgccggaggaggccgaggcgccggagcaggaggaggccggccggaggcggcatgagacgagcgtggcggccgcggctgctcggggccgcgctggttgcccattgacagcggcgtctgcagctcgcttcaagatggccgcttggctcgcattcattttctgctgaacgacttttaactttcattgtcttttccgcccgcttcgatcgcctcgcgccggctgctctttccgggattttttatcaagcagaaatgcatcgaacaacgagaatcaagatcactgagctaaatccccacctgatgtgtgtgctttgtggagggtacttcattgatgccacaaccataatagaatgtctacattccttctgtaaaacgtgtattgttcgttacctggagaccagcaagtattgtcctatttgtgatgtccaagttcacaagaccagaccactactgaatataaggtcagataaaactctccaagatattgtatacaaattagttccagggcttttcaaaaatgaaatgaagagaagaagggatttttatgcagctcatccttctgctgatgctgccaatggctctaatgaagatagaggagaggttgcagatgaagataagagaattataactgatgatgagataataagcttatccattgaattctttgaccagaacagattggatcggaaagtaaacaaagacaaagagaaatctaaggaggaggtgaatgataaaagatacttacgatgcccagcagcaatgactgtgatgcacttaagaaagtttctcagaagtaaaatggacatacctaatactttccagattgatgtcatgtatgaggaggaacctttaaaggattattatacactaatggatattgcctacatttatacctggagaaggaatggtccacttccattgaaatacagagttcgacctacttgtaaaagaatgaagatcagtcaccagagagatggactgacaaatgctggagaactggaaagtgactctgggagtgacaaggccaacagcccagcaggaggtattccctccacctcttcttgtttgcctagccccagtactccagtgcagtctcctcatccacagtttcctcacatttccagtactatgaatggaaccagcaacagccccagcggtaaccaccaatcttcttttgccaatagacctcgaaaatcatcagtaaatgggtcatcagcaacttcttctggttgatacctgagactgttaaggaaaaaaattttaaacccctgatttatatagatatcttcatgccattacagctttctagatgctaatacatgtgactatcgtccaatttgctttcttttgtagtgacattaaatttggctataaaagatggactacatgtgatactcctatggacgttaattgaaaagaaagattgttgttataaagaattggtttcttggaaagcaggcaagactttttctctgtgttaggaaagatgggaaatggtttctgtaaccattgtttggatttggaagtactctgcagtggacataagcattgggccatagtttgttaatctcaactaacgcctacattacattctccttgatcgttcttgttattacgctgttttgtgaacctgtagaaaacaagtgctttttatcttgaaattcaaccaacggaaagaatatgcatagaataatgcattctatgtagccatgtcactgtgaataacgatttcttgcatatttagccattttgattcctgtttgatttatacttctctgttgctacgcaaaaccgatcaaagaaaagtgaacttcagttttacaatctgtatgcctaaaagcgggtactaccgtttattttactgacttgtttaaatgattcgcttttgtaagaatcagatggcattatgcttgttgtacaatgccatattggtatatgacataacaggaaacagtattgtatgatatatttataaatgctataaagaaatattgtgtttcatgcattcagaaatgattgttaaaattctcccaactggttcgacctttgcagatacccataacctatgttgagccttgcttaccagcaaagaatatttttaatgtggatatctaattctaaagtctgttccattagaagcaattggcacatctttctatactttatatacttttctccagtaatacatgtttactttaaagattgttgcagtgaagaaaaacctttaactgagaaatatggaaaccgtcttaattttccattggctatgatggaattaatattgtattttaaaaatgcatattgatcactataattctaaaacaattttttaaataaaccagcaggttgctaaaagaaggcattttatctaaagttattttaataggtggtatagcagtaattttaaatttaagagttgcttttacagttaacaatggaatatgccttctctgctatgtctgaaaatagaagctatttattatgagcttctacaggtatttttaaatagagcaagcatgttgaatttaaaatatgaataaccccacccaacaattttcagtttattttttgctttggtcgaacttggtgtgtgttcatcacccatcagttatttgtgagggtgtttattctatatgaatattgtttcatgtttgtatgggaaaattgtagctaaacatttcattgtccccagtctgcaaaagaagcacaattctattgctttgtcttgcttatagtcattaaatcattacttttacatatattgctgttacttctgctttctttaaaaatatagtaaaggatgttttatgaagtcacaagatacatatatttttattttgacctaaatttgtacagtcccattgtaagtgttgtttctaattatagatgtaaaatgaaatttcatttgtaattggaaaaaatccaataaaaaggatattcatttagaaaatagctaagatctttaataaaaatttgatatgaaaagcacaatgtgcagaagttatggaaaacctatagaggattacaacaggtaaacgttaaagagaatacattgctgacttatagtgatgtggctaagaagtacatgctttgttgtaaaattgcttgaaagcccattgaaagatgtatctgtttatttacagtctttgaagtaaaagttaccaatgtttgccaa

SEQ ID NO: 533 - DNA, 3344 bp, Homo sapiens
gagccattttggagccggtgtcagtttccactctgccttcagcggtgcatttttttccaccctcccctccccctcctcccctccccccgctcgcacgcacacacacggcgccccccgcccgcccgcctcccccacagcaactatgaaataatcgtagtatgagaggcagagatcggggcgagacaatggggatgtgggcgcgggagccccgttccggcttagcagcacctcccagccccgcagaataaaaccgatcgcgccccctccgcgcgcgccctcccccgagtgcggagcgggaggaggcggcggcggccgaggaggaggaggaggaggccccggaggaggaggcgttggaggtcgaggcggaggcggaggaggaggaggccgaggcgccggaggaggccgaggcgccggagcaggaggaggccggccggaggcggcatgagacgagcgtggcggccgcggctgctcggggccgcgctggttgcccattgacagcggcgtctgcagctcgcttcaagatggccgcttggctcgcattcattttctgctgaacgacttttaactttcattgtcttttccgcccgcttcgatcgcctcgcgccggctgctctttccgggattttttatcaagcagaaatgcatcgaacaacgagaatcaagatcactgagctaaatccccacctgatgtgtgtgctttgtggagggtacttcattgatgccacaaccataatagaatgtctacattccttctgtaaaacgtgtattgttcgttacctggagaccagcaagtattgtcctatttgtgatgtccaagttcacaagaccagaccactactgaatataagattggatcggaaagtaaacaaagacaaagagaaatctaaggaggaggtgaatgataaaagatacttacgatgcccagcagcaatgactgtgatgcacttaagaaagtttctcagaagtaaaatggacatacctaatactttccagattgatgtcatgtatgaggaggaacctttaaaggattattatacactaatggatattgcctacatttatacctggagaaggaatggtccacttccattgaaatacagagttcgacctacttgtaaaagaatgaagatcagtcaccagagagatggactgacaaatgctggagaactggaaagtgactctgggagtgacaaggccaacagcccagcaggaggtattccctccacctcttcttgtttgcctagccccagtactccagtgcagtctcctcatccacagtttcctcacatttccagtactatgaatggaaccagcaacagccccagcggtaaccaccaatcttcttttgccaatagacctcgaaaatcatcagtaaatgggtcatcagcaacttcttctggttgatacctgagactgttaaggaaaaaaattttaaacccctgatttatatagatatcttcatgccattacagctttctagatgctaatacatgtgactatcgtccaatttgctttcttttgtagtgacattaaatttggctataaaagatggactacatgtgatactcctatggacgttaattgaaaagaaagattgttgttataaagaattggtttcttggaaagcaggcaagactttttctctgtgttaggaaagatgggaaatggtttctgtaaccattgtttggatttggaagtactctgcagtggacataagcattgggccatagtttgttaatctcaactaacgcctacattacattctccttgatcgttcttgttattacgctgttttgtgaacctgtagaaaacaagtgctttttatcttgaaattcaaccaacggaaagaatatgcatagaataatgcattctatgtagccatgtcactgtgaataacgatttcttgcatatttagccattttgattcctgtttgatttatacttctctgttgctacgcaaaaccgatcaaagaaaagtgaacttcagttttacaatctgtatgcctaaaagcgggtactaccgtttattttactgacttgtttaaatgattcgcttttgtaagaatcagatggcattatgcttgttgtacaatgccatattggtatatgacataacaggaaacagtattgtatgatatatttataaatgctataaagaaatattgtgtttcatgcattcagaaatgattgttaaaattctcccaactggttcgacctttgcagatacccataacctatgttgagccttgcttaccagcaaagaatatttttaatgtggatatctaattctaaagtctgttccattagaagcaattggcacatctttctatactttatatacttttctccagtaatacatgtttactttaaagattgttgcagtgaagaaaaacctttaactgagaaatatggaaaccgtcttaattttccattggctatgatggaattaatattgtattttaaaaatgcatattgatcactataattctaaaacaattttttaaataaaccagcaggttgctaaaagaaggcattttatctaaagttattttaataggtggtatagcagtaattttaaatttaagagttgcttttacagttaacaatggaatatgccttctctgctatgtctgaaaatagaagctatttattatgagcttctacaggtatttttaaatagagcaagcatgttgaatttaaaatatgaataaccccacccaacaattttcagtttattttttgctttggtcgaacttggtgtgtgttcatcacccatcagttatttgtgagggtgtttattctatatgaatattgtttcatgtttgtatgggaaaattgtagctaaacatttcattgtccccagtctgcaaaagaagcacaattctattgctttgtcttgcttatagtcattaaatcattacttttacatatattgctgttacttctgctttctttaaaaatatagtaaaggatgttttatgaagtcacaagatacatatatttttattttgacctaaatttgtacagtcccattgtaagtgttgtttctaattatagatgtaaaatgaaatttcatttgtaattggaaaaaatccaataaaaaggatattcatttagaaaatagctaagatctttaataaaaatttgatatgaaaagcacaatgtgcagaagttatggaaaacctatagaggattacaacaggtaaacgttaaagagaatacattgctgacttatagtgatgtggctaagaagtacatgctttgttgtaaaattgcttgaaagcccattgaaagatgtatctgtttatttacagtctttgaagtaaaagttaccaatgtttgcc

SEQ ID NO: 534 - DNA, 406 bp, Homo sapiens
gcccgccgaggctcggggctcgggccgggctccgcgcggagttgcagcggtggccggatgccaagtgtaagtgattttttatcaagcagaaatgcatcgaacaacgagaatcaagatcactgagctaaatccccacctgatgtgtgtgctttgtggagggtacttcattgatgccacaaccataatagaatgtctacattccttctgtaaaacgtgtattgttcgttacctggagaccagcaagtattgtcctatttgtgatgtccaagttcacaagaccagaccactactgaatataaggtcagataaaactctccaagatattgtatacaaattagttccagggcttttcaaaaatgaaatgaagagaagaagggatttttatgcagctcatccttctgctgat

SEQ ID NO: 535 - DNA, 745 bp, Homo sapiens
agatgctggcggatccccgctccttcgactccaacgccttcacgcttctcctccgggcggcattccagagtctgctggacgcccaggcggacgaggccgtgttaggattttttatcaagcagaaatgcatcgaacaacgagaatcaagatcactgagctaaatccccacctgatgtgtgtgctttgtggagggtacttcattgatgccacaaccataatagaatgtctacattccttctgtaaaacgtgtattgttcgttacctggagaccagcaagtattgtcctatttgtgatgtccaagttcacaagaccagaccactactgaatataaggtcagataaaactctccaagatattgtatacaaattagttccagggcttttcaaaaatgaaatgaagagaagaagggatttttatgcagctcatccttctgctgatgctgccaatggctctaatgaagatagaggagaggttgcagatgaagataagagaattataactgatgatgagataataagcttatccattgaattctttgaccagaacagattggatcggaaagtaaacaaagacaaagagaaatctaaggaggaggtgaatgataaaagatacttacgatgcccagcagcaatgactgtgatgcacttaagaaagtttctcagaagtaaaatggacatacctaatactttccagattgatgtcatgtatgaggaggaacctttaaaggattattatacactaatg

SEQ ID NO: 536 - DNA, 536 bp, Homo sapiens
ccgagaggagtactggtatttccagcctcggcggctctcccggccgcagcgccctttgttgagaggattttttatcaagcagaaatgcatcgaacaacgagaatcaagatcactgagctaaatccccacctgatgtgtgtgctttgtggagggtacttcattgatgccacaaccataatagaatgtctacattccttctgtaaaacgtgtattgttcgttacctggagaccagcaagtattgtcctatttgtgatgtccaagttcacaagaccagaccactactgaatataaggtcagataaaactctccaagatattgtatacaaattagttccagggcttttcaaaaatgaaatgaagagaagaagggatttttatgcagctcatccttctgctgatgctgccaatggctctaatgaagatagaggagaggttgcagatgaagataagagaattataactgatgatgagataataagcttatccattgaattctttgaccagaacagattggatcggaaagtaaacaaagacaa

SEQ ID NO: 537 - DNA, 552 bp, Homo sapiens
tacttcattgatgccacaaccataatagaatgtctacattccttctgtaaaacgtgtattgttcgttacctggagaccagcaagtattgtcctatttgtgatgtccaagttcacaagaccagaccactactgaatataagattggatcggaaagtaaacaaagacaaagagaaatctaaggaggaggtgaatgataaaagatacttacgatgcccagcagcaatgactgtgatgcacttaagaaagtttctcagaagtaaaatggacatacctaatactttccagattgatgtcatgtatgaggaggaacctttaaaggattattatacactaatggatattgcctacatttatacctggagaaggaatggtccacttccattgaaatacagagttcgacctacttgtaaaagaatgaagatcagtcaccagagagatggactgacaaatgctggagaactggaaagtgactctgggagtgacaaggccaacagcccagcaggaggtattccctccacctcttcttgtttgcctagccccagtactccagtg

SEQ ID NO: 538 - DNA, 378 bp, Homo sapiens
ccgccccgcacgcccgccgaggctcggggctcgggccgggctccgcgcggagttgcagcggtggccggatgccaagtgtaagtgattttttatcaagcagaaatgcatcgaacaacgagaatcaagatcactgagctaaatccccacctgatgtgtgtgctttgtggagggtacttcattgatgccacaaccataatagaatgtctacattccttctgtaaaacgtgtattgttcgttacctggagaccagcaagtattgtcctatttgtgatgtccaagttcacaagaccagaccactactgaatataaggtcagataaaactctccaagatattgtatacaaattagttccagggcttttcactgccaatggctct

SEQ ID NO: 539 - DNA, 2626 bp, Homo sapiens
gagacaggaaggagggaggcgagcagagggaaggggaagaggtcggggagcgagggcgggagcggtcgcggtcgcgatcgagcaagcaagcgggcgagaggacgccctcccctggcctccagtgcgccgcttccctcgccgccgccccgccagcatgcccggcgtggcccgcctgccgctgctgctcgggctgctgctgctcccgcgtcccggccggccgctggacttggccgactacacctatgacctggcggaggaggacgactcggagcccctcaactacaaagacccctgcaaggcggctgcctttcttggggacattgccctggacgaagaggacctgagggccttccaggtacagcaggctgtggatctcagacggcacacagctcgtaagtcctccatcaaagctgcagttccaggaaacacttctacccccagctgccagagcaccaacgggcagcctcagaggggagcctgtgggagatggagaggtagatcccgtagccggcgggcggcgacgtcccgaccagagcgtgtgtggcccgatggggtcatcccctttgtcattgggggaaacttcactggtagccagagggcagtcttccggcaggccatgaggcactgggagaagcacacctgtgtcaccttcctggagcgcactgacgaggacagctatattgtgttcacctatcgaccttgcgggtgctgctcctacgtgggtcgccgcggcgggggcccccaggccatctccatcggcaagaactgtgacaagttcggcattgtggtccacgagctgggccacgtcgtcggcttctggcacgaacacactcggccagaccgggaccgccacgtttccatcgttcgtgagaacatccagccagggcaggagtataacttcctgaagatggagcctcaggaggtggagtccctgggggagacctatgacttcgacagcatcatgcattacgctcggaacacattctccaggggcatcttcctggataccattgtccccaagtatgaggtgaacggggtgaaacctcccattggccaaaggacacggctcagcaagggggacattgcccaagcccgcaagctttacaagtgcccagcctgtggagagaccctgcaagacagcacaggcaacttctcctcccctgaataccccaatggctactctgctcacatgcactgcgtgtggcgcatctctgtcacacccggggagaagatcatcctgaacttcacgtccctggacctgtaccgcagccgcctgtgctggtacgactatgtggaggtccgagatggcttctggaggaaggcgcccctccgaggccgcttctgcgggtccaaactccctgagcctatcgtctccactgacagccgcctctgggttgaattccgcagcagcagcaattgggttggaaagggcttctttgcagtctacgaagccatctgcgggggtgatgtgaaaaaggactatggccacattcaatcgcccaactacccagacgattaccggcccagcaaagtctgcatctggcggatccaggtgtctgagggcttccacgtgggcctcacattccagtcctttgagattgagcgccacgacagctgtgcctacgactatctggaggtgcgcgacgggcacagtgagagcagcaccctcatcgggcgctactgtggctatgagaagcctgatgacatcaagagcacgtccagccgcctctggctcaagttcgtctctgacgggtccattaacaaagcgggctttgccgtcaactttttcaaagaggtggacgagtgctctcggcccaaccgcgggggctgtgagcagcggtgcctcaacaccctgggcagctacaagtgcagctgtgaccccgggtacgagctggccccagacaagcgccgctgtgaggctgcttgtggcggattcctcaccaagctcaacggctccatcaccagcccgggctggcccaaggagtacccccccaacaagaactgcatctggcagctggtggcccccacccagtaccgcatctccctgcagtttgacttctttgagacagagggcaatgatgtgtgcaagtacgacttcgtggaggtgcgcagtggactcacagctgactccaagctgcatggcaagttctgtggttctgagaagcccgaggtcatcacctcccagtacaacaacatgcgcgtggagttcaagtccgacaacaccgtgtccaaaaagggcttcaaggcccacttcttctcagaaaagaggccagctctgcagccccctcggggacgcccccaccagctcaaattccgagtgcagaaaagaaaccggaccccccagtgaggcctgccaggcctcccggaccccttgttactcaggaacctcaccttggacggaatgggatgggggcttcggtgcccaccaaccccccacctccactctgccattccggcccacctccctctggccggacagaactggtgctctcttctccccactgtgcccgtccgcggaccggggacccttccccgtgccctaccccctcccattttgatggtgtctgtgacatttcctgttgtgaagtaaaagagggacccctgcgtcctgctcctttctcttgca

SEQ ID NO: 540 - DNA, 4229 bp, Homo sapiens
cgagagagcgagggtccaagaaggggagatagggagacgcgggcggagagaccgacccgaggcgggggcgcggggcaggggcggcgcgaggacctgacagcgtgtcccgcggcggggcgggggctcggccgcgcgcccgcgggggaggccgccgctagagggcacttcaggagggacagccctcccggcaccccggggcccgagctccagccccggcctcgcggcccgcggcccgcggcccgggcggcccgagccccctccccgggcgcgcggctctccgccttccccgccccggctggcgcgcggcccggcccggccgagcactgtcccggccccgaggggggcagagctcgggcgaaaacccgccctccagcgagctcatttccctaaaaaggggggggggagtcggagggagggagggagggagagaaagaaagagagaaaaagaaggaaagggagagggagacggctggagcccgaggacgagcgcggagccgcggaccgagcggggggcgggagacaggaaggagggaggcgagcagagggaaggggaagaggtcggggagcgagggcgggagcggtcgcggtcgcgatcgagcaagcaagcgggcgagaggacgccctcccctggcctccagtgcgccgcttccctcgccgccgccccgccagcatgcccggcgtggcccgcctgccgctgctgctcgggctgctgctgctcccgcgtcccggccggccgctggacttggccgactacacctatgacctggcggaggaggacgactcggagcccctcaactacaaagacccctgcaaggcggctgcctttcttggggacattgccctggacgaagaggacctgagggccttccaggtacagcaggctgtggatctcagacggcacacagctcgtaagtcctccatcaaagctgcagttccaggaaacacttctacccccagctgccagagcaccaacgggcagcctcagaggggagcctgtgggagatggagaggtagatcccgtagccggcgggcggcgacgtcccgaccagagcgtgtgtggcccgatggggtcatcccctttgtcattgggggaaacttcactggtagccagagggcagtcttccggcaggccatgaggcactgggagaagcacacctgtgtcaccttcctggagcgcactgacgaggacagctatattgtgttcacctatcgaccttgcgggtgctgctcctacgtgggtcgccgcggcgggggcccccaggccatctccatcggcaagaactgtgacaagttcggcattgtggtccacgagctgggccacgtcgtcggcttctggcacgaacacactcggccagaccgggaccgccacgtttccatcgttcgtgagaacatccagccagggcaggagtataacttcctgaagatggagcctcaggaggtggagtccctgggggagacctatgacttcgacagcatcatgcattacgctcggaacacattctccaggggcatcttcctggataccattgtccccaagtatgaggtgaacggggtgaaacctcccattggccaaaggacacggctcagcaagggggacattgcccaagcccgcaagctttacaagtgcccagcctgtggagagaccctgcaagacagcacaggcaacttctcctcccctgaataccccaatggctactctgctcacatgcactgcgtgtggcgcatctctgtcacacccggggagaagatcatcctgaacttcacgtccctggacctgtaccgcagccgcctgtgctggtacgactatgtggaggtccgagatggcttctggaggaaggcgcccctccgaggccgcttctgcgggtccaaactccctgagcctatcgtctccactgacagccgcctctgggttgaattccgcagcagcagcaattgggttggaaagggcttctttgcagtctacgaagccatctgcgggggtgatgtgaaaaaggactatggccacattcaatcgcccaactacccagacgattaccggcccagcaaagtctgcatctggcggatccaggtgtctgagggcttccacgtgggcctcacattccagtcctttgagattgagcgccacgacagctgtgcctacgactatctggaggtgcgcgacgggcacagtgagagcagcaccctcatcgggcgctactgtggctatgagaagcctgatgacatcaagagcacgtccagccgcctctggctcaagttcgtctctgacgggtccattaacaaagcgggctttgccgtcaactttttcaaagaggtggacgagtgctctcggcccaaccgcgggggctgtgagcagcggtgcctcaacaccctgggcagctacaagtgcagctgtgaccccgggtacgagctggccccagacaagcgccgctgtgaggctgcttgtggcggattcctcaccaagctcaacggctccatcaccagcccgggctggcccaaggagtacccccccaacaagaactgcatctggcagctggtggcccccacccagtaccgcatctccctgcagtttgacttctttgagacagagggcaatgatgtgtgcaagtacgacttcgtggaggtgcgcagtggactcacagctgactccaagctgcatggcaagttctgtggttctgagaagcccgaggtcatcacctcccagtacaacaacatgcgcgtggagttcaagtccgacaacaccgtgtccaaaaagggcttcaaggcccacttcttctcagacaaggacgagtgctccaaggataacggcggctgccagcaggactgcgtcaacacgttcggcagttatgagtgccaatgccgcagtggcttcgtcctccatgacaacaagcacgactgcaaagaagccggctgtgaccacaaggtgacatccaccagtggtaccatcaccagccccaactggcctgacaagtatcccagcaagaaggagtgcacgtgggccatctccagcacccccgggcaccgggtcaagctgaccttcatggagatggacatcgagtcccagcctgagtgtgcctacgaccacctagaggtgttcgacgggcgagacgccaaggcccccgtcctcggccgcttctgtgggagcaagaagcccgagcccgtcctggccacaggcagccgcatgttcctgcgcttctactcagataactcggtccagcgaaagggcttccaggcctcccacgccacagagtgcgggggccaggtacgggcagacgtgaagaccaaggacctttactcccacgcccagtttggcgacaacaactaccctgggggtgtggactgtgagtgggtcattgtggccgaggaaggctacggcgtggagctcgtgttccagacctttgaggtggaggaggagaccgactgcggctatgactacatggagctcttcgacggctacgacagcacagcccccaggctggggcgctactgtggctcagggcctcctgaggaggtgtactcggcgggagattctgtcctggtgaagttccactcggatgacaccatcaccaaaaaaggtttccacctgcgatacaccagcaccaagttccaggacacactccacagcaggaagtgaccactgcctgagcaggggcggggactggagcctgctgcccttggtcgcctagactggatagtgggggtgggcggaaggcaacgcaccatccctctcccccaggccccaggacctgcagggccaatggcctggtgagactgtccataggaggtgggggaactggactccggcataagccacttccccacaaacccccaccagcaaggggctggggccagggagcagagcttccacaagacatttcgaagtcatcattcctctcttagggggccctgcctggtggcaagagggaatgtcagcaggaccccatcgccatccctgtgtctctacacgctgtattgtgtatcaccgggggcattattttcattgtaatgttcatttcccacccctgctccagcctcgatttggttttattttgagcccccattccaccaccccagtttcctggggcacaagtgtctgtgcatgtcccccaggagccaccgtggggagccgatggggaggggatggagaaacaagacagggcttctctcaggcccagtggccggtcagccacaccagggcaccgcagccaataaaccgaaagtgttacagccaa

SEQ ID NO: 541 - DNA, 3989 bp, Homo sapiens
gtcggagggagggagggagggagagaaagaaagagagaaaaagaaggaaagggagagggagacggctggagcccgaggacgagcgcggagccgcggaccgagcggggggcgggagacaggaaggagggaggcgagcagagggaaggggaagaggtcggggagcgagggcgggagcggtcgcggtcgcgatcgagcaagcaagcgggcgagaggacgccctcccctggcctccagtgcgccgcttccctcgccgccgccccgccagcatgcccggcgtggcccgcctgccgctgctgctcgggctgctgctgctcccgcgtcccggccggccgctggacttggccgactacacctatgacctggcggaggaggacgactcggagcccctcaactacaaagacccctgcaaggcggctgcctttcttggggacattgccctggacgaagaggacctgagggccttccaggtacagcaggctgtggatctcagacggcacacagctcgtaagtcctccatcaaagctgcagttccaggaaacacttctacccccagctgccagagcaccaacgggcagcctcagaggggagcctgtgggagatggagaggtagatcccgtagccggcgggcggcgacgtcccgaccagagcgtgtgtggcccgatggggtcatcccctttgtcattgggggaaacttcactggtagccagagggcagtcttccggcaggccatgaggcactgggagaagcacacctgtgtcaccttcctggagcgcactgacgaggacagctatattgtgttcacctatcgaccttgcgggtgctgctcctacgtgggtcgccgcggcgggggcccccaggccatctccatcggcaagaactgtgacaagttcggcattgtggtccacgagctgggccacgtcgtcggcttctggcacgaacacactcggccagaccgggaccgccacgtttccatcgttcgtgagaacatccagccaggcgttctccactcttcactgctccttctcagctgtggctctagaaatggtgcttccttcccatgttcccttgagtcctccattcaccaggccctctgctggacaggactcttcctgagaccctccccattccccaggctccccttggctgctccccggaccctcagggcaggagtataacttcctgaagatggagcctcaggaggtggagtccctgggggagacctatgacttcgacagcatcatgcattacgctcggaacacattctccaggggcatcttcctggataccattgtccccaagtatgaggtgaacggggtgaaacctcccattggccaaaggacacggctcagcaagggggacattgcccaagcccgcaagctttacaagtgcccagcctgtggagagaccctgcaagacagcacaggcaacttctcctcccctgaataccccaatggctactctgctcacatgcactgcgtgtggcgcatctctgtcacacccggggagaagatcatcctgaacttcacgtccctggacctgtaccgcagccgcctgtgctggtacgactatgtggaggtccgagatggcttctggaggaaggcgcccctccgaggccgcttctgcgggtccaaactccctgagcctatcgtctccactgacagccgcctctgggttgaattccgcagcagcagcaattgggttggaaagggcttctttgcagtctacgaagccatctgcgggggtgatgtgaaaaaggactatggccacattcaatcgcccaactacccagacgattaccggcccagcaaagtctgcatctggcggatccaggtgtctgagggcttccacgtgggcctcacattccagtcctttgagattgagcgccacgacagctgtgcctacgactatctggaggtgcgcgacgggcacagtgagagcagcaccctcatcgggcgctactgtggctatgagaagcctgatgacatcaagagcacgtccagccgcctctggctcaagttcgtctctgacgggtccattaacaaagcgggctttgccgtcaactttttcaaagaggtggacgagtgctctcggcccaaccgcgggggctgtgagcagcggtgcctcaacaccctgggcagctacaagtgcagctgtgaccccgggtacgagctggccccagacaagcgccgctgtgaggctgcttgtggcggattcctcaccaagctcaacggctccatcaccagcccgggctggcccaaggagtacccccccaacaagaactgcatctggcagctggtggcccccacccagtaccgcatctccctgcagtttgacttctttgagacagagggcaatgatgtgtgcaagtacgacttcgtggaggtgcgcagtggactcacagctgactccaagctgcatggcaagttctgtggttctgagaagcccgaggtcatcacctcccagtacaacaacatgcgcgtggagttcaagtccgacaacaccgtgtccaaaaagggcttcaaggcccacttcttctcagacaaggacgagtgctccaaggataacggcggctgccagcaggactgcgtcaacacgttcggcagttatgagtgccaatgccgcagtggcttcgtcctccatgacaacaagcacgactgcaaagaagccggctgtgaccacaaggtgacatccaccagtggtaccatcaccagccccaactggcctgacaagtatcccagcaagaaggagtgcacgtgggccatctccagcacccccgggcaccgggtcaagctgaccttcatggagatggacatcgagtcccagcctgagtgtgcctacgaccacctagaggtgttcgacgggcgagacgccaaggcccccgtcctcggccgcttctgtgggagcaagaagcccgagcccgtcctggccacaggcagccgcatgttcctgcgcttctactcagataactcggtccagcgaaagggcttccaggcctcccacgccacagagtgcgggggccaggtacgggcagacgtgaagaccaaggacctttactcccacgcccagtttggcgacaacaactaccctgggggtgtggactgtgagtgggtcattgtggccgaggaaggctacggcgtggagctcgtgttccagacctttgaggtggaggaggagaccgactgcggctatgactacatggagctcttcgacggctacgacagcacagcccccaggctggggcgctactgtggctcagggcctcctgaggaggtgtactcggcgggagattctgtcctggtgaagttccactcggatgacaccatcaccaaaaaaggtttccacctgcgatacaccagcaccaagttccaggacacactccacagcaggaagtgaccactgcctgagcaggggcggggactggagcctgctgcccttggtcgcctagactggatagtgggggtgggcggaaggcaacgcaccatccctctcccccaggccccaggacctgcagggccaatggcctggtgagactgtccataggaggtgggggaactggactccggcataagccacttccccacaaacccccaccagcaaggggctggggccagggagcagagcttccacaagacatttcgaagtcatcattcctctcttagggggccctgcctggtggcaagagggaatgtcagcaggaccccatcgccatccctgtgtctctacacgctgtattgtgtatcaccgggggcattattttcattgtaatgttcatttcccacccctgctccagcctcgatttggttttattttgagcccccattccaccaccccagtttcctggggcacaagtgtctgtgcatgtcccccaggagccaccgtggggagccgatggggaggggatggagaaacaagacagggcttctctcaggcccagtggccggtcagccacaccagggcaccgcagccaataaaccgaaagtgttacagcc

SEQ ID NO: 542 - DNA, 2205 bp, Homo sapiens
gaagaggtcggggagcgagggcgggagcggtcgcggtcgcgatcgagcaagcaagcgggcgagaggacgccctcccctggcctccagtgcgccgcttccctcgccgccgccccgccagcatgcccggcgtggcccgcctgccgctgctgctcgggctgctgctgctcccgcgtcccggccggccgctggacttggccgactacacctatgacctggcggaggaggacgactcggagcccctcaactacaaagacccctgcaaggcggctgcctttcttggggacattgccctggacgaagaggacctgagggccttccaggtacagcaggctgtggatctcagacggcacacagctcgtaagtcctccatcaaagctgcagttccaggaaacacttctacccccagctgccagagcaccaacgggcagcctcagaggggagcctgtgggagatggagaggtagatcccgtagccggcgggcggcgacgtcccgaccagagcgtgtgtggcccgatggggtcatcccctttgtcattgggggaaacttcactggtagccagagggcagtcttccggcaggccatgaggcactgggagaagcacacctgtgtcaccttcctggagcgcactgacgaggacagctatattgtgttcacctatcgaccttgcgggtgctgctcctacgtgggtcgccgcggcgggggcccccaggccatctccatcggcaagaactgtgacaagttcggcattgtggtccacgagctgggccacgtcgtcggcttctggcacgaacacactcggccagaccgggaccgccacgtttccatcgttcgtgagaacatccagccagggcaggagtataacttcctgaagatggagcctcaggaggtggagtccctgggggagacctatgacttcgacagcatcatgcattacgctcggaacacattctccaggggcatcttcctggataccattgtccccaagtatgaggtgaacggggtgaaacctcccattggccaaaggacacggctcagcaagggggacattgcccaagcccgcaagctttacaagtgcccagcctgtggagagaccctgcaagacagcacaggcaacttctcctcccctgaataccccaatggctactctgctcacatgcactgcgtgtggcgcatctctgtcacacccggggagaagatcatcctgaacttcacgtccctggacctgtaccgcagccgcctgtgctggtacgactatgtggaggtccgagatggcttctggaggaaggcgcccctccgaggccgcttctgcgggtccaaactccctgagcctatcgtctccactgacagccgcctctgggttgaattccgcagcagcagcaattgggttggaaagggcttctttgcagtctacgaagccatctgcgggggtgatgtgaaaaaggactatggccacattcaatcgcccaactacccagacgattaccggcccagcaaagtctgcatctggcggatccaggtgtctgagggcttccacgtgggcctcacattccagtcctttgagattgagcgccacgacagctgtgcctacgactatctggaggtgcgcgacgggcacagtgagagcagcaccctcatcgggcgctactgtggctatgagaagcctgatgacatcaagagcacgtccagccgcctctggctcaagttcgtctctgacgggtccattaacaaagcgggctttgccgtcaactttttcaaagaggtggacgagtgctctcggcccaaccgcgggggctgtgagcagcggtgcctcaacaccctgggcagctacaagtgcagctgtgaccccgggtacgagctggccccagacaagcgccgctgtgaggggtgttatgatctacaggttgggaaacccctgttgtgggacagacactgtttccgcctctccacgcatggtcccgagatgctggggacagcactccgaggctaatggctccagctcactaggccgatcctgctgtgcccccgagctgctccctttcctgcacctcccaggaccgcccctccctgaactgctttccctgagccccttattcccgctcactccctcttggaggaccttggcctgttcatttgcagagaagatagaaatggccacacttatgaccccttagctcccccactcctccctacaggcccacccctga

SEQ ID NO: 543 - DNA, 2691 bp, Homo sapiens
aaagggagagggagacggctggagcccgaggacgagcgcggagccgcggaccgagcggggggcgggagacaggaaggagggaggcgagcagagggaaggggaagaggtcggggagcgagggcgggagcggtcgcggtcgcgatcgagcaagcaagcgggcgagaggacgccctcccctggcctccagtgcgccgcttccctcgccgccgccccgccagcatgcccggcgtggcccgcctgccgctgctgctcgggctgctgctgctcccgcgtcccggccggccgctggacttggccgactacacctatgacctggcggaggaggacgactcggagcccctcaactacaaagacccctgcaaggcggctgcctttcttggggacattgccctggacgaagaggacctgagggccttccaggtacagcaggctgtggatctcagacggcacacagctcgtaagtcctccatcaaagctgcagttccaggaaacacttctacccccagctgccagagcaccaacgggcagcctcagaggggagcctgtgggagatggagaggtagatcccgtagccggcgggcggcgacgtcccgaccagagcgtgtgtggcccgatggggtcatcccctttgtcattgggggaaacttcactggtagccagagggcagtcttccggcaggccatgaggcactgggagaagcacacctgtgtcaccttcctggagcgcactgacgaggacagctatattgtgttcacctatcgaccttgcgggtgctgctcctacgtgggtcgccgcggcgggggcccccaggccatctccatcggcaagaactgtgacaagttcggcattgtggtccacgagctgggccacgtcgtcggcttctggcacgaacacactcggccagaccgggaccgccacgtttccatcgttcgtgagaacatccagccagggcaggagtataacttcctgaagatggagcctcaggaggtggagtccctgggggagacctatgacttcgacagcatcatgcattacgctcggaacacattctccaggggcatcttcctggataccattgtccccaagtatgaggtgaacggggtgaaacctcccattggccaaaggacacggctcagcaagggggacattgcccaagcccgcaagctttacaagtgcccagcctgtggagagaccctgcaagacagcacaggcaacttctcctcccctgaataccccaatggctactctgctcacatgcactgcgtgtggcgcatctctgtcacacccggggagaagatcatcctgaacttcacgtccctggacctgtaccgcagccgcctgtgctggtacgactatgtggaggtccgagatggcttctggaggaaggcgcccctccgaggccgcttctgcgggtccaaactccctgagcctatcgtctccactgacagccgcctctgggttgaattccgcagcagcagcaattgggttggaaagggcttctttgcagtctacgaagccatctgcgggggtgatgtgaaaaaggactatggccacattcaatcgcccaactacccagacgattaccggcccagcaaagtctgcatctggcggatccaggtgtctgagggcttccacgtgggcctcacattccagtcctttgagattgagcgccacgacagctgtgcctacgactatctggaggtgcgcgacgggcacagtgagagcagcaccctcatcgggcgctactgtggctatgagaagcctgatgacatcaagagcacgtccagccgcctctggctcaagttcgtctctgacgggtccattaacaaagcgggctttgccgtcaactttttcaaagaggtggacgagtgctctcggcccaaccgcgggggctgtgagcagcggtgcctcaacaccctgggcagctacaagtgcagctgtgaccccgggtacgagctggccccagacaagcgccgctgtgaggctgcttgtggcggattcctcaccaagctcaacggctccatcaccagcccgggctggcccaaggagtacccccccaacaagaactgcatctggcagctggtggcccccacccagtaccgcatctccctgcagtttgacttctttgagacagagggcaatgatgtgtgcaagtacgacttcgtggaggtgcgcagtggactcacagctgactccaagctgcatggcaagttctgtggttctgagaagcccgaggtcatcacctcccagtacaacaacatgcgcgtggagttcaagtccgacaacaccgtgtccaaaaagggcttcaaggcccacttcttctcagtcttggagggggcaggggaccgacactcacatctatcaggcctggagttactgctctgcccccatgccctggtcgacactgtgcccgccccaccctcagccctgcacggagacacacacgcccacacgcacacacatgtgcacacacattgccccatcgcacaagaaacctgcagaggacccccactgggggcatcgaggctcagccctcagggcccggggcatctgactctggccccccaggaggggagctatttggacttttgggacacccaccgaggagaccctaagccaagaaggagaagaaagagcctgaagaccttcagtctgacccctgccaccttccggggcatttgggcactgtag

SEQ ID NO: 544 - DNA, 4333 bp, Homo sapiens
aaagggagagggagacggctggagcccgaggacgagcgcggagccgcggaccgagcggggggcgggagacaggaaggagggaggcgagcagagggaaggggaagaggtcggggagcgagggcgggagcggtcgcggtcgcgatcgagcaagcaagcgggcgagaggacgccctcccctggcctccagtgcgccgcttccctcgccgccgccccgccagcatgcccggcgtggcccgcctgccgctgctgctcgggctgctgctgctcccgcgtcccggccggccgctggacttggccgactacacctatgacctggcggaggaggacgactcggagcccctcaactacaaagacccctgcaaggcggctgcctttcttggggacattgccctggacgaagaggacctgagggccttccaggtacagcaggctgtggatctcagacggcacacagctcgtaagtcctccatcaaagctgcagttccaggaaacacttctacccccagctgccagagcaccaacgggcagcctcagaggggagcctgtgggagatggagaggtagatcccgtagccggcgggcggcgacgtcccgaccagagcgtgtgtggcccgatggggtcatcccctttgtcattgggggaaacttcactggtagccagagggcagtcttccggcaggccatgaggcactgggagaagcacacctgtgtcaccttcctggagcgcactgacgaggacagctatattgtgttcacctatcgaccttgcgggtgctgctcctacgtgggtcgccgcggcgggggcccccaggccatctccatcggcaagaactgtgacaagttcggcattgtggtccacgagctgggccacgtcgtcggcttctggcacgaacacactcggccagaccgggaccgccacgtttccatcgttcgtgagaacatccagccagggcaggagtataacttcctgaagatggagcctcaggaggtggagtccctgggggagacctatgacttcgacagcatcatgcattacgctcggaacacattctccaggggcatcttcctggataccattgtccccaagtatgaggtgaacggggtgaaacctcccattggccaaaggacacggctcagcaagggggacattgcccaagcccgcaagctttacaagtgcccagcctgtggagagaccctgcaagacagcacaggcaacttctcctcccctgaataccccaatggctactctgctcacatgcactgcgtgtggcgcatctctgtcacacccggggagaagatcatcctgaacttcacgtccctggacctgtaccgcagccgcctgtgctggtacgactatgtggaggtccgagatggcttctggaggaaggcgcccctccgaggccgcttctgcgggtccaaactccctgagcctatcgtctccactgacagccgcctctgggttgaattccgcagcagcagcaattgggttggaaagggcttctttgcagtctacgaagccatctgcgggggtgatgtgaaaaaggactatggccacattcaatcgcccaactacccagacgattaccggcccagcaaagtctgcatctggcggatccaggtgtctgagggcttccacgtgggcctcacattccagtcctttgagattgagcgccacgacagctgtgcctacgactatctggaggtgcgcgacgggcacagtgagagcagcaccctcatcgggcgctactgtggctatgagaagcctgatgacatcaagagcacgtccagccgcctctggctcaagttcgtctctgacgggtccattaacaaagcgggctttgccgtcaactttttcaaagaggtggacgagtgctctcggcccaaccgcgggggctgtgagcagcggtgcctcaacaccctgggcagctacaagtgcagctgtgaccccgggtacgagctggccccagacaagcgccgctgtgaggctgcttgtggcggattcctcaccaagctcaacggctccatcaccagcccgggctggcccaaggagtacccccccaacaagaactgcatctggcagctggtggcccccacccagtaccgcatctccctgcagtttgacttctttgagacagagggcaatgatgtgtgcaagtacgacttcgtggaggtgcgcagtggactcacagctgactccaagctgcatggcaagttctgtggttctgagaagcccgaggtcatcacctcccagtacaacaacatgcgcgtggagttcaagtccgacaacaccgtgtccaaaaagggcttcaaggcccacttcttctcagaaaagaggccagctctgcagccccctcggggacgcccccaccagctcaaattccgagtgcagaaaagaaaccggaccccccagtgaggcctgccaggcctcccggaccccttgttactcaggaacctcaccttggacggaatgggatgggggcttcggtgcccaccaaccccccacctccactctgccattccggcccacctccctctggccggacagaactggtgctctcttctccccactgtgcccgtccgcggaccggggacccttccccgtgccctaccccctcccattttgatggtgtctgtgacatttcctgttgtgaagtaaaagagggacccctgcgtcctgctcctttctcttgcagtctgcttgtccatgtgtctatttttccacttgtccatctgtccagtaagcaggtaatggtgacccatgctggtccgctcggacccccatcctcctctccccacagctgggccctgctcagctggtcctgctggatgcagtgcccctttggacccccttgtcgcctggcctcccactcccggccacctggcctggccagctctgccagctgttgctctgtcccggtgggagaaagtccagccaggcctccacttcccctggggcatcccaacctcagccctgcacagacccagcgtctgcccttatttgctcccctgcagacaaggacgagtgctccaaggataacggcggctgccagcaggactgcgtcaacacgttcggcagttatgagtgccaatgccgcagtggcttcgtcctccatgacaacaagcacgactgcaaagaagaccttcatggagatggacatcgagtcccagcctgagtgtgcctacgaccacctagaggtgttcgacgggcgagacgccaaggcccccgtcctcggccgcttctgtgggagcaagaagcccgagcccgtcctggccacaggcagccgcatgttcctgcgcttctactcagataactcggtccagcgaaagggcttccaggcctcccacgccacagagtgcgggggccaggtacgggcagacgtgaagaccaaggacctttactcccacgcccagtttggcgacaacaactaccctgggggtgtggactgtgagtgggtcattgtggccgaggaaggctacggcgtggagctcgtgttccagacctttgaggtggaggaggagaccgactgcggctatgactacatggagctcttcgacggctacgacagcacagcccccaggctggggcgctactgtggctcagggcctcctgaggaggtgtactcggcgggagattctgtcctggtgaagttccactcggatgacaccatcaccaaaaaaggtttccacctgcgatacaccagcaccaagttccaggacacactccacagcaggaagtgaccactgcctgagcaggggcggggactggagcctgctgcccttggtcgcctagactggatagtgggggtgggcggaaggcaacgcaccatccctctcccccaggccccaggacctgcagggccaatggcctggtgagactgtccataggaggtgggggaactggactccggcataagccacttccccacaaacccccaccagcaaggggctggggccagggagcagagcttccacaagacatttcgaagtcatcattcctctcttagggggccctgcctggtggcaagagggaatgtcagcaggaccccatcgccatccctgtgtctctacacgctgtattgtgtatcaccgggggcattattttcattgtaatgttcatttcccacccctgctccagcctcgatttggttttattttgagcccccattccaccaccccagtttcctggggcacaagtgtctgtgcatgtcccccaggagccaccgtggggagccgatggggaggggatggagaaacaagacagggcttctctcaggcccagtggccggtcagccacaccagggcaccgcagccaataaaccgaaagtgttacagcc

SEQ ID NO: 545 - DNA, 1807 bp, Homo sapiens
atatcacaggtgcaggattagtgctgcctacggtgctgggctttttagtggaaacccctagcaattctgtgcctcctcctcatgtctctcatcctagggagcctggcaaccatatatcaagcgtacagaaatcaaaacaaacttccttgataacatgcttttgcgaagtgcaggaaaattaaatgtgggcaccaagaaagaggatggtgagagtacagcccccaccccccgtccaaaggtcttgcgttgtaaatgccaccaccattgtccagaagactcagtcaacaatatttgcagcacagacggatattgtttcacgatgatagaagaggatgactctgggttgcctgtggtcacttctggttgcctaggactagaaggctcagattttcagtgtcgggacactcccattcctcatcaaagaagatcaattgaatgctgcacagaaaggaacgaatgtaataaagacctacaccctacactgcctccattgaaaaacagagattttgttgatggacctatacaccacagggctttacttatatctgtgactgtctgtagtttgctcttggtccttatcatattattttgttacttccggtataaaagacaagaaaccagacctcgatacagcattgggttagaacaggatgaaacttacattcctcctggagaatccctgagagacttaattgagcagtctcagagctcaggaagtggatcaggcctccctctgctggtccaaaggactatagctaagcagattcagatggtgaaacagattggaaaaggtcgctatggggaagtttggatgggaaagtggcgtggcgaaaaggtagctgtgaaagtgttcttcaccacagaggaagccagctggttcagagagacagaaatatatcagacagtgttgatgaggcatgaaaacattttgggtttcattgctgcagatatcaaagggacagggtcctggacccagttgtacctaatcacagactatcatgaaaatggttccctttatgattatctgaagtccaccaccctagacgctaaatcaatgctgaagttagcctactcttctgtcagtggcttatgtcatttacacacagaaatctttagtactcaaggcaaaccagcaattgcccatcgagatctgaaaagtaaaaacattctggtgaagaaaaatggaacttgctgtattgctgacctgggcctggctgttaaatttattagtgatacaaatgaagttgacataccacctaacactcgagttggcaccaaacgctatatgcctccagaagtgttggacgagagcttgaacagaaatcacttccagtcttacatcatggctgacatgtatagttttggcctcatcctttgggaggttgctaggagatgtgtatcaggaggtatagtggaagaataccagcttccttatcatgacctagtgcccagtgacccctcttatgaggacatgagggagattgtgtgcatcaagaagttacgcccctcattcccaaaccggtggagcagtgatgagtgtctaaggcagatgggaaaactcatgacagaatgctgggctcacaatcctgcatcaaggctgacagccctgcgggttaagaaaacacttgccaaaatgtcagagtcccaggacattaaactctgataggagaggaaaagtaagcatctctgcagaaagccaacaggtactcttctgtttgtgggcagagcaaaagacatcaaataagcatccacagtacaagccttgaacatcgtcctgcttcccagtgggttcagacctcacctctca

SEQ ID NO: 546 - DNA, 1922 bp, Homo sapiens
gactggggtagtctaccccacagatgcctaactctcactatttcttctttcagcaaacttccttgataacatgcttttgcgaagtgcaggaaaattaaatgtgggcaccaagaaagaggatggtgagagtacagcccccaccccccgtccaaaggtcttgcgttgtaaatgccaccaccattgtccagaagactcagtcaacaatatttgcagcacagacggatattgtttcacgatgatagaagaggatgactctgggttgcctgtggtcacttctggttgcctaggactagaaggctcagattttcagtgtcgggacactcccattcctcatcaaagaagatcaattgaatgctgcacagaaaggaacgaatgtaataaagacctacaccctacactgcctccattgaaaaacagagattttgttgatggacctatacaccacagggctttacttatatctgtgactgtctgtagtttgctcttggtccttatcatattattttgttacttccggtataaaagacaagaaaccagacctcgatacagcattgggttagaacaggatgaaacttacattcctcctggagaatccctgagagacttaattgagcagtctcagagctcaggaagtggatcaggcctccctctgctggtccaaaggactatagctaagcagattcagatggtgaaacagattggaaaaggtcgctatggggaagtttggatgggaaagtggcgtggcgaaaaggtagctgtgaaagtgttcttcaccacagaggaagccagctggttcagagagacagaaatatatcagacagtgttgatgaggcatgaaaacattttgggtttcattgctgcagatatcaaagggacagggtcctggacccagttgtacctaatcacagactatcatgaaaatggttccctttatgattatctgaagtccaccaccctagacgctaaatcaatgctgaagttagcctactcttctgtcagtggcttatgtcatttacacacagaaatctttagtactcaaggcaaaccagcaattgcccatcgagatctgaaaagtaaaaacattctggtgaagaaaaatggaacttgctgtattgctgacctgggcctggctgttaaatttattagtgatacaaatgaagttgacataccacctaacactcgagttggcaccaaacgctatatgcctccagaagtgttggacgagagcttgaacagaaatcacttccagtcttacatcatggctgacatgtatagttttggcctcatcctttgggaggttgctaggagatgtgtatcaggaggtatagtggaagaataccagcttccttatcatgacctagtgcccagtgacccctcttatgaggacatgagggagattgtgtgcatcaagaagttacgcccctcattcccaaaccggtggagcagtgatgagtgtctaaggcagatgggaaaactcatgacagaatgctgggctcacaatcctgcatcaaggctgacagccctgcgggttaagaaaacacttgccaaaatgtcagagtcccaggacattaaactctgataggagaggaaaagtaagcatctctgcagaaagccaacaggtactcttctgtttgtgggcagagcaaaagacatcaaataagcatccacagtacaagccttgaacatcgtcctgcttcccagtgggttcagacctcacctctcagggagcgacctgggcaaagacagagaagctcccagaaggagagattgatccatgtctgtttgtaggacggagaaaccgcttgggtaacttgttcaagatatgatgcatgttgctttctaagaaagccctgtattttgtgattgcctttttttttttttaagatgctttcattttgccaaaataaaacagataatgtgga

SEQ ID NO: 547 - DNA, 1764 bp, Homo sapiens
attgactgctctgctgctgcaatgggttggctggaagaactaaactggcagcttcacattttcttgctcattcttctctctatgcacacaagggcaaacttccttgataacatgcttttgcgaagtgcaggaaaattaaatgtgggcaccaagaaagaggatggtgagagtacagcccccaccccccgtccaaaggtcttgcgttgtaaatgccaccaccattgtccagaagactcagtcaacaatatttgcagcacagacggatattgtttcacgatgatagaagaggatgactctgggttgcctgtggtcacttctggttgcctaggactagaaggctcagattttcagtgtcgggacactcccattcctcatcaaagaagatcaattgaatgctgcacagaaaggaacgaatgtaataaagacctacaccctacactgcctccattgaaaaacagagattttgttgatggacctatacaccacagggctttacttatatctgtgactgtctgtagtttgctcttggtccttatcatattattttgttacttccggtataaaagacaagaaaccagacctcgatacagcattgggttagaacaggatgaaacttacattcctcctggagaatccctgagagacttaattgagcagtctcagagctcaggaagtggatcaggcctccctctgctggtccaaaggactatagctaagcagattcagatggtgaaacagattggaaaaggtcgctatggggaagtttggatgggaaagtggcgtggcgaaaaggtagctgtgaaagtgttcttcaccacagaggaagccagctggttcagagagacagaaatatatcagacagtgttgatgaggcatgaaaacattttgggtttcattgctgcagatatcaaagggacagggtcctggacccagttgtacctaatcacagactatcatgaaaatggttccctttatgattatctgaagtccaccaccctagacgctaaatcaatgctgaagttagcctactcttctgtcagtggcttatgtcatttacacacagaaatctttagtactcaaggcaaaccagcaattgcccatcgagatctgaaaagtaaaaacattctggtgaagaaaaatggaacttgctgtattgctgacctgggcctggctgttaaatttattagtgatacaaatgaagttgacataccacctaacactcgagttggcaccaaacgctatatgcctccagaagtgttggacgagagcttgaacagaaatcacttccagtcttacatcatggctgacatgtatagttttggcctcatcctttgggaggttgctaggagatgtgtatcaggaggtatagtggaagaataccagcttccttatcatgacctagtgcccagtgacccctcttatgaggacatgagggagattgtgtgcatcaagaagttacgcccctcattcccaaaccggtggagcagtgatgagtgtctaaggcagatgggaaaactcatgacagaatgctgggctcacaatcctgcatcaaggctgacagccctgcgggttaagaaaacacttgccaaaatgtcagagtcccaggacattaaactctgataggagaggaaaagtaagcatctctgcagaaagccaacaggtactcttctgtttgtgggcagagcaaaagacatcaaataagcatccacagtacaagccttgaacatcgtcctgcttcccagtgggttcagacctcacctctca

SEQ ID NO: 548 - DNA, 567 bp, Homo sapiens
agctgagctgtattaggcaaccacagtctgggctgcatttcttaactgctgaataacatatcacaggtgcaggattagtgctgcctacggtgctgggctttttagtggaaacccctagcaattctgtgcctcctcctcatgtctctcatcctagggagcctggcaaccatatatcaagcgtacagaaatcaaaacaaacttccttgataacatgcttttgcgaagtgcaggaaaattaaatgtgggcaccaagaaagaggatggtgagagtacagcccccaccccccgtccaaaggtcttgcgttgtaaatgccaccaccattgtccagaagactcagtcaacaatatttgcagcacagacggatattgtttcacgatgatagaagaggatgactctgggttgcctgtggtcacttctggttgcctaggactagaaggctcagattttcagtgtcgggtaaggacactcccattcctcatcaaagaagatcaattgaatgctgcacagaaaggaacgaatgtaataaagacctacaccctacactgcctccattgaaaaacagaggt

SEQ ID NO: 549 - DNA, 731 bp, Homo sapiens
gtctgagcagctgagaactttgccggagtattaccacggtgttcagtaacacagacctgtgccatgagcaagtaaagcactgagcaagtgtcagggtcaatatttatagaccactacgtagctgccttgcatagagagaaaacgggagagtaacatgcacacagagggcaaggaaagaaagactgcagtggagggaatgttaatttccaattttttctgaaaatgtattctttctaactgtcaggttcagacttctgctgattcataaccatttggctctgagctatgacaagagaggaaacaaaaagttaaacaagcaagcctgccataagtgagaagcaaacttccttgataacatgcttttgcgaagtgcaggaaaattaaatgtgggcaccaagaaagaggatggtgagagtacagcccccaccccccgtccaaaggtcttgcgttgtaaatgccaccaccattgtccagaagactcagtcaacaatatttgcagcacagacggatattgtttcacgatgatagaagaggatgactctgggttgcctgtggtcacttctggttgcctaggactagaaggctcagattttcagtgtcgggacactcccattcctcatcaaagaagatcaattgaatgctgcacagaaaggaacgaatgtaataaagacctacaccctacactgcctccattgaaaaacagagattttgttgatggacctatacaccac

SEQ ID NO: 550 - DNA, 1764 bp, Homo sapiens; identical to SEQ ID NO: 547

SEQ ID NO: 551 - DNA, 1679 bp, Homo sapiens
gctaatgaggagggctgcctgctgggtaagaatgttgttggtggcagagccgttttgtgtactgctgttgagaatgccgggtacattcacaagacgtttcctgcgtgtggtaggaacagctctcaagcaccaatttcatattgtgtcctatcacaaacttccttgataacatgcttttgcgaagtgcaggaaaattaaatgtgggcaccaagaaagaggatggtgagagtacagcccccaccccccgtccaaaggtcttgcgttgtaaatgccaccaccattgtccagaagactcagtcaacaatatttgcagcacagacggatattgtttcacgatgatagaagaggatgactctgggttgcctgtggtcacttctggttgcctaggactagaaggctcagattttcagtgtcgggacactcccattcctcatcaaagaagatcaattgaatgctgcacagaaaggaacgaatgtaataaagacctacaccctacactgcctccattgaaaaacagagattttgttgatggacctatacaccacagggctttacttatatctgtgactgtctgtagtttgctcttggtccttatcatattattttgttacttccggtataaaagacaagaaaccagacctcgatacagcattgggttagaacaggatgaaacttacattcctcctggagaatccctgagagacttaattgagcagtctcagagctcaggaagtggatcaggcctccctctgctggtccaaaggactatagctaagcagattcagatggtgaaacagattggaaaaggtcgctatggggaagtttggatgggaaagtggcgtggcgaaaaggtagctgtgaaagtgttcttcaccacagaggaagccagctggttcagagagacagaaatatatcagacagtgttgatgaggcatgaaaacattttgggtttcattgctgcagatatcaaagggacagggtcctggacccagttgtacctaatcacagactatcatgaaaatggttccctttatgattatctgaagtccaccaccctagacgctaaatcaatgctgaagttagcctactcttctgtcagtggcttatgtcatttacacacagaaatctttagtactcaaggcaaaccagcaattgcccatcgagatctgaaaagtaaaaacattctggtgaagaaaaatggaacttgctgtattgctgacctgggcctggctgttaaatttattagtgatacaaatgaagttgacataccacctaacactcgagttggcaccaaacgctatatgcctccagaagtgttggacgagagcttgaacagaaatcacttccagtcttacatcatggctgacatgtatagttttggcctcatcctttgggaggttgctaggagatgtgtatcaggaggtatagtggaagaataccagcttccttatcatgacctagtgcccagtgacccctcttatgaggacatgagggagattgtgtgcatcaagaagttacgcccctcattcccaaaccggtggagcagtgatgagtgtctaaggcagatgggaaaactcatgacagaatgctgggctcacaatcctgcatcaaggctgacagccctgcgggttaagaaaacacttgccaaaatgtcagagtcccaggacattaaactctga

SEQ ID NO: 552 - DNA, 5567 bp, Homo sapiens
gcagccgggcgcggggcgcggagtcggcggggcctcgcgggacgccgggcagtgcggagaccgcggcgctgaggacgcgggagccgggagcgcagccgcggggtggagttcagcctactctttcttagatgtgaaaggaaaggaagatcatttcatgccttgttgataaaggttcagacttctgctgattcataaccatttggctctgagctatgacaagagaggaaacaaaaagttaaacaagcaagcctgccataagtgagaagcaaacttccttgataacatgcttttgcgaagtgcaggaaaattaaatgtgggcaccaagaaagaggatggtgagagtacagcccccaccccccgtccaaaggtcttgcgttgtaaatgccaccaccattgtccagaagactcagtcaacaatatttgcagcacagacggatattgtttcacgatgatagaagaggatgactctgggttgcctgtggtcacttctggttgcctaggactagaaggctcagattttcagtgtcgggacactcccattcctcatcaaagaagatcaattgaatgctgcacagaaaggaacgaatgtaataaagacctacaccctacactgcctccattgaaaaacagagattttgttgatggacctatacaccacagggctttacttatatctgtgactgtctgtagtttgctcttggtccttatcatattattttgttacttccggtataaaagacaagaaaccagacctcgatacagcattgggttagaacaggatgaaacttacattcctcctggagaatccctgagagacttaattgagcagtctcagagctcaggaagtggatcaggcctccctctgctggtccaaaggactatagctaagcagattcagatggtgaaacagattggaaaaggtcgctatggggaagtttggatgggaaagtggcgtggcgaaaaggtagctgtgaaagtgttcttcaccacagaggaagccagctggttcagagagacagaaatatatcagacagtgttgatgaggcatgaaaacattttgggtttcattgctgcagatatcaaagggacagggtcctggacccagttgtacctaatcacagactatcatgaaaatggttccctttatgattatctgaagtccaccaccctagacgctaaatcaatgctgaagttagcctactcttctgtcagtggcttatgtcatttacacacagaaatctttagtactcaaggcaaaccagcaattgcccatcgagatctgaaaagtaaaaacattctggtgaagaaaaatggaacttgctgtattgctgacctgggcctggctgttaaatttattagtgatacaaatgaagttgacataccacctaacactcgagttggcaccaaacgctatatgcctccagaagtgttggacgagagcttgaacagaaatcacttccagtcttacatcatggctgacatgtatagttttggcctcatcctttgggaggttgctaggagatgtgtatcaggaggtatagtggaagaataccagcttccttatcatgacctagtgcccagtgacccctcttatgaggacatgagggagattgtgtgcatcaagaagttacgcccctcattcccaaaccggtggagcagtgatgagtgtctaaggcagatgggaaaactcatgacagaatgctgggctcacaatcctgcatcaaggctgacagccctgcgggttaagaaaacacttgccaaaatgtcagagtcccaggacattaaactctgataggagaggaaaagtaagcatctctgcagaaagccaacaggtactcttctgtttgtgggcagagcaaaagacatcaaataagcatccacagtacaagccttgaacatcgtcctgcttcccagtgggttcagacctcacctctcagggagcgacctgggcaaagacagagaagctcccagaaggagagattgatccatgtctgtttgtaggacggagaaaccgcttgggtaacttgttcaagatatgatgcatgttgctttctaagaaagccctgtattttgtgattgcctttttttttttttaagatgctttcattttgccaaaataaaacagataatgtggatggtttaagggttatagtattatagtttaaataataacaacaaaattcttcccaggaactctgctggaaggtaaattaaaatacttgtttttccattggtaaaatattgttgcactctgtgaaccaaaagacagtctaagttggaggacatagaacggaactcatcttaaacatactccccaccccgtcttggcctcctcagaccactttggccatccctgcatttggggccgctatggtaatgtgaatgcactgggtacaaacaccgcctgtctaggaccacatttggaattcctgcaggtggccttttgcagcttcaggcaatatggaacaaatgaaggtttatgtgactctaatagaagtaattgttgataggtgttcttcagatccacttctgtttctgattgagttaggcatctctttcatggtaaaacccttttcattaaacacaaagaaagcttttttttttttttttttttttttttttttttaatgtgcagaggattgacctgtgcatgcttttgatctctcattcaaaggatcaatattaaataaaattgtcatgagctgtgttgaagacagggtgctttcaaatagaggtaatttgctcttgtgttgtaagaggaacatgtcaacaaagataggaaatgagggtgatcgtgcagatggcttgtatcttatatatgcaaaggagccaatctcagaagcacaaagaaaaaagtgtgcataccttattttgtacagataaagatgatgtctttttgttattgtctgtctgttttgtatgtgtctgagataagggatagagaggaaacatccgtcaggctaatttaactacattttattttaaaaatagagaaacataacctctagatgggacagcagaggacagttagtagaggccacaaactgttatgggctgctgtgttttgttctaaaatcaatatggttggagcatgtatatcttaggtgatcatttcacatcttaggaatgcctactcattttattttattctagtgatgctcaattcactatttaatttattatattttctcttctgtggcacttatacaaaatatctcttcacctacttagttctacagggttttaactttggagcaacatgaataaaatcatcgagaaggccaatattgtttagcaacatgaatacaatacagtttaaagttgtacacatcctgctcaactttattcatatacatttcctttctgtggttttcttttgcttcttagaaattctgttagtggttagtaaagaatttgaaagtactttctccttgctgtttttttttttttttaagacattcctcccagaatactccagggggcagtgttttataacacattttccccactgggtgattgaaggatggaggatttttgaaaatttgacagctacatgaaacatgagaaaacattttcctcacttctgaagtcggtttgcagctggtaacttgttcatccagaaaacattctaaagcaatgagactttgtgagctgtgcttacagtttgggagaatcatgaagattctttctatattttgcatttacttcccagtgcttcatagctgcattttgtttgtaactaagacagaagaatttcgtaatccttgaaattgaaaaaaaaaaaattgtgtttttaaagagtgaaaacagttagaaaacaagtagaactgtaatcagaacgctgcttcaattgatattaaaaataacctcaataataatgtaaaggttcctttctcttgtgtcagttatattcttagggatagcctagaaggaatatatggttagaactaagtgtgactaatcatctgagccttgaagagaaacttcagtgcctctaaacagatcatctacaaaacaacaggtaaacatttatgccagttaagtgggtcatgtttttgtttcttgggtttttcctaaatttaagtgaggttgggcttaccttgtagataaaattatgttttctttttggtaaatacttgaacgtggataacgtcaaatcagaatattttgtgaggaggtgatgatttgaaattaagctagatttctagggaggtgttggttccaatgaaggatgggaagaaattaaaatagtcttcaaacttcttccttattatatttggttgctttggaaaagattggtcctatcctcaatctaatttattcactattaatattttaaaaacattcctgagatacttaaaaagacccacttagcgattatagttgctcaatgaaacaagaatttatttatgcatagatttttctctgtatcttaccaaaatccactttacttagataacactaaattgttcttaaagactactcatttcccaataatcctttatgatttcaaaatttctagtggctcagaagtgaattttattttatttgtctttcacttgaataaatgagaacccagaaattaataatgttgtttattgcttactgtcaggactatttcaaagactaagaagagtttcttctaacccctccctctcaaaggaatcctaaattattagttgttagataagttttgtatgctaagatattcaggtttatagtttatgtatgtgtgtatatatataaatatatatgtatatataaatattatgttcagtttggagtctggcacaactccattatgtggattagagagtaagatattatggatgataaagtactaaatgaaacataatatttatttataaaagtgtgtagattgttaaatcacaaaaagagtgctatgaccattatgtatgaggaaacaggcctttgacctcctggaaagcactgctcaaaagtcattagtgcccatttttgaattccccaaacagaaagcttcttagaaaacatgctgagattttatttacagggaattctttgacacatttcaattggtgtgtagtcaagtatagcaagtacttaataatgactgaatttcatgttcctacagtcatacatattcattagaagttttatgttgttggtctgatctgattcttctttgtttgtgggtggaacggcactgagagaagtatagttttttaaacttgaacatgttcagtagttacattgccttagaaaacccagacacatagcagtggaaatgaaagaaatggcatcagaagtgacttaatttagcaattgtgattcctcttgtaaaacaaaacaaaaaaacaatgccatattttttggagaaaagttggcaatataggggtttcgttgtctgtttcacaagaagactcatttgttcttttgggggaaccagtgccttacagattttgtatatactgtaattattcaggactagggaacaaacaattgtattgtatttgttacagattgtatatggctttgttttaacattcccctaaataaaatggcttcattctccccttggaaaaaaa

SEQ ID NO: 553 - DNA, 5506 bp, Homo sapiens
ggactttagaagccgttgctgccctctctgtcacctgaagcggggccctctcccatcccacccttgccccgcctccctgcccccaccgggccggccctgcccgccgccggaccctggcatgtcaagacctggtccgcgcctgcctgcccagcccgcggaaccccggcggccccgcgagctaggatgaggggccaggccgccgccccgggccccgtctggatcctcgccccgctgctactgctgctgctgctgctgggacgccgcgcgcgggcggccgccggagcagacgcggggcccgggcccgagccgtgcgccacgctggtgcagggaaagttcttcggctacttctccgcggccgccgtgttcccggccaacgcctcgcgctgctcctggacgctacgcaacccggacccgcggcgctacactctctacatgaaggtggccaaggcgcccgtgccctgcagcggccccggccgcgtgcgcacctaccagttcgactccttcctcgagtccacgcgcacctacctgggcgtggagagcttcgacgaggtgctgcggctctgcgacccctccgcacccctggccttcctgcaggccagcaagcagttcctgcagatgcggcgccagcagccgccccagcacgacgggctccggccccgggccgggccgccgggccccaccgacgacttctccgtggagtacctggtggtggggaaccgcaaccccagccgtgccgcctgccagatgctgtgccgctggctggacgcgtgtctggccggtagtcgcagctcgcacccctgcgggatcatgcagaccccctgcgcctgcctgggcggcgaggcgggcggccctgccgcgggacccctggccccccgcggggatgtctgcttgagagatgcggtggctggtggccctgaaaactgcctcaccagcctgacccaggaccggggcgggcacggcgccacaggcggctggaagctgtggtccctgtggggcgaatgcacgcgggactgcgggggaggcctccagacgcggacgcgcacctgcctgcccgcgccgggcgtggagggcggcggctgcgagggggtgctggaggagggtcgccagtgcaaccgcgaggcctgcggccccgctgggcgcaccagctcccggagccagtccctgcggtccacagatgcccggcggcgcgaggagctgggggacgagctgcagcagtttgggttcccagccccccagaccggtgacccagcagccgaggagtggtccccgtggagcgtgtgctccagcacctgcggcgagggctggcagacccgcacgcgcttctgcgtgtcctcctcctacagcacgcagtgcagcggacccctgcgcgagcagcggctgtgcaacaactctgccgtgtgcccagtgcatggtgcctgggatgagtggtcgccctggagcctctgctccagcacctgtggccgtggctttcgggatcgcacgcgcacctgcaggcccccccagtttgggggcaacccctgtgagggccctgagaagcaaaccaagttctgcaacattgccctgtgccctggccgggcagtggatggaaactggaatgagtggtcgagctggagcgcctgctccgccagctgctcccagggccgacagcagcgcacgcgtgaatgcaacgggccttcctacgggggtgcggagtgccagggccactgggtggagacccgagactgcttcctgcagcagtgcccagtggatggcaagtggcaggcctgggcgtcatggggcagttgcagcgtcacgtgtggggctggcagccagcgacgggagcgtgtctgctctgggcccttcttcgggggagcagcctgccagggcccccaggatgagtaccggcagtgcggcacccagcggtgtcccgagccccatgagatctgtgatgaggacaactttggtgctgtgatctggaaggagaccccagcgggagaggtggctgctgtccggtgtccccgcaacgccacaggactcatcctgcgacggtgtgagctggacgaggaaggcatcgcctactgggagccccccacctacatccgctgtgtttccattgactacagaaacatccagatgatgacccgggagcacctggccaaggctcagcgagggctgcctggggagggggtctcggaggtcatccagacactggtggagatctctcaggacgggaccagctacagtggggacctgctgtccaccatcgatgtcctgaggaacatgacagagattttccggagagcgtactacagccccacccctggggacgtacagaactttgtccagatccttagcaacctgttggcagaggagaatcgggacaagtgggaggaggcccagctggcgggccccaacgccaaggagctgttccggctggtggaggactttgtggacgtcatcggcttccgcatgaaggacctgagggatgcataccaggtgacagacaacctggttctcagcatccataagctcccagccagcggagccactgacatcagcttccccatgaagggctggcgggccacgggtgactgggccaaggtgccagaggacagggtcactgtgtccaagagtgtcttctccacggggctgacagaggccgatgaagcatccgtgtttgtggtgggcaccgtgctctacaggaacctgggcagcttcctggccctgcagaggaacacgaccgtcctgaattctaaggtgatctccgtgactgtgaaacccccgcctcgctccctgcgcacacccttggagatcgagtttgcccacatgtataatggcaccaccaaccagacctgtatcctgtgggatgagacggatgtaccctcctcctccgcccccccgcagctcgggccctggtcgtggcgcggctgccgcacggtgcccctcgacgccctccggacgcgctgcctctgtgaccggctctccaccttcgccatcttagcccagctcagcgccgacgcgaacatggagaaggcgactctgccgtcggtgacgctcatcgtgggctgtggcgtgtcctctctcaccctgctcatgctggtcatcatctacgtgtccgtgtggaggtacattcgctcagagcgttctgtcatcctcatcaacttctgcctgtccatcatctcctccaatgccctcatcctcatcgggcagacccagacccgcaacaaggtggtgtgcacgctggtggccgccttcctgcacttcttcttcctgtcctccttctgctgggtgctcaccgaggcctggcagtcctacatggcggtgacgggccacctccggaaccgcctcatccgcaagcgcttcctctgcctgggctgggggctccctgcactggttgtggccatttctgtgggattcaccaaggccaaagggtacagcaccatgaactactgctggctctccctggaggggggactgctctatgccttcgtgggacctgccgctgccgttgtgctggtgaacatggtcattgggatcctggtgttcaacaagctcgtgtccaaagacggcatcacggacaagaagctgaaggagcgggcaggggcctccctgtggagctcctgcgtggtgctgccgctgctggcgctgacctggatgtcggctgtgctcgccgtcaccgaccgccgctccgccctcttccagatcctcttcgctgtcttcgactcgctggagggcttcgtcatcgtcatggtgcactgtatcctccgtagagaggtccaggacgctgtgaaatgccgtgtggttgaccggcaggaggagggcaacggggactcagggggctccttccagaacggccacgcccagctcatgaccgacttcgagaaggacgtggatctggcctgtagatcagtgctgaacaaggacatcgcggcctgccgcactgccaccatcacgggcacactgaagcggccgtctctgcccgaggaggagaagctgaagctggcccatgccaaggggccgcccaccaatttcaacagcctgccggccaacgtgtccaagctgcacctgcacggctcaccccgctatcccggcgggcccctgcccgacttccccaaccactcactgaccctcaagagggacaaggcgcccaagtcctccttcgtcggtgacggggacatcttcaagaagctggactcggagctgagccgggcccaggagaaggctctggacacgagctacgtgatcctgcccacggccacggccacgctgcggcccaagcccaaggaggagcccaagtacagcatccacattgaccagatgccgcagacccgcctcatccacctcagcacggcccccgaggccagcctccccgcccgcagcccgccctcccgccagccccccagcggcgggccccccgaggcaccccctgcccagcccccaccgcctccgcccccaccgccaccacctccccagcagcccctgcccccaccgcccaatctggagccggcaccccccagcctgggggatcccggggagcctgccgcccatccgggacccagcacggggcccagcaccaagaacgagaatgtcgccaccttgtctgtgagctccctggagcggcggaagtcgcggtatgcagaactggactttgagaagatcatgcacacccggaagcggcaccaagacatgttccaggacctgaaccggaagctgcagcacgcagcggagaaggacaaggaggtgctggggccggacagcaagccggaaaagcagcagacgcccaacaagaggccctgggagagcctccggaaagcccacgggacgcccacgtgggtgaagaaggagctggagccgctgcagccgtcgccgctggagcttcgcagcgtggagtgggagaggtcgggcgccacgatcccgctggtgggccaggacatcatcgacctccagaccgaggtctgagcgggtgggcggcggccacgcactgggccacggaggagggatgctgctccgcccgctcctgccgcagacgggcacagacacgctcgcgggcagcgggccaggcccgcaccccggcctcagggcgctcagacggcggccaggcacagggcccgcagtgctgggaccagagccagatgcaggacaggaggcggcccggccagcgggcacagggcaccagaggccgaaggtgcctcagactccgccctcctcgggccgaggcccagcgggcagatgggcggacggctgtggaccgtggacaggcccagcgcggccagcgtcccagggtacccgcctgagctcctgctgcggaggagctgcctgcttggcccggccggcctggcaccgttttttaaacacccccatccctcgggaagcagccagctccccacaccttccagggccctaggcccctcctagacccaggtggagggcacagccctccgaccctcatggcccccaggggcaggactgagtcccctccaggaagaagcaggggggaatctattttttctctccttttcttttcttc

SEQ ID NO: 554 - DNA, 6241 bp, Homo sapiens
gatgtaatccgtaatgcagtctctggctcccgattcgggatccagtttcagagagcgagagattggggagcgccggcagccgggtggggggaagcagctctcgcctctctcctcctccttctcctcgtcctcggcctcctcctcctccccgcgccgccccgcccccggctcggcttggctcgcccccccccccccctcgccaggaaggggaaaaaaggcgagaagagccgggcaggcgagaggagcggagcggcggcggcggccggagagggagcggcgggcgcaggcggcggcggcgggcgcggcgttggcggcggccccggcggagcgagcgcggagccggagagccgggagcacaggcggccgcgccgcgtcctggcccggcccgggcccgcgcgccagcatcgtccgcagcgcgggcatccggaccctccgggcgcccggggggctccagcaggcgcgggggaacgggagggggcctgcgtgcgccggcgggtgctctccagggggcgtcccggcgaggcccagagcgggccgggggcggcggcggctggaggagccccccccacctccggtcgggcgcccggctcagccgccggcgacgcgaggcgctcgcggggatttgcaactcgccggatcgagtcctcgccggcggggccgctgctgctggggaagctgctgctggtggccacaggctggcaccagggccctggactttagaagccgttgctgccctctctgtcacctgaagcggggccctctcccatcccacccttgccccgcctccctgcccccaccgggccggccctgcccgccgccggaccctggcatgtcaagacctggtccgcgcctgcctgcccagcccgcggaaccccggcggccccgcgagctaggatgaggggccaggccgccgccccgggccccgtctggatcctcgccccgctgctactgctgctgctgctgctgggacgccgcgcgcgggcggccgccggagcagacgcggggcccgggcccgagccgtgcgccacgctggtgcagggaaagttcttcggctacttctccgcggccgccgtgttcccggccaacgcctcgcgctgctcctggacgctacgcaacccggacccgcggcgctacactctctacatgaaggtggccaaggcgcccgtgccctgcagcggccccggccgcgtgcgcacctaccagttcgactccttcctcgagtccacgcgcacctacctgggcgtggagagcttcgacgaggtgctgcggctctgcgacccctccgcacccctggccttcctgcaggccagcaagcagttcctgcagatgcggcgccagcagccgccccagcacgacgggctccggccccgggccgggccgccgggccccaccgacgacttctccgtggagtacctggtggtggggaaccgcaaccccagccgtgccgcctgccagatgctgtgccgctggctggacgcgtgtctggccggtagtcgcagctcgcacccctgcgggatcatgcagaccccctgcgcctgcctgggcggcgaggcgggcggccctgccgcgggacccctggccccccgcggggatgtctgcttgagagatgcggtggctggtggccctgaaaactgcctcaccagcctgacccaggaccggggcgggcacggcgccacaggcggctggaagctgtggtccctgtggggcgaatgcacgcgggactgcgggggaggcctccagacgcggacgcgcacctgcctgcccgcgccgggcgtggagggcggcggctgcgagggggtgctggaggagggtcgccagtgcaaccgcgaggcctgcggccccgctgggcgcaccagctcccggagccagtccctgcggtccacagatgcccggcggcgcgaggagctgggggacgagctgcagcagtttgggttcccagccccccagaccggtgacccagcagccgaggagtggtccccgtggagcgtgtgctccagcacctgcggcgagggctggcagacccgcacgcgcttctgcgtgtcctcctcctacagcacgcagtgcagcggacccctgcgcgagcagcggctgtgcaacaactctgccgtgtgcccagtgcatggtgcctgggatgagtggtcgccctggagcctctgctccagcacctgtggccgtggctttcgggatcgcacgcgcacctgcaggcccccccagtttgggggcaacccctgtgagggccctgagaagcaaaccaagttctgcaacattgccctgtgccctggccgggcagtggatggaaactggaatgagtggtcgagctggagcgcctgctccgccagctgctcccagggccgacagcagcgcacgcgtgaatgcaacgggccttcctacgggggtgcggagtgccagggccactgggtggagacccgagactgcttcctgcagcagtgcccagtggatggcaagtggcaggcctgggcgtcatggggcagttgcagcgtcacgtgtggggctggcagccagcgacgggagcgtgtctgctctgggcccttcttcgggggagcagcctgccagggcccccaggatgagtaccggcagtgcggcacccagcggtgtcccgagccccatgagatctgtgatgaggacaactttggtgctgtgatctggaaggagaccccagcgggagaggtggctgctgtccggtgtccccgcaacgccacaggactcatcctgcgacggtgtgagctggacgaggaaggcatcgcctactgggagccccccacctacatccgctgtgtttccattgactacagaaacatccagatgatgacccgggagcacctggccaaggctcagcgagggctgcctggggagggggtctcggaggtcatccagacactggtggagatctctcaggacgggaccagctacagtggggacctgctgtccaccatcgatgtcctgaggaacatgacagagattttccggagagcgtactacagccccacccctggggacgtacagaactttgtccagatccttagcaacctgttggcagaggagaatcgggacaagtgggaggaggcccagctggcgggccccaacgccaaggagctgttccggctggtggaggactttgtggacgtcatcggcttccgcatgaaggacctgagggatgcataccaggtgacagacaacctggttctcagcatccataagctcccagccagcggagccactgacatcagcttccccatgaagggctggcgggccacgggtgactgggccaaggtgccagaggacagggtcactgtgtccaagagtgtcttctccacggggctgacagaggccgatgaagcatccgtgtttgtggtgggcaccgtgctctacaggaacctgggcagcttcctggccctgcagaggaacacgaccgtcctgaattctaaggtgatctccgtgactgtgaaacccccgcctcgctccctgcgcacacccttggagatcgagtttgcccacatgtataatggcaccaccaaccagacctgtatcctgtgggatgagacggatgtaccctcctcctccgcccccccgcagctcgggccctggtcgtggcgcggctgccgcacggtgcccctcgacgccctccggacgcgctgcctctgtgaccggctctccaccttcgccatcttagcccagctcagcgccgacgcgaacatggagaaggcgactctgccgtcggtgacgctcatcgtgggctgtggcgtgtcctctctcaccctgctcatgctggtcatcatctacgtgtccgtgtggaggtacattcgctcagagcgttctgtcatcctcatcaacttctgcctgtccatcatctcctccaatgccctcatcctcatcgggcagacccagacccgcaacaaggtggtgtgcacgctggtggccgccttcctgcacttcttcttcctgtcctccttctgctgggtgctcaccgaggcctggcagtcctacatggcggtgacgggccacctccggaaccgcctcatccgcaagcgcttcctctgcctgggctgggggctccctgcactggttgtggccatttctgtgggattcaccaaggccaaagggtacagcaccatgaactactgctggctctccctggaggggggactgctctatgccttcgtgggacctgccgctgccgttgtgctggtgaacatggtcattgggatcctggtgttcaacaagctcgtgtccaaagacggcatcacggacaagaagctgaaggagcgggcaggggcctccctgtggagctcctgcgtggtgctgccgctgctggcgctgacctggatgtcggctgtgctcgccgtcaccgaccgccgctccgccctcttccagatcctcttcgctgtcttcgactcgctggagggcttcgtcatcgtcatggtgcactgtatcctccgtagagaggtccaggacgctgtgaaatgccgtgtggttgaccggcaggaggagggcaacggggactcagggggctccttccagaacggccacgcccagctcatgaccgacttcgagaaggacgtggatctggcctgtagatcagtgctgaacaaggacatcgcggcctgccgcactgccaccatcacgggcacactgaagcggccgtctctgcccgaggaggagaagctgaagctggcccatgccaaggggccgcccaccaatttcaacagcctgccggccaacgtgtccaagctgcacctgcacggctcaccccgctatcccggcgggcccctgcccgacttccccaaccactcactgaccctcaagagggacaaggcgcccaagtcctccttcgtcggtgacggggacatcttcaagaagctggactcggagctgagccgggcccaggagaaggctctggacacgagctacgtgatcctgcccacggccacggccacgctgcggcccaagcccaaggaggagcccaagtacagcatccacattgaccagatgccgcagacccgcctcatccacctcagcacggcccccgaggccagcctccccgcccgcagcccgccctcccgccagccccccagcggcgggccccccgaggcaccccctgcccagcccccaccgcctccgcccccaccgccaccacctccccagcagcccctgcccccaccgcccaatctggagccggcaccccccagcctgggggatcccggggagcctgccgcccatccgggacccagcacggggcccagcaccaagaacgagaatgtcgccaccttgtctgtgagctccctggagcggcggaagtcgcggtatgcagaactggactttgagaagatcatgcacacccggaagcggcaccaagacatgttccaggacctgaaccggaagctgcagcacgcagcggagaaggacaaggaggtgctggggccggacagcaagccggaaaagcagcagacgcccaacaagaggccctgggagagcctccggaaagcccacgggacgcccacgtgggtgaagaaggagctggagccgctgcagccgtcgccgctggagcttcgcagcgtggagtgggagaggtcgggcgccacgatcccgctggtgggccaggacatcatcgacctccagaccgaggtctgagcgggtgggcggcggccacgcactgggccacggaggagggatgctgctccgcccgctcctgccgcagacgggcacagacacgctcgcgggcagcgggccaggcccgcaccccggcctcagggcgctcagacggcggccaggcacagggcccgcagtgctgggaccagagccagatgcaggacaggaggcggcccggccagcgggcacagggcaccagaggccgaaggtgcctcagactccgccctcctcgggccgaggcccagcgggcagatgggcggacggctgtggaccgtggacaggcccagcgcggccagcgtcccagggtacccgcctgagctcctgctgcggaggagctgcctgcttggcccggccggcctggcaccgttttttaaacacccccatccctcgggaagcagccagctccccacaccttccagggccctaggcccctcctagacccaggtggagggcacagccctccgaccctcatggcccccaggggcaggactgagtcccctccaggaagaagcaggggggaatctattttttctctccttttcttttcttcaataaaaagaattaaaaacccatc

SEQ ID NO: 555 - DNA, 5499 bp, Homo sapiens
cctctggcggcccgccgtcccagacgcgggaagagcttggccggtttcgagtcgctggcctgcagcttccctgtggtttcccgaggcttccttgcttcccgctctgcgaggagcctttcatccgaaggcgggacgatgccggataatcggcagccgaggaaccggcagccgaggatccgctccgggaacgagcctcgttccgcgcccgccatggaaccggatggtcgcggtgcctgggcccacagtcgcgccgcgctcgaccgcctggagaagctgctgcgctgctcgcgttgtactaacattctgagagagcctgtgtgtttaggaggatgtgagcacatcttctgtagtaattgtgtaagtgactgcattggaactggatgtccagtgtgttacaccccggcctggatacaagacttgaagataaatagacaactggacagcatgattcaactttgtagtaagcttcgaaatttgctacatgacaatgagctgtcagatttgaaagaagataaacctaggaaaagtttgtttaatgatgcaggaaacaagaagaattcaattaaaatgtggtttagccctcgaagtaagaaagtcagatatgttgtgagtaaagcttcagtgcaaacccagcctgcaataaaaaaagatgcaagtgctcagcaagactcatatgaatttgtttccccaagtcctcctgcagatgtttctgagagggctaaaaaggcttctgcaagatctggaaaaaagcaaaaaaagaaaactttagctgaaatcaaccaaaaatggaatttagaggcagaaaaagaagatggtgaatttgactccaaagaggaatctaagcaaaagctggtatccttctgtagccaaccatctgttatctccagtcctcagataaatggtgaaatagacttactagcaagtggctccttgacagaatctgaatgttttggaagtttaactgaagtctctttaccattggctgagcaaatagagtctccagacactaagagcaggaatgaagtagtgactcctgagaaggtctgcaaaaattatcttacatctaagaaatctttgccattagaaaataatggaaaacgtggccatcacaatagactttccagtcccatttctaagagatgtagaaccagcattctgagcaccagtggagattttgttaagcaaacggtgccctcagaaaatataccattgcctgaatgttcttcaccaccttcatgcaaacgtaaagttggtggtacatcagggaggaaaaacagtaacatgtccgatgaattcattagtctttcaccaggtacaccaccttctacattaagtagttcaagttacaggcgagtgatgtctagtccctcagcaatgaagctgttgcccaatatggctgtgaaaagaaatcatagaggagagactttgctccatattgcttctattaagggcgacataccttctgttgaataccttttacaaaatggaagtgatccaaatgttaaagaccatgctggatggacaccattgcatgaagcttgcaatcatgggcacctgaaggtagtggaattattgctccagcataaggcattggtgaacaccaccgggtatcaaaatgactcaccacttcacgatgcagccaagaatgggcatgtggatatagtcaagctgttactttcctatggagcctccagaaatgctgttaatatatttggtctgcggcctgtcgattatacagatgatgaaagtatgaaatcgctattgctgctaccagagaagaatgaatcatcctcagctagccactgctcagtaatgaacactgggcagcgtagggatggacctcttgtacttataggcagtgggctgtcttcagaacaacagaaaatgctcagtgagcttgcagtaattcttaaggctaaaaaatatactgagtttgacagtacagtaactcatgttgttgttcctggtgatgcagttcaaagtaccttgaagtgtatgcttgggattctcaatggatgctggattctaaaatttgaatgggtaaaagcatgtctacgaagaaaagtatgtgaacaggaagaaaagtatgaaattcctgaaggtccacgcagaagcaggctcaacagagaacagctgttgccaaagctgtttgatggatgctacttctatttgtggggaaccttcaaacaccatccaaaggacaaccttattaagctcgtcactgcaggtgggggccagatcctcagtagaaagcccaagccagacagtgacgtgactcagaccatcaatacagtcgcataccatgcgagacccgattctgatcagcgcttctgcacacagtatatcatctatgaagatttgtgtaattatcacccagagagggttcggcagggcaaagtctggaaggctccttcgagctggtttatagactgtgtgatgtcctttgagttgcttcctcttgacagctgaatattataccagatgaacatttcaaattgaatttgcacggtttgtgagagcccagtcattgtactgtttttaatgttcacatttttacaaataggtagagtcattcatatttgtctttgaatcaaaaaaaaaaaaaaagtctaatgccagattaggaattcatgttatgtttaccatttagaagctgggattgcttttaaaggtttttctttttaaaattggcatgtttttgatttatcatgtctttctattcagattattgggtatcaaagattaatgaggacaccagaatcttggttaaatagacaagtggtatcattactgtttgagtcttttaatattctccatacctgccaccagtgaaaaaacttgccttttttttttttttttttttagtaaacagaatattatcaaacaatttattttggctttattgaaaaaagagtatttggtctaaatgtgccaccataggtgttaaattctcctatctgcaattgtctttatcctatattgtgttcatttcttttcttaataatttactttgttgtgtgtttctacactttcatccctgttttttatcttgtatatcatcaggaaattgtgatttaatcattaacattggtttttttgtgtgtgtggtaaaaatcaacactaggctcatggtacatatttttattctgtacatttgcttgtaactatcaatttgtaactctgtttatctactacatgtgtatatatacttagagcattttctctaacacattttaatgttagtattttttaaaaggtctgaccagtctagcaaattgtcagtccaacgtcattactttaaattaagaagcagtcttcttctggtaaaccttgttggtatttgtaaaataattttgaaggtcttaatttcttcctttgtaaaaggaaaaggttttttttaaagtttttaggttggcatggaggcagaagttggtgattacttgatttacaacagattttttccagatcatacaaaaggccatacagtaagtatagaagtaggtatggggagggcttactaatatcaaataggcaaggccttagtgagtgggcaggataccacctgagagtggccagatgtggggaggttactctgctctgggtgctctcattcatgaatcgacaaggatacattagattattttgaaacatttttttaagaagcagaattctttaataattccttcctagacattgaatatacttataaaattaaagacttggggaaggagacactgagagacttgccagtttggttcctcatgaacaaaagaggacagtttgataactaccagaatagaatatccctagttttaaaatagtgagaatctctgaagttcatcaacatcttaagatgcacttacttgaaagtttgagattctgtttatcatttgaaaacacattttgctttaattctttctttgacatgttgttttttcatatcaagaaatatatgaacaaaataataaccttttgaccctgaccttgctgggtgaattagctctgaaacactctctacaaccagtaatgcatttgtcccacatttcattctgatagaaaatgaacaccatagcaccaaacaaaaatccgaggcgttagataatgtctggattaaataatttaagactctctaggattttggttgtcattttttatttataacagactttaagtcactttctgttgcctcataggtcacattttagacaggtttgtgtctgttccttgcatctgaattcctgattgtaaagacacctatgaggtctcttagtttttgtcattcattttcttggtttatcacccctcccttctttttgttgtttttccctgactgttaagcagtttcatctttgcttttgttaaatatttgacagcagttagtttgtgttaagctcttgaaacttgtgattgtactttctgtgtagatatacatgtaattattttttatttttcaatcatagattcaagcttccttcttttttaccacaaatcattaaagttatttgtgtttccatatacctgtgtcttgtataaaattggcttattctgtgctgttgaatgaggctcaacatgacttggtgaggaagtctattaactaacaaaagcttatcttttttaacataatgctttttaattaattttgaataaaaatatttctaaagtgtactagatactttattaccttagattattccgaatacagtataactttgatagtttggaatagtcattaagaaacaattacacactgattgctttgtgtctctaaaagtgagaggctggtagcttttccacattctcatggctattttctagttctacttgaatttataactgtttccctttttccttgacagctgccactttgtagctatttttctgtctctgctaatactttaccatatctatctcaattgttttttcttttgacttgctgaaaaatagaaaccagatgggaagtatattagcattatgattgaaataagggtaaatgagcaatgtgtgaaggttttcactgacttcacctaaaagatagtttagctacttgaattttagtaaatagaatttttcctttatttcatcggtccccccacctttttttttttttgcacctgccttgtaaatttaatagttaagtgacctctgcctagaggatgatatttggggaggtttgatgtttcctgtgggaataagacgattcacaggtgagagtggggccacattagctgttattgtttccatgggtcagtgtggaaaatgcattaatcatattctaaacgttcatgggcctcattacagtcacaattgtctattctgtttcctaccctgaacacattaaaatggtaggaactaatgcttgtcttatttaattactaaaagccaccattttctttgatagattgagctacagattgtaaacttcatgtatttctttataagtcaacccttttcaaagatacgcacatcaaactgaatgaataaataaatattgagaagttg

SEQ ID NO: 556 - DNA, 2257 bp, Homo sapiens
agagcttggccggtttcgagtcgctggcctgcagcttccctgtggtttcccgaggcttccttgcttcccgctctgcgaggagcctttcatccgaaggcgggacgatgccggataatcggcagccgaggaaccggcagccgaggatccgctccgggaacgagcctcgttccgcgcccgccatggaaccggatggtcgcggtgcctgggcccacagtcgcgccgcgctcgaccgcctggagaagctgctgcgctgctcgcgttgtactaacattctgagagagcctgtgtgtttaggaggatgtgagcacatcttctgtagatttgaaagaagataaacctaggaaaagtttgtttaatgatgcaggaaacaagaagaattcaattaaaatgtggtttagccctcgaagtaagaaagtcagatatgttgtgagtaaagcttcagtgcaaacccagcctgcaataaaaaaagatgcaagtgctcagcaagactcatatgaatttgtttccccaagtcctcctgcagatgtttctgagagggctaaaaaggcttctgcaagatctggaaaaaagcaaaaaaagaaaactttagctgaaatcaaccaaaaatggaatttagaggcagaaaaagaagatggtgaatttgactccaaagaggaatctaagcaaaagctggtatccttctgtagccaaccatctgttatctccagtcctcagataaatggtgaaatagacttactagcaagtggctccttgacagaatctgaatgttttggaagtttaactgaagtctctttaccattggctgagcaaatagagtctccagacactaagagcaggaatgaagtagtgactcctgagaaggtctgcaaaaattatcttacatctaagaaatctttgccattagaaaataatggaaaacgtggccatcacaatagactttccagtcccatttctaagagatgtagaaccagcattctgagcaccagtggagattttgttaagcaaacggtgccctcagaaaatataccattgcctgaatgttcttcaccaccttcatgcaaacgtaaagttggtggtacatcagggaggaaaaacagtaacatgtccgatgaattcattagtctttcaccaggtacaccaccttctacattaagtagttcaagttacaggcgagtgatgtctagtccctcagcaatgaagctgttgcccaatatggctgtgaaaagaaatcatagaggagagactttgctccatattgcttctattaagggcgacataccttctgttgaataccttttacaaaatggaagtgatccaaatgttaaagaccatgctggatggacaccattgcatgaagcttgcaatcatgggcacctgaaggtagtggaattattgctccagcataaggcattggtgaacaccaccgggtatcaaaatgactcaccacttcacgatgcagccaagaatgggcatgtggatatagtcaagctgttactttcctatggagcctccagaaatgctgttaatatatttggtctgcggcctgtcgattatacagatgatgaaagtatgaaatcgctattgctgctaccagagaagaatgaatcatcctcagctagccactgctcagtaatgaacactgggcagcgtagggatggacctcttgtacttataggcagtgggctgtcttcagaacaacagaaaatgctcagtgagcttgcagtaattcttaaggctaaaaaatatactgagtttgacagtacagtaactcatgttgttgttcctggtgatgcagttcaaagtaccttgaagtgtatgcttgggattctcaatggatgctggattctaaaatttgaatgggtaaaagcatgtctacgaagaaaagtatgtgaacaggaagaaaagtatgaaattcctgaaggtccacgcagaagcaggctcaacagagaacattgccaaagctgtttgatggatgctacttctatttgtggggaaccttcaaacaccatccaaaggacaaccttattaagctcgtcactgcaggtgggggccagatcctcagtagaaagcccaagccagacagtgacgtgactcagaccatcaatacagtcgcataccatgcgagacccgattctgatcagcgcttctgcacacagtatatcatctatgaagatttgtgtaattatcacccagagagggttcggcagggcaaagtctggaaggctccttcgagctggtttatagactgtgtgatgtc

SEQ ID NO: 557 - DNA, 4563 bp, Homo sapiens
ccctttcttctcttccagggctccgctttatttgctctcagaagtcggtttcctttccttttcttcagtgaatcggagctcagagcgttgcttcggtttccctccagacagttaggaatctgaaataaacaggaaagcactatgtcttcaatgtggtctgaatatacaattggtggggtgaagatttactttccttataaagcttacccgtcacagcttgctatgatgaattctattctcagaggattaaacagcaagcaacattgtttgttggagagtcccacaggaagtggaaaaagcttagccttactttgttctgctttagcatggcaacaatctcttagtgggaaaccagcagatgagggcgtaagtgaaaaagctgaagtacaattgtcatgttgttgtgcatgccattcaaaggattttacaaacaatgacatgaaccaaggaacttcacgtcatttcaactatccaagcacaccaccttctgaaagaaatggcacttcatcaacttgtcaagactcccctgaaaaaaccactctggctgcaaagttatctgctaagaaacaggcatccatatacagagatgaaaatgatgattttcaagtagagaagaaaagaattcgacccttagaaactacacagcagattagaaaacgtcattgctttggaacagaagtacacaatttggatgcaaaagttgattcaggaaagactgtaaaactcaactctccactggaaaagataaactccttttcgccacagaaaccccctggccactgttctaggtgctgttgttctactaaacaaggaaacagtcaagagtcatcgaataccattaagaaggatcatacagggaaatccaagatacccaaaatatattttgggacacgcacacacaagcagattgctcagattactagagagctccggaggacggcatattcaggggttccaatgactattctttccagcagggatcatacttgtgtccatcctgaggtagtcggtaacttcaacagaaatgagaagtgcatggaattgctagatgggaaaaacggaaaatcctgctatttttatcatggagttcataaaattagtgatcagcacacattacagactttccaagggatgtgcaaagcctgggatatagaagaacttgtcagcctggggaagaaactaaaggcctgtccatattacacagcccgagaactaatacaagatgctgacatcatattttgtccctacaactatcttctagatgcacaaataagggaaagtatggatttaaatctgaaagaacaggttgtcattttagatgaagctcataacatcgaggactgtgctcgggaatcagcaagttacagtgtaacagaagttcagcttcggtttgctcgggatgaactagatagtatggtcaacaataatataaggaagaaagatcatgaacccctacgagctgtgtgctgtagcctcattaattggttagaagcaaacgctgaatatcttgtagaaagagattatgaatcagcttgtaaaatatggagtggaaatgaaatgctcttaactttacacaaaatgggtatcaccactgctacttttcccattttgcagggacatttttctgctgttcttcaaaaagaggaaaaaatctcaccaatttatggtaaagaggaggcaagagaagtacctgttattagtgcatcaactcaaataatgcttaaaggactttttatggtacttgactatctttttaggcaaaatagcagatttgcagatgattataaaattgcgattcaacagacttactcctggacaaatcagattgatatttcagacaaaaatgggttgttggttctaccaaaaaataagaaacgttcacgacagaaaactgcagttcatgtgctaaacttttggtgcttaaatccagctgtggccttttcagatattaatggcaaagttcagaccattgttttgacatctggtacattatcaccaatgaaatccttttcgtcagaacttggtgttacatttactatccagctggaggctaatcatatcattaaaaattcacaggtttgggttggtaccattgggtcaggccccaagggtcggaatctctgtgctaccttccagaatactgaaacatttgagttccaagatgaagtgggagcacttttgttatctgtgtgccagactgtgagccaaggaattttgtgtttcttgccatcttacaagttattagaaaaattaaaagaacgttggctctctactggtttatggcataatctggagttggtgaagacagtcattgtagaaccacagggaggagaaaaaacaaattttgatgaattactgcaggtgtactatgacgcaatcaaatacaaaggagagaaagatggagctctcctggtagcagtttgtcgtggtaaagtgagtgagggtctggatttctcagatgacaatgcccgtgctgtcataacaataggaattccttttccaaatgtgaaagatctacaggttgaactaaaacgacaatacaatgaccaccattcaaaattgagaggtcttctacctggccgtcagtggtatgaaattcaagcatacagggccttaaaccaggcccttggtagatgtattagacacagaaatgattggggagctcttattctagtggatgatcgctttaggaataacccaagtcgctatatatctggactttctaaatgggtacggcagcagattcagcaccattcaacctttgaaagtgcactggaatccttggctgaattttccaaaaagcatcaaaaagttcttaatgtatccataaaggacagaaccaatatacaggacaatgagtctacacttgaagtgacctctttaaagtacagtacctcaccttatttactggaagcagcaagtcatctatcaccagaaaattttgtggaagatgaagcaaagatatgtgtccaggaactacagtgtcctaaaattattaccaaaaattcacctctaccaagtagcattatctccagaaaggagaaaaatgatccagtattcctggaagaagcagggaaagcagaaaaaattgtgatttccagatccacaagcccaactttcaacaaacaaacaaagagagttagctggtcaagctttaattctttgggacagtattttactggtaaaataccgaaggcaacacctgagctcgggtcatcagagaatagtgcctctagtcctccccgtttcaaaacagagaagatggaaagtaaaactgttttgcccttcactgataaatgtgaatcctcaaatctgacagtaaacacatcgtttggatcatgccctcaatcagaaaccattatttcatcattaaagattgatgccacccttactagaaaaaatcattctgaacatccgctctgttctgaagaagccctggatccagacattgaattgtctctagtaagtgaagaagataaacagtccacttcaaatagagattttgaaacagaagcagaagatgaatctatctattttacacctgaactttatgatcctgaagatacagatgaagaaaaaaatgacctagctgaaactgatagaggaaatagattggctaacaattcagattgcattttagctaaagacctttttgaaattagaactataaaagaagtagattcagccagagaagtgaaagctgaggattgcatagatacaaagttgaatggaattctgcatattgaagaaagtaaaattgatgacattgatggtaatgtaaaaacaacttggataaatgaactggaactgggaaaaactcatgaaatagaaataaagaactttaaaccatctccttccaaaaataaaggcatgtttcctggttttaagtaataatacttaactctcaagctaagtaaaaatatgtcatcatgcttatgttaaactctgttgtaagtaataatttgtaaattgaataagtggcatactttttaaaaaactattttatgttcagaaatgtaaatgttattattcttgagtttttgggtttttttttttgagacagagtcttggtctgttgcccaggctggaatgcagtggtgtgctctgggctcactgcaaccttcacctccaggttcaagtgattctcctgcctcagccttctgagtagctgggactacaggtgtgcaccaccatgcccagctagtttttgtatttttagtagagatggggtttcaccatgttggccaggctggtctcgaactcctggcctcgtgatctgcccttctctgcctccctaagttgctgggattacaggtgtgagccacagtgcctggcccattcttgagttttgataaagtaattcatacaaagtactgtcctcaaataagtcttccttagctaaatgcaatttaaaattattcaaagatcctagggcacttctagtttcacgtaaatattcatattaggtggttctcttcatccatttgttttcacactgatacataaaaattaacagcagtctaatctagtgacacctcagtcatatttcgctatagattttac

SEQ ID NO: 558 - DNA, 1236 bp, Homo sapiens
gtgagcggcaacatggcgtccaggtctaagcggcgtgccgtggaaagtggggttccgcagccgccggatcccccagtccagcgcgacgaggaagaggaaaaagaagtcgaaaatgaggatgaagacgatgatgacagtgacaaggaaaaggatgaagaggacgaggtcattgacgaggaagtgaatattgaatttgaagcttattccctatcagataatgattatgacggaattaagaaattactgcagcagctttttctaaaggctcctgtgaacactgcagaactaacagatctcttaattcaacagaaccatattgggagtgtgattaagcaaacggatgtttcagaagacagcaatgatgatatggatgaagatgaggtttttggtttcataagccttttaaatttaactgaaagaaagggtacccagtgtgttgaacaaattcaagagttggttctacgcttctgtgagaagaactgtgaaaagagcatggttgaacagctggacaagtttttaaatgacaccaccaagcctgtgggccttctcctaagtgaaagattcattaatgtccctccacagatcgctctgcccatgtaccagcagcttcagaaagaactggcgggggcacacagaaccaataagccatgtgggaagtgctacttttaccttctgattagtaagacatttgtggaagcaggaaaaaacaattccaaaaagaaacctagcaacaaaaagaaagctgcgttaatgtttgcaaatgcagaggaagaatttttctatgagaaggcaattctcaagttcaactactcagtgcaggaggagagcgacacttgtctgggaggcaaatggtcttttgatgacgtaccaatgacgcccttgcgaactgtgatgttaattccaggcgacaagatgaacgaaatcatggataaactgaaagaatatctatctgtctaacccatttccaatggacagtgatgggcttgtttttgtaaaattaccagaaaactcagtggagatttactgaaaaactcagactttattcagattaagttcctctacaaaaagtagggttctgtcccatgtgtctctgacacatttacaaaataccagttttttaaaattttggtcaaattatgagtggttgatttaaaaacttttccaagaagaagaaaagcatggagtagtaatttaaagaactcaataaaaacttctattttttattttaaaataata

SEQ ID NO: 559 - DNA, 2338 bp, Homo sapiens
gtgagcggcaacatggcgtccaggtctaagcggcgtgccgtggaaagtggggttccgcagccgccggatcccccagtccagcgcgacgaggaagaggaaaaagaagtcgaaaatgaggatgaagacgatgatgacagtgacaaggaaaaggatgaagaggacgaggtcattgacgaggaagtgaatattgaatttgaagcttattccctatcagataatgattatgacggaattaagaaattactgcagcagctttttctaaaggctcctgtgaacactgcagaactaacagatctcttaattcaacagaaccatattgggagtgtgattaagcaaacggatgtttcagaagacagcaatgatgatatggatgaagatgaggtttttggtttcataagccttttaaatttaactgaaagaaagggtacccagtgtgttgaacaaattcaagagttggttctacgcttctgtgagaagaactgtgaaaagagcatggttgaacagctggacaagtttttaaatgacaccaccaagcctgtgggccttctcctaagtgaaagattcattaatgtccctccacagatcgctctgcccatgtaccagcagcttcagaaagaactggcgggggcacacagaaccaataagccatgtgggaagtgctacttttaccttctgattagtaagacatttgtggaagcaggaaaaaacaattccaaaaagaaacctagcaacaaaaagaaagctgcgttaatgtttgcaaatgcagaggaagaatttttctatgaggagcagggaaaacctgaggtgcttggaggtccagacacaagaagaggattggaaccagttccgatacagcacaatggttggtctgttcccccagtattagaataaattaaaacatacaagccaggatgaatgaagccaataggaaataaaaaacaggcacacaacattatttggggaaaaacacctctagtgacacattttcttcatctgcactgattatttcagcaaaagaaatctagtatgttttcatacatctgatgtataaatttgctgaactttgagttagttttcttaagataatttttcatattaagaaaattttccttttctaacctattaaaatacctcactatcatttcaaaaggttaaatgagttgatcactatctctgctctgtgctcctcaaaatataatttcaaatggatccgatctaaatctatacctagtgcagatttgcaaaaaaagaaaaggaatagtcattaaggatacctgttaccatggctgcgattgttagcacttcatctacacagtcaaattcacaggacgctaagatagacttcgagagttgtggatcaagaggaaactctgacatgatgattccaaattcagaaagatttccatcattatccagtgctgccagataatctaagtcttccaatgcctgcatcaaactttctggtgctaggaaaggaaaaaaataataatttaagagtctcatatggctaagatggagaaacaggtactggacttttccctcctgcatgaaacaagcaaacaatggacaaaatatgtgaaacaacggtttgcaagccaccaaataccagggagtgaaggatagtgattcttgagagggcaaactcaggaggggagccctgtgattgtccagctcatgctccgaggagggtcccagctgcagtgtgcatgcggggggaacccaggtggagcctgccagcctccctgcagtaggaaaacaatgccagggatccagggagactaaggtggccggaactcgcggtcacagtactggagagagacacacagatctaagtcgggggccagagggagctccctcaactaggcagcacagccctactgatcagcgcatgtgtgtaaggaaccacctcaggccagagaaagagccatgtgagaagattagaaggaacagtggtgctgacacaggacctagggtagggcctgttcccaccaccctagctggaaaacctcatgatttatggggcactgggtagaaaacacaagtgagaaaccctagatgggcactgccacctgacacagctatacagcaggacctgaaaggatcacactgcatcctaggacaaagctcaaaagtacctctgggactacaaaaatattcagtgcccaagaaggtaaaatgtacaatgtctagcatccagtagagaggcatgaaaagcaggaaaatacattgcataatacagagaaaaattaatcacaactgacctggatctcagatgctagaaatagtagacaaagatgttatttcccagtgcaaataaagaaataaagatagcaagctg

SEQ ID NO: 560 - DNA, 1433 bp, Homo sapiens
gtgagcggcaacatggcgtccaggtctaagcggcgtgccgtggaaagtggggttccgcagccgccggatcccccagtccagcgcgacgaggaagaggaaaaagaagtcgaaaatgaggatgaagacgatgatgacagtgacaaggaaaaggatgaagaggacgaggtcattgacgaggaagtgaatattgaatttgaagcttattccctatcagataatgattatgacggaattaagaaattactgcagcagctttttctaaaggctcctgtgaacactgcagaactaacagatctcttaattcaacagaaccatattgggagtgtgattaagcaaacggatgtttcagaagacagcaatgatgatatggatgaagatgaggtttttggtttcataagccttttaaatttaactgaaagaaagggtacccagtgtgttgaacaaattcaagagttggttctacgcttctgtgagaagaactgtgaaaagagcatggttgaacagctggacaagtttttaaatgacaccaccaagcctgtgggccttctcctaagtgaaagattcattaatgtccctccacagatcgctctgcccatgtaccagcagcttcagaaagaactggcgggggcacacagaaccaataagccatgtgggaagtgctacttttaccttctgattagtaagacatttgtggaagcaggaaaaaacaattccaaaaagaaacctagcaacaaaaagaaagctgcgttaatgtttgcaaatgcagaggaagaatttttctatgaggagcagggaaaacctgaggtgcttggaggtccagacacaagaagaggattggaaccagttccgatacagcacaatggtggttcacgggggcaagtgacagccctggtttctctgaaggctggactaattcaatcaagatcaactctaagtgatttccagggaaccttcatgactgttggaattgctctgtcataataagtcagggatatttaggaggctcatagtctcctggagggataaaacatctcggcacctagtaatggtaaattagtcaatatttgttagtttcgtttgagatctcaaatgttaggattttctgaagtctcagtgtctttcagagtttgagataccttgttttcattttttctaatttttaatttaaaagtaataaagaatattttgtaatgattaggatgaaaattttatcgtcaattataagccaaaatttgctaaaattaaagtcagtatacttgaaacaagtttctagtaagttctctggggtaagatactaattactctgataaaggggctatcaaaaaaatccagtaaattgttcataagaagagatcagtttaagagtcaaacaatttgctttgctagtaccttagctaaagaaaaaatactattaaagatgactatcaccttta

SEQ ID NO: 561 - DNA, 891 bp, Homo sapiens
gtgagcggcaacatggcgtccaggtctaagcggcgtgccgtggaaagtggggttccgcagccgccggatcccccagtccagcgcgacgaggaagaggaaaaagaagtcgaaaatgaggatgaagacgatgatgacagtgacaaggaaaaggatgaagaggacgaggtcattgacgaggaagtgaatattgaatttgaagcttattccctatcagataatgattatgacggaattaagaaattactgcagcagctttttctaaaggctcctgtgaacactgcagaactaacagatctcttaattcaacagaaccatattgggagtgtgattaagcaaacggatgtttcagaagacagcaatgatgatatggatgaagatgaggtttttggtttcataagccttttaaatttaactgaaagaaagggtacccagtgtgttgaacaaattcaagagttggttctacgcttctgtgagaagaactgtgaaaagagcatggttgaacagctggacaagtttttaaatgacaccaccaagcctgtgggccttctcctaagtgaaagattcattaatgtccctccacagatcgctctgcccatgtaccagcagcttcagaaagaactggcgggggcacacagaaccaataagccatgtgggaagtgctacttttaccttctgattagtaagacatttgtggaagcaggaaaaaacaattccaaaaagaaacctagcaacaaaaagaaagctgcgttaatgtttgcaaatgcagaggaagaatttttctatgagaaggcaattctcaagttcaactactcagtgcaggaggagagcgacacttgtctgggaggcaaatggtcttttgatgactggtctgttcccccagtattagaataa

SEQ ID NO: 562 - DNA, 1379 bp, Homo sapiens
gtgagcggcaacatggcgtccaggtctaagcggcgtgccgtggaaagtggggttccgcagccgccggatcccccagtccagcgcgacgaggaagaggaaaaagaagtcgaaaatgaggatgaagacgatgatgacagtgacaaggaaaaggatgaagaggacgaggtcattgacgaggaagtgaatattgaatttgaagcttattccctatcagataatgattatgacggaattaagaaattactgcagcagctttttctaaaggctcctgtgaacactgcagaactaacagatctcttaattcaacagaaccatattgggagtgtgattaagggtacccagtgtgttgaacaaattcaagagttggttctacgcttctgtgagaagaactgtgaaaagagcatggttgaacagctggacaagtttttaaatgacaccaccaagcctgtgggccttctcctaagtgaaagattcattaatgtccctccacagatcgctctgcccatgtaccagcagcttcagaaagaactggcgggggcacacagaaccaataagccatgtgggaagtgctacttttaccttctgattagtaagacatttgtggaagcaggaaaaaacaattccaaaaagaaacctagcaacaaaaagaaagctgcgttaatgtttgcaaatgcagaggaagaatttttctatgaggagcagggaaaacctgaggtgcttggaggtccagacacaagaagaggattggaaccagttccgatacagcacaatggttggtctgttcccccagtattagaataaattaaaacatacaagccaggatgaatgaagccaataggaaataaaaaacaggcacacaacattatttggggaaaaacacctctagtgacacattttcttcatctgcactgattatttcagcaaaagaaatctagtatgttttcatacatctgatgtataaatttgctgaactttgagttagttttcttaagataatttttcatattaagaaaattttccttttctaacctattaaaatacctcactatcatttcaaaaggttaaatgagttgatcactatctctgctctgtgctcctcaaaatataatttcaaatggatccgatctaaatctatacctagtgcagatttgcaaaaaaagaaaaggaatagtcattaaggatacctgttaccatggctgcgattgttagcacttcatctacacagtcaaattcacaggacgctaagatagacttcgagagttgtggatcaagaggaaactctgacatgatgattccaaattcagaaagatttccatcattatccagtgctgccagataatctaagtcttccaatgcctgcatcaaactttctggtgcta

SEQ ID NO: 563 - DNA, 1398 bp, Homo sapiens
atggtggacccggtgggcttcgcggaggcgtggaaggcgcagttcccggactcagagcccccgcgcatggagctgcgctcagtgggcgacatcgagcaggagctggagcgctgcaaggcctccattcggcgcctggagcaggaggtgaaccaggagcgcttccgcatgatctacctgcagacgttgctggccaaggaaaagaagagctatgaccggcagcgatggggcttccggcgcgcggcgcaggcccccgacggcgcctccgagccccgagcgtccgcgtcgcgcccgcagccagcgcccgccgacggagccgacccgccgcccgccgaggagcccgaggcccggcccgacggcgagggttctccgggtaaggccaggcccgggaccgcccgcaggcccggggcagccgcgtcgggggaacgggacgaccggggaccccccgccagcgtggcggcgctcaggtccaacttcgagcggatccgcaagggccatggccagcccggggcggacgccgagaagcccttctacgtgaacgtcgagtttcaccacgagcgcggcctggtgaaggtcaacgacaaagaggtgtcggaccgcatcagctccctgggcagccaggccatgcagatggagcgcaaaaagtcccagcacggcgcgggctcgagcgtgggggatgcatccaggcccccttaccggggacgctcctcggagagcagctgcggcgtcgacggcgactacgaggacgccgagttgaacccccgcttcctgaaggacaacctgatcgacgccaatggcggtagcaggcccccttggccgcccctggagtaccagccctaccagagcatctacgtcgggggcatgatggaaggggagggcaagggcccgctcctgcgcagccagagcacctctgagcaggagaagcgccttacctggccccgcaggtcctactccccccggagttttgaggattgcggaggcggctataccccggactgcagctccaatgagaacctcacctccagcgaggaggacttctcctctggccagtccagccgcgtgtccccaagccccaccacctaccgcatgttccgggacaaaagccgctctccctcgcagaactcgcaacagtccttcgacagcagcagtccccccacgccgcagtgccataagcggcaccggcactgcccggttgtcgtgtccgaggccaccatcgtgggcgtccgcaagaccgggcagatctggcccaacgatggcgagggcgccttccatggagaacatccgggagcagcagaagaagtgtttcagaagcttctccctgacatccgtggagctgcagatgctgaccaactcgtgtgtgaaactccagactgtccacagcattccgctgaccatcaataa

SEQ ID NO: 564 - DNA, 1377 bp, Homo sapiens
atggtggacccggtgggcttcgcggaggcgtggaaggcgcagttcccggactcagagcccccgcgcatggagctgcgctcagtgggcgacatcgagcaggagctggagcgctgcaaggcctccattcggcgcctggagcaggaggtgaaccaggagcgcttccgcatgatctacctgcagacgttgctggccaaggaaaagaagagctatgaccggcagcgatggggcttccggcgcgcggcgcaggcccccgacggcgcctccgagccccgagcgtccgcgtcgcgcccgcagccagcgcccgccgacggagccgacccgccgcccgccgaggagcccgaggcccggcccgacggcgagggttctccgggtaaggccaggcccgggaccgcccgcaggcccggggcagccgcgtcgggggaacgggacgaccggggaccccccgccagcgtggcggcgctcaggtccaacttcgagcggatccgcaagggccatggccagcccggggcggacgccgagaagcccttctacgtgaacgtcgagtttcaccacgagcgcggcctggtgaaggtcaacgacaaagaggtgtcggaccgcatcagctccctgggcagccaggccatgcagatggagcgcaaaaagtcccagcacggcgcgggctcgagcgtgggggatgcatccaggcccccttaccggggacgctcctcggagagcagctgcggcgtcgacggcgactacgaggacgccgagttgaacccccgcttcctgaaggacaacctgatcgacgccaatggcggtagcaggcccccttggccgcccctggagtaccagccctaccagagcatctacgtcgggggcatgatggaaggggagggcaagggcccgctcctgcgcagccagagcacctctgagcaggagaagcgccttacctggccccgcaggtcctactccccccggagttttgaggattgcggaggcggctataccccggactgcagctccaatgagaacctcacctccagcgaggaggacttctcctctggccagtccagccgcgtgtccccaagccccaccacctaccgcatgttccgggacaaaagccgctctccctcgcagaactcgcaacagtccttcgacagcagcagtccccccacgccgcagtgccataagcggcaccggcactgcccggttgtcgtgtccgaggccaccatcgtgggcgtccgcaagaccgggcagatctggcccaacgatggcgagggcgccttccatggagacgcagatggctcgttcggaacaccacctggatacggctgcttatgtctcccagcatggccttcagggtgcacagccgcaacggcaagagttacacgttcctga

SEQ ID NO: 565 - DNA, 7082 bp, Homo sapiens
ttccaggactgcagaactggcccagacctctgtattggaaaggtctttatggaccagggagtccggtgtcttttttacgggggacccctgggctgcgagttgcacagtccaattcgctgttgttagggcctcagtttcccaaaaggcacagggacggggggagggtggcggctcgatgggggagccgcctccagggggcccccccgccctgtgcccacggcgcggcccctttaagaggcccgcctggctccgtcatccgcgccgcggccacctccccccggccctccccttcctgcggcgcagagtgcgggccgggcgggagtgcggcgagagccggctggctgagcttagcgtccgaggaggcggcggcggcggcggcggcacggcggcggcggggctgtggggcggtgcggaagcgagaggcgaggagcgcgcgggccgtggccagagtctggcggcggcctggcggagcggagagcagcgcccgcgcctcgccgtgcggaggagccccgcacacaatagcggcgcgcgcagcccgcgcccttccccccggcgcgccccgccccgcgcgccgagcgccccgctccgcctcacctgccaccagggagtgggcgggcattgttcgccgccgccgccgccgcgcgggccatgggggccgcccggcgcccggggccgggctggcgaggcgccgcgccgccgctgagacgggccccgcgcgcagcccggcggcgcaggtaaggccggccgcgccatggtggacccggtgggcttcgcggaggcgtggaaggcgcagttcccggactcagagcccccgcgcatggagctgcgctcagtgggcgacatcgagcaggagctggagcgctgcaaggcctccattcggcgcctggagcaggaggtgaaccaggagcgcttccgcatgatctacctgcagacgttgctggccaaggaaaagaagagctatgaccggcagcgatggggcttccggcgcgcggcgcaggcccccgacggcgcctccgagccccgagcgtccgcgtcgcgcccgcagccagcgcccgccgacggagccgacccgccgcccgccgaggagcccgaggcccggcccgacggcgagggttctccgggtaaggccaggcccgggaccgcccgcaggcccggggcagccgcgtcgggggaacgggacgaccggggaccccccgccagcgtggcggcgctcaggtccaacttcgagcggatccgcaagggccatggccagcccggggcggacgccgagaagcccttctacgtgaacgtcgagtttcaccacgagcgcggcctggtgaaggtcaacgacaaagaggtgtcggaccgcatcagctccctgggcagccaggccatgcagatggagcgcaaaaagtcccagcacggcgcgggctcgagcgtgggggatgcatccaggcccccttaccggggacgctcctcggagagcagctgcggcgtcgacggcgactacgaggacgccgagttgaacccccgcttcctgaaggacaacctgatcgacgccaatggcggtagcaggcccccttggccgcccctggagtaccagccctaccagagcatctacgtcgggggcatgatggaaggggagggcaagggcccgctcctgcgcagccagagcacctctgagcaggagaagcgccttacctggccccgcaggtcctactccccccggagttttgaggattgcggaggcggctataccccggactgcagctccaatgagaacctcacctccagcgaggaggacttctcctctggccagtccagccgcgtgtccccaagccccaccacctaccgcatgttccgggacaaaagccgctctccctcgcagaactcgcaacagtccttcgacagcagcagtccccccacgccgcagtgccataagcggcaccggcactgcccggttgtcgtgtccgaggccaccatcgtgggcgtccgcaagaccgggcagatctggcccaacgatggcgagggcgccttccatggagacgcagatggctcgttcggaacaccacctggatacggctgcgctgcagaccgggcagaggagcagcgccggcaccaagatgggctgccctacattgatgactcgccctcctcatcgccccacctcagcagcaagggcaggggcagccgggatgcgctggtctcgggagccctggagtccactaaagcgagtgagctggacttggaaaagggcttggagatgagaaaatgggtcctgtcgggaatcctggctagcgaggagacttacctgagccacctggaggcactgctgctgcccatgaagcctttgaaagccgctgccaccacctctcagccggtgctgacgagtcagcagatcgagaccatcttcttcaaagtgcctgagctctacgagatccacaaggagttctatgatgggctcttcccccgcgtgcagcagtggagccaccagcagcgggtgggcgacctcttccagaagctggccagccagctgggtgtgtaccgggccttcgtggacaactacggagttgccatggaaatggctgagaagtgctgtcaggccaatgctcagtttgcagaaatctccgagaacctgagagccagaagcaacaaagatgccaaggatccaacgaccaagaactctctggaaactctgctctacaagcctgtggaccgtgtgacgaggagcacgctggtcctccatgacttgctgaagcacactcctgccagccaccctgaccaccccttgctgcaggacgccctccgcatctcacagaacttcctgtccagcatcaatgaggagatcacaccccgacggcagtccatgacggtgaagaagggagagcaccggcagctgctgaaggacagcttcatggtggagctggtggagggggcccgcaagctgcgccacgtcttcctgttcaccgacctgcttctctgcaccaagctcaagaagcagagcggaggcaaaacgcagcagtatgactgcaaatggtacattccgctcacggatctcagcttccagatggtggatgaactggaggcagtgcccaacatccccctggtgcccgatgaggagctggacgctttgaagatcaagatctcccagatcaagaatgacatccagagagagaagagggcgaacaagggcagcaaggctacggagaggctgaagaagaagctgtcggagcaggagtcactgctgctgcttatgtctcccagcatggccttcagggtgcacagccgcaacggcaagagttacacgttcctgatctcctctgactatgagcgtgcagagtggagggagaacatccgggagcagcagaagaagtgtttcagaagcttctccctgacatccgtggagctgcagatgctgaccaactcgtgtgtgaaactccagactgtccacagcattccgctgaccatcaataaggaagatgatgagtctccggggctctatgggtttctgaatgtcatcgtccactcagccactggatttaagcagagttcaaatctgtactgcaccctggaggtggattcctttgggtattttgtgaataaagcaaagacgcgcgtctacagggacacagctgagccaaactggaacgaggaatttgagatagagctggagggctcccagaccctgaggatactgtgctatgaaaagtgttacaacaagacgaagatccccaaggaggacggcgagagcacggacagactcatggggaagggccaggtccagctggacccgcaggccctgcaggacagagactggcagcgcaccgtcatcgccatgaatgggatcgaagtaaagctctcggtcaagttcaacagcagggagttcagcttgaagaggatgccgtcccgaaaacagacaggggtcttcggagtcaagattgctgtggtcaccaagagagagaggtccaaggtgccctacatcgtgcgccagtgcgtggaggagatcgagcgccgaggcatggaggaggtgggcatctaccgcgtgtccggtgtggccacggacatccaggcactgaaggcagccttcgacgtcaataacaaggacgtgtcggtgatgatgagcgagatggacgtgaacgccatcgcaggcacgctgaagctgtacttccgtgagctgcccgagcccctcttcactgacgagttctaccccaacttcgcagagggcatcgctctttcagacccggttgcaaaggagagctgcatgctcaacctgctgctgtccctgccggaggccaacctgctcaccttccttttccttctggaccacctgaaaagggtggcagagaaggaggcagtcaataagatgtccctgcacaacctcgccacggtctttggccccacgctgctccggccctccgagaaggagagcaagctccctgccaaccccagccagcctatcaccatgactgacagctggtccttggaggtcatgtcccaggtccaggtgctgctgtacttcctgcagctggaggccatccctgccccggacagcaagagacagagcatcctgttctccaccgaagtctaaaggtcccagtccatctcctggaggcggacagatggcctggaaacctctggctaatcgggccatccgtagagcgggaaccttcctgaggtgtccttgggccacccccaagtgttgggccatctgccaagagacagcgacccaaagccgaaggacaggtggcctggaaagatcccgcccaggtctgggagccccaggctggcctcagactgtggttttttatgtggccacctgagggcgccccaagccagttcatctcggagtccaggcctggccctgggagacagggtgaagggagtggtttttatgaacttaacttagagtctaaaagatttctactggatcacttgtcaagatgcgccctctctggggagaagggaacgtgactggattccctcactgttgtatcttgaataaacgctgctgcttcatcctgtgggggccgtggccctgtccctgtgtgggtggggcctcttccatttccctgacttagaaaccacactccacttctaacagggtttgagaggcttagtcagcactgggtagcgttttgactccattcttggctttctttttctttccagaaggatttttgtgcagaaatgggtcttttgttgccatgttagtcctccttggaaggcagctcagaaggcctgtgaaatgtcaggggacaggacccccagggagggaaccccaggctacgcactttagggttcgttctccagggagagcgacctcgtcccccgatcctgaccgcccttccggcccacgctctcctgtttggcttccacaggcctggacttctctggcttctctgcccacacactccctgcccccagtgtccctgcccctgccccagcacaggtgacttcatttctgtcctctcagctcagtggactcgctcaacttttgtataagtctccacttggtggcagcagcttgctgatgacttgttttaaaactttcatcctaaataaccttttgatacttgaatatttgtaagttttatacatagtttctaatttttttccgaacagatccagatacctaataagatgctggaatgtaatccctggacaatccgtgtcctggcagcatttggtcttcctctaagcgcctggctccgctgttctcaggagtgggttctgaagtctctggagaacaggatacgtggagggttaggaaggggccaggcctagagacgggagactccctcccggagcaggtggaggcacaggaccattcgctaccccatctgccgacacctgcgggggagcccaggcattctttgtaaaccctcctgaccacctggctcaaagaaaacagaagcatggagaccgccaagtattttcaagaaataaccccatgaatattccatcacttttttagaaagaggggcttggggcaggcagaggagagaagggagagcaaactgagagccaagtttccacacggtcctgcaggaggagaggatgcagctgcccagagggaagcaggatcacatttaaggaagtgtgtggggtccctggatgacaccagcacccagtgcggctctgtctggcacccgctcccaaggtgggaggagtgggtgtcccctgtgtgtcagtgggcagctcctgctgaacccgcagctcactagggagcctgacagtggggccatgcgcctgacactcctctctgcttgtggacctggcaaggcagggagcagaaaacagccacttgaaggctttctgtctgcgtctgtgtgcagtgtggatttagttgtgcttttttcttgctgggagagcacagccaccatttacaagcagtgtcaccgtcgtgggtggcgaggacagaacaggagcctctgctctctgtacctatctgggcccggtgggctcccttgtcctggcttccatctctgtctcagcgaccattcagccctgcgcaggaacacgtgttgcttagaaaagccaaatccagccttgtctctgcctcctctggtctcatgatgtgcatctgttaccttgaaactggaaaccagtctatcaatgtctgtgccaattttttattccctccccaacctccttccccatacgactttttatttatgtaggatgtgtgctgtctaatgatgggatgaccacacttttccatgttctaaaagtgctcctctcccgcagggtcccagggctggtggttgctttgggtctacagctacgtcttacccacctcctgcctcaacagcctgtgtggtggcaaagccggtgtggggctggggaacgcagcgttctccaggagggggacctggctctccttctgcaatgcaggcgaaggcctagatgccagtgtgacctcccacaaggcgtggcttccagactccccggccggaagtgatgcttttttgccttgggccctgggtttgaagcagcctggctttctcttggtaagtggctggtgtcttagcagctgcaatctgagctcagccacctacacaccaccgtggccgacactttcattaaaaagtttcctgagacga

SEQ ID NO: 566 - DNA, 2951 bp, Homo sapiens
ccgagtgctccccgagtgtccaccgtcggcctgctctgttccggggcagggccacatctttgtccgtgtgccgaggaggggactggtgggctggagtcccagggggagattattccaagtaggggctccagaaagccagatggtgtgagtggctccagaagactcttctcttctctgtgcaagagccaggaaggctctagaaaggaatgtctgaggaagcatcggagactgggtcccgccatgcctgtgtcatctcctggcttccccggccctttggctcgttcggaacaccacctggatacggctgcgctgcagaccgggcagaggagcagcgccggcaccaagatgggctgccctacattgatgactcgccctcctcatcgccccacctcagcagcaagggcaggggcagccgggatgcgctggtctcgggagccctggagtccactaaagcggagtgagctggacttggaaaagggcttggagatgagaaaatgggtcctgtcgggaatcctggctagcgaggagacttacctgagccacctggaggcactgctgctgcccatgaagcctttgaaagccgctgccaccacctctcagccggtgctgacgagtcagcagatcgagaccatcttcttcaaagtgcctgagctctacgagatccacaaggagttctatgatgggctcttcccccgcgtgcagcagtggagccaccagcagcgggtgggcgacctcttccagaagctggccagccagctgggtgtgtaccgggccttcgtggacaactacggagttgccatggaaatggctgagaagtgctgtcaggccaatgctcagtttgcagaaatctccgagaacctgagagccagaagcaacaaagatgccaaggatccaacgaccaagaactctctggaaactctgctctacaagcctgtggaccgtgtgacgaggagcacgctggtcctccatgacttgctgaagcacactcctgccagccaccctgaccaccccttgctgcaggacgccctccgcatctcacagaacttcctgtccagcatcaatgaggagatcacaccccgacggcagtccatgacggtgaagaagggagagcaccggcagctgctgaaggacagcttcatggtggagctggtggagggggcccgcaagctgcgccacgtcttcctgttcaccgacctgcttctctgcaccaagctcaagaagcagagcggaggcaaaacgcagcagtatgactgcaaatggtacattccgctcacggatctcagcttccagatggtggatgaactggaggcagtgcccaacatccccctggtgcccgatgaggagctggacgctttgaagatcaagatctcccagatcaagaatgacatccagagagagaagagggcgaacaagggcagcaaggctacggagaggctgaagaagaagctgtcggagcaggagtcactgctgctgcttatgtctcccagcatggccttcagggtgcacagccgcaacggcaagagttacacgttcctgatctcctctgactatgagcgtgcagagtggagggagaacatccgggagcagcagaagaagtgtttcagaagcttctccctgacatccgtggagctgcagatgctgaccaactcgtgtgtgaaactccagactgtccacagcattccgctgaccatcaataaggaagatgatgagtctccggggctctatgggtttctgaatgtcatcgtccactcagccactggatttaagcagagttcaaatctgtactgcaccctggaggtggattcctttgggtattttgtgaataaagcaaagacgcgcgtctacagggacacagctgagccaaactggaacgaggaatttgagatagagctggagggctcccagaccctgaggatactgtgctatgaaaagtgttacaacaagacgaagatccccaaggaggacggcgagagcacggacagactcatggggaagggccaggtccagctggacccgcaggccctgcaggacagagactggcagcgcaccgtcatcgccatgaatgggatcgaagtaaagctctcggtcaagttcaacagcagggagttcagcttgaagaggatgccgtcccgaaaacagacaggggtcttcggagtcaagattgctgtggtcaccaagagagagaggtccaaggtgccctacatcgtgcgccagtgcgtggaggagatcgagcgccgaggcatggaggaggtgggcatctaccgcgtgtccggtgtggccacggacatccaggcactgaaggcagccttcgacgtcaataacaaggacgtgtcggtgatgatgagcgagatggacgtgaacgccatcgcaggcacgctgaagctgtacttccgtgagctgcccgagcccctcttcactgacgagttctaccccaacttcgcagagggcatcgctctttcagacccggttgcaaaggagagctgcatgctcaacctgctgctgtccctgccggaggccaacctgctcaccttccttttccttctggaccacctgaaaagggtggcagagaaggaggcagtcaataagatgtccctgcacaacctcgccacggtctttggccccacgctgctccggccctccgagaaggagagcaagctccctgccaaccccagccagcctatcaccatgactgacagctggtccttggaggtcatgtcccaggtccaggtgctgctgtacttcctgcagctggaggccatccctgccccggacagcaagagacagagcatcctgttctccaccgaagtctaaaggtcccagtccatctcctggaggcggacagatggcctggaaacctctggctaatcgggccatccgtagagcgggaaccttcctgaggtgtccttgggccacccccaagtgttgggccatctgccaagagacagcgaccc

SEQ ID NO: 567 - DNA, 4708 bp, Homo sapiens
ggggggagggtggcggctcgatgggggagccgcctccagggggcccccccgccctgtgcccacggcgcggcccctttaagaggcccgcctggctccgtcatccgcgccgcggccacctccccccggccctccccttcctgcggcgcagagtgcgggccgggcgggagtgcggcgagagccggctggctgagcttagcgtccgaggaggcggcggcggcggcggcggcacggcggcggcggggctgtggggcggtgcggaagcgagaggcgaggagcgcgcgggccgtggccagagtctggcggcggcctggcggagcggagagcagcgcccgcgcctcgccgtgcggaggagccccgcacacaatagcggcgcgcgcagcccgcgcccttccccccggcgcgccccgccccgcgcgccgagcgccccgctccgcctcacctgccaccagggagtgggcgggcattgttcgccgccgccgccgccgcgcgggccatgggggccgcccggcgcccggggccgggctggcgaggcgccgcgccgccgctgagacgggccccgcgcgcagcccggcggcgcaggtaaggccggccgcgccatggtggacccggtgggcttcgcggaggcgtggaaggcgcagttcccggactcagagcccccgcgcatggagctgcgctcagtgggcgacatcgagcaggagctggagcgctgcaaggcctccattcggcgcctggagcaggaggtgaaccaggagcgcttccgcatgatctacctgcagacgttgctggccaaggaaaagaagagctatgaccggcagcgatggggcttccggcgcgcggcgcaggcccccgacggcgcctccgagccccgagcgtccgcgtcgcgcccgcagccagcgcccgccgacggagccgacccgccgcccgccgaggagcccgaggcccggcccgacggcgagggttctccgggtaaggccaggcccgggaccgcccgcaggcccggggcagccgcgtcgggggaacgggacgaccggggaccccccgccagcgtggcggcgctcaggtccaacttcgagcggatccgcaagggccatggccagcccggggcggacgccgagaagcccttctacgtgaacgtcgagtttcaccacgagcgcggcctggtgaaggtcaacgacaaagaggtgtcggaccgcatcagctccctgggcagccaggccatgcagatggagcgcaaaaagtcccagcacggcgcgggctcgagcgtgggggatgcatccaggcccccttaccggggacgctcctcggagagcagctgcggcgtcgacggcgactacgaggacgccgagttgaacccccgcttcctgaaggacaacctgatcgacgccaatggcggtagcaggcccccttggccgcccctggagtaccagccctaccagagcatctacgtcgggggcatgatggaaggggagggcaagggcccgctcctgcgcagccagagcacctctgagcaggagaagcgccttacctggccccgcaggtcctactccccccggagttttgaggattgcggaggcggctataccccggactgcagctccaatgagaacctcacctccagcgaggaggacttctcctctggccagtccagccgcgtgtccccaagccccaccacctaccgcatgttccgggacaaaagccgctctccctcgcagaactcgcaacagtccttcgacagcagcagtccccccacgccgcagtgccataagcggcaccggcactgcccggttgtcgtgtccgaggccaccatcgtgggcgtccgcaagaccgggcagatctggcccaacgatggcgagggcgccttccatggagacgcagatggctcgttcggaacaccacctggatacggctgcgctgcagaccgggcagaggagcagcgccggcaccaagatgggctgccctacattgatgactcgccctcctcatcgccccacctcagcagcaagggcaggggcagccgggatgcgctggtctcgggagccctggagtccactaaagcgagtgagctggacttggaaaagggcttggagatgagaaaatgggtcctgtcgggaatcctggctagcgaggagacttacctgagccacctggaggcactgctgctgcccatgaagcctttgaaagccgctgccaccacctctcagccggtgctgacgagtcagcagatcgagaccatcttcttcaaagtgcctgagctctacgagatccacaaggagttctatgatgggctcttcccccgcgtgcagcagtggagccaccagcagcgggtgggcgacctcttccagaagctggccagccagctgggtgtgtaccgggccttcgtggacaactacggagttgccatggaaatggctgagaagtgctgtcaggccaatgctcagtttgcagaaatctccgagaacctgagagccagaagcaacaaagatgccaaggatccaacgaccaagaactctctggaaactctgctctacaagcctgtggaccgtgtgacgaggagcacgctggtcctccatgacttgctgaagcacactcctgccagccaccctgaccaccccttgctgcaggacgccctccgcatctcacagaacttcctgtccagcatcaatgaggagatcacaccccgacggcagtccatgacggtgaagaagggagagcaccggcagctgctgaaggacagcttcatggtggagctggtggagggggcccgcaagctgcgccacgtcttcctgttcaccgacctgcttctctgcaccaagctcaagaagcagagcggaggcaaaacgcagcagtatgactgcaaatggtacattccgctcacggatctcagcttccagatggtggatgaactggaggcagtgcccaacatccccctggtgcccgatgaggagctggacgctttgaagatcaagatctcccagatcaagaatgacatccagagagagaagagggcgaacaagggcagcaaggctacggagaggctgaagaagaagctgtcggagcaggagtcactgctgctgcttatgtctcccagcatggccttcagggtgcacagccgcaacggcaagagttacacgttcctgatctcctctgactatgagcgtgcagagtggagggagaacatccgggagcagcagaagaagtgtttcagaagcttctccctgacatccgtggagctgcagatgctgaccaactcgtgtgtgaaactccagactgtccacagcattccgctgaccatcaataaggaagatgatgagtctccggggctctatgggtttctgaatgtcatcgtccactcagccactggatttaagcagagttcaaatctgtactgcaccctggaggtggattcctttgggtattttgtgaataaagcaaagacgcgcgtctacagggacacagctgagccaaactggaacgagctggacccgcaggccctgcaggacagagactggcagcgcaccgtcatcgccatgaatgggatcgaagtaaagctctcggtcaagttcaacagcagggagttcagcttgaagaggatgccgtcccgaaaacagacaggggtcttcggagtcaagattgctgtggtcaccaagagagagaggtccaaggtgccctacatcgtgcgccagtgcgtggaggagatcgagcgccgaggcatggaggaggtgggcatctaccgcgtgtccggtgtggccacggacatccaggcactgaaggcagccttcgacgtcaataacaaggacgtgtcggtgatgatgagcgagatggacgtgaacgccatcgcaggcacgctgaagctgtacttccgtgagctgcccgagcccctcttcactgacgagttctaccccaacttcgcagagggcatcgctctttcagacccggttgcaaaggagagctgcatgctcaacctgctgctgtccctgccggaggccaacctgctcaccttccttttccttctggaccacctgaaaagggtggcagagaaggaggcagtcaataagatgtccctgcacaacctcgccacggtctttggccccacgctgctccggccctccgagaaggagagcaagctccctgccaaccccagccagcctatcaccatgactgacagctggtccttggaggtcatgtcccaggtccaggtgctgctgtacttcctgcagctggaggccatccctgccccggacagcaagagacagagcatcctgttctccaccgaagtctaaaggtcccagtccatctcctggaggcggacagatggcctggaaacctctggctaatcgggccatccgtagagcgggaaccttcctgaggtgtccttgggccacccccaagtgttgggccatctgccaagagacagcgacccaaagccgaaggacaggtggcctggaaagatcccgcccaggtctgggagccccaggctggcctcagactgtggttttttatgtggccacctgagggcgccccaagccagttcatctcggagtccaggcctggccctgggagacagggtgaagggagtggtttttatgaacttaacttagagtctaaaagatttctactggatcacttgtcaagatgcgccctctctggggagaagggaacgtgactggattccctcactgttgtatcttgaataaacgctgctgcttca

SEQ ID NO: 568 - DNA, 2000 bp, Homo sapiens
ggggggagggtggcggctcgatgggggagccgcctccagggggcccccccgccctgtgcccacggcgcggcccctttaagaggcccgcctggctccgtcatccgcgccgcggccacctccccccggccctccccttcctgcggcgcagagtgcgggccgggcgggagtgcggcgagagccggctggctgagcttagcgtccgaggaggcggcggcggcggcggcggcacggcggcggcggggctgtggggcggtgcggaagcgagaggcgaggagcgcgcgggccgtggccagagtctggcggcggcctggcggagcggagagcagcgcccgcgcctcgccgtgcggaggagccccgcacacaatagcggcgcgcgcagcccgcgcccttccccccggcgcgccccgccccgcgcgccgagcgccccgctccgcctcacctgccaccagggagtgggcgggcattgttcgccgccgccgccgccgcgcgggccatgggggccgcccggcgcccggggccgggctggcgaggcgccgcgccgccgctgagacgggccccgcgcgcagcccggcggcgcaggtaaggccggccgcgccatggtggacccggtgggcttcgcggaggcgtggaaggcgcagttcccggactcagagcccccgcgcatggagctgcgctcagtgggcgacatcgagcaggagctggagcgctgcaaggcctccattcggcgcctggagcaggaggtgaaccaggagcgcttccgcatgatctacctgcagacgttgctggccaaggaaaagaagagctatgaccggcagcgatggggcttccggcgcgcggcgcaggcccccgacggcgcctccgagccccgagcgtccgcgtcgcgcccgcagccagcgcccgccgacggagccgacccgccgcccgccgaggagcccgaggcccggcccgacggcgagggttctccgggtaaggccaggcccgggaccgcccgcaggcccggggcagccgcgtcgggggaacgggacgaccggggaccccccgccagcgtggcggcgctcaggtccaacttcgagcggatccgcaagggccatggccagcccggggcggacgccgagaagcccttctacgtgaacgtcgagtttcaccacgagcgcggcctggtgaaggtcaacgacaaagaggtgtcggaccgcatcagctccctgggcagccaggccatgcagatggagcgcaaaaagtcccagcacggcgcgggctcgagcgtgggggatgcatccaggcccccttaccggggacgctcctcggagagcagctgcggcgtcgacggcgactacgaggacgccgagttgaacccccgcttcctgaaggacaacctgatcgacgccaatggcggtagcaggcccccttggccgcccctggagtaccagccctaccagagcatctacgtcgggggcatgatggaaggggagggcaagggcccgctcctgcgcagccagagcacctctgagcaggagaagcgccttacctggccccgcaggtcctactccccccggagttttgaggattgcggaggcggctataccccggactgcagctccaatgagaacctcacctccagcgaggaggacttctcctctggccagtccagccgcgtgtccccaagccccaccacctaccgcatgttccgggacaaaagccgctctccctcgcagaactcgcaacagtccttcgacagcagcagtccccccacgccgcagtgccataagcggcaccggcactgcccggttgtcgtgtccgaggccaccatcgtgggcgtccgcaagaccgggcagatctggcccaacgatggcgagggcgccttccatggagacgcagttctgaagactgaagtcccacatcaaggtgtccgcagggccaggctgtctctggaggctctaggggaggatccttcctttctgttcccagcatctgatggcccacggcattcctcgacctggtga

SEQ ID NO: 569 - DNA, 1365 bp, Homo sapiens
atggtggacccggtgggcttcgcggaggcgtggaaggcgcagttcccggactcagagcccccgcgcatggagctgcgctcagtgggcgacatcgagcaggagctggagcgctgcaaggcctccattcggcgcctggagcaggaggtgaaccaggagcgcttccgcatgatctacctgcagacgttgctggccaaggaaaagaagagctatgaccggcagcgatggggcttccggcgcgcggcgcaggcccccgacggcgcctccgagccccgagcgtccgcgtcgcgcccgcagccagcgcccgccgacggagccgacccgccgcccgccgaggagcccgaggcccggcccgacggcgagggttctccgggtaaggccaggcccgggaccgcccgcaggcccggggcagccgcgtcgggggaacgggacgaccggggaccccccgccagcgtggcggcgctcaggtccaacttcgagcggatccgcaagggccatggccagcccggggcggacgccgagaagcccttctacgtgaacgtcgagtttcaccacgagcgcggcctggtgaaggtcaacgacaaagaggtgtcggaccgcatcagctccctgggcagccaggccatgcagatggagcgcaaaaagtcccagcacggcgcgggctcgagcgtgggggatgcatccaggcccccttaccggggacgctcctcggagagcagctgcggcgtcgacggcgactacgaggacgccgagttgaacccccgcttcctgaaggacaacctgatcgacgccaatggcggtagcaggcccccttggccgcccctggagtaccagccctaccagagcatctacgtcgggggcatgatggaaggggagggcaagggcccgctcctgcgcagccagagcacctctgagcaggagaagcgccttacctggccccgcaggtcctactccccccggagttttgaggattgcggaggcggctataccccggactgcagctccaatgagaacctcacctccagcgaggaggacttctcctctggccagtccagccgcgtgtccccaagccccaccacctaccgcatgttccgggacaaaagccgctctccctcgcagaactcgcaacagtccttcgacagcagcagtccccccacgccgcagtgccataagcggcaccggcactgcccggttgtcgtgtccgaggccaccatcgtgggcgtccgcaagaccgggcagatctggcccaacgatggcgagggcgccttccatggagacgcagatggctcgttcggaacaccacctggatacggctgcgctgcaggacgccctccgcatctcacagaacttcctgtccagcatcaatga

SEQ ID NO: 570 - DNA, 7114 bp, Homo sapiens
cttagcggtagccccttggtttccgtggcaacggaaaagcgcgggaattacagataaattaaaactgcgactgcgcggcgtgagctcgctgagacttcctggacgggggacaggctgtggggtttctcagataactgggcccctgcgctcaggaggccttcaccctctgctctggttcattggaacagaaagaaatggatttatctgctcttcgcgttgaagaagtacaaaatgtcattaatgctatgcagaaaatcttagagtgtcccatctgattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagagataaagaaaaaaaagtacaaccaaatgccagtcaggcacagcagaaacctacaactcatggaaggtaaagaacctgcaactggagccaagaagagtaacaagccaaatgaacagacaagtaaaagacatgacagcgatactttcccagagctgaagttaacaaatgcacctggttcttttactaagtgttcaaataccagtgaacttaaagaatttgtcaatcctagccttccaagagaagaaaaagaagagaaactagaaacagttaaagtgtctaataatgctgaagaccccaaagatctcatgttaagtggagaaagggttttgcaaactgaaagatctgtagagagtagcagtatttcattggtacctggtactgattatggcactcaggaaagtatctcgttactggaagttagcactctagggaaggcaaaaacagaaccaaataaatgtgtgagtcagtgtgcagcatttgaaaaccccaagggactaattcatggttgttccaaagataatagaaatgacacagaaggctttaagtatccattgggacatgaagttaaccacagtcgggaaacaagcatagaaatggaagaaagtgaacttgatgctcagtatttgcagaatacattcaaggtttcaaagcgccagtcatttgctccgttttcaaatccaggaaatgcagaagaggaatgtgcaacattctctgcccactctgggtccttaaagaaacaaagtccaaaagtcacttttgaatgtgaacaaaaggaagaaaatcaaggaaagaatgagtctaatatcaagcctgtacagacagttaatatcactgcaggctttcctgtggttggtcagaaagataagccagttgataatgccaaatgtagtatcaaaggaggctctaggttttgtctatcatctcagttcagaggcaacgaaactggactcattactccaaataaacatggacttttacaaaacccatatcgtataccaccactttttcccatcaagtcatttgttaaaactaaatgtaagaaaaatctgctagaggaaaactttgaggaacattcaatgtcacctgaaagagaaatgggaaatgagaacattccaagtacagtgagcacaattagccgtaataacattagagaaaatgtttttaaagaagccagctcaagcaatattaatgaagtaggttccagtactaatgaagtgggctccagtattaatgaaataggttccagtgatgaaaacattcaagcagaactaggtagaaacagagggccaaaattgaatgctatgcttagattaggggttttgcaacctgaggtctataaacaaagtcttcctggaagtaattgtaagcatcctgaaataaaaaagcaagaatatgaagaagtagttcagactgttaatacagatttctctccatatctgatttcagataacttagaacagcctatgggaagtagtcatgcatctcaggtttgttctgagacacctgatgacctgttagatgatggtgaaataaaggaagatactagttttgctgaaaatgacattaaggaaagttctgctgtttttagcaaaagcgtccagaaaggagagcttagcaggagtcctagccctttcacccatacacatttggctcagggttaccgaagaggggccaagaaattagagtcctcagaagagaacttatctagtgaggatgaagagcttccctgcttccaacacttgttatttggtaaagtaaacaatataccttctcagtctactaggcatagcaccgttgctaccgagtgtctgtctaagaacacagaggagaatttattatcattgaagaatagcttaaatgactgcagtaaccaggtaatattggcaaaggcatctcaggaacatcaccttagtgaggaaacaaaatgttctgctagcttgttttcttcacagtgcagtgaattggaagacttgactgcaaatacaaacacccaggatcctttcttgattggttcttccaaacaaatgaggcatcagtctgaaagccagggagttggtctgagtgacaaggaattggtttcagatgatgaagaaagaggaacgggcttggaagaaaataatcaagaagagcaaagcatggattcaaacttaggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagcagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctgggagctcctctcactcttcagtccttctactgtcctggctactaaatattttatgtacatcagcctgaaaaggacttctggctatgcaagggtcccttaaagattttctgcttgaagtctcccttggaaatctgccatgagcacaaaattatggtaatttttcacctgagaagattttaaaaccatttaaacgccaccaattgagcaagatgctgattcattatttatcagccctattctttctattcaggctgttgttggcttagggctggaagcacagagtggcttggcctcaagagaatagctggtttccctaagtttacttctctaaaaccctgtgttcacaaaggcagagagtcagacccttcaatggaaggagagtgcttgggatcgattatgtgacttaaagtcagaatagtccttgggcagttctcaaatgttggagtggaacattggggaggaaattctgaggcaggtattagaaatgaaaaggaaacttgaaacctgggcatggtggctcacgcctgtaatcccagcactttgggaggccaaggtgggcagatcactggaggtcaggagttcgaaaccagcctggccaacatggtgaaaccccatctctactaaaaatacagaaattagccggtcatggtggtggacacctgtaatcccagctactcaggtggctaaggcaggagaatcacttcagcccgggaggtggaggttgcagtgagccaagatcataccacggcactccagcctgggtgacagtgagactgtggctcaaaaaaaaaaaaaaaaaaaggaaaatgaaactagaagagatttctaaaagtctgagatatatttgctagatttctaaagaatgtgttctaaaacagcagaagattttcaagaaccggtttccaaagacagtcttctaattcctcattagtaataagtaaaatgtttattgttgtagctctggtatataatccattcctcttaaaatataagacctctggcatgaatatttcatatctataaaatgacagatcccaccaggaaggaagctgttgctttctttgaggtgatttttttcctttgctccctgttgctgaaaccatacagcttcataaataattttgcttgctgaaggaagaaaaagtgtttttcataaacccattatccaggactgtttatagctgttggaaggactaggtcttccctagcccccccagtgtgcaagggcagtgaagacttgattgtacaaaatacgttttgtaaatgttgtgctgttaacactgcaaataaacttggtagcaaacacttcc

SEQ ID NO: 571 - DNA, 6451 bp, Homo sapiens
cttagcggtagccccttggtttccgtggcaacggaaaagcgcgggaattacagataaattaaaactgcgactgcgcggcgtgagctcgctgagacttcctggacgggggacaggctgtggggtttctcagataactgggcccctgcgctcaggaggccttcaccctctgctctggttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagagataaagaaaaaaaagtacaaccaaatgccagtcaggcacagcagaaacctacaactcatggaaggtaaagaacctgcaactggagccaagaagagtaacaagccaaatgaacagacaagtaaaagacatgacagcgatactttcccagagctgaagttaacaaatgcacctggttcttttactaagtgttcaaataccagtgaacttaaagaatttgtcaatcctagccttccaagagaagaaaaagaagagaaactagaaacagttaaagtgtctaataatgctgaagaccccaaagatctcatgttaagtggagaaagggttttgcaaactgaaagatctgtagagagtagcagtatttcattggtacctggtactgattatggcactcaggaaagtatctcgttactggaagttagcactctagggaaggcaaaaacagaaccaaataaatgtgtgagtcagtgtgcagcatttgaaaaccccaagggactaattcatggttgttccaaagataatagaaatgacacagaaggctttaagtatccattgggacatgaagttaaccacagtcgggaaacaagcatagaaatggaagaaagtgaacttgatgctcagtatttgcagaatacattcaaggtttcaaagcgccagtcatttgctccgttttcaaatccaggaaatgcagaagaggaatgtgcaacattctctgcccactctgggtccttaaagaaacaaagtccaaaagtcacttttgaatgtgaacaaaaggaagaaaatcaaggaaagaatgagtctaatatcaagcctgtacagacagttaatatcactgcaggctttcctgtggttggtcagaaagataagccagttgataatgccaaatgtagtatcaaaggaggctctaggttttgtctatcatctcagttcagaggcaacgaaactggactcattactccaaataaacatggacttttacaaaacccatatcgtataccaccactttttcccatcaagtcatttgttaaaactaaatgtaagaaaaatctgctagaggaaaactttgaggaacattcaatgtcacctgaaagagaaatgggaaatgagaacattccaagtacagtgagcacaattagccgtaataacattagagaaaatgtttttaaagaagccagctcaagcaatattaatgaagtaggttccagtactaatgaagtgggctccagtattaatgaaataggttccagtgatgaaaacattcaagcagaactaggtagaaacagagggccaaaattgaatgctatgcttagattaggggttttgcaacctgaggtctataaacaaagtcttcctggaagtaattgtaagcatcctgaaataaaaaagcaagaatatgaagaagtagttcagactgttaatacagatttctctccatatctgatttcagataacttagaacagcctatgggaagtagtcatgcatctcaggtttgttctgagacacctgatgacctgttagatgatggtgaaataaaggaagatactagttttgctgaaaatgacattaaggaaagttctgctgtttttagcaaaagcgtccagaaaggagagcttagcaggagtcctagccctttcacccatacacatttggctcagggttaccgaagaggggccaagaaattagagtcctcagaagagaacttatctagtgaggatgaagagcttccctgcttccaacacttgttatttggtaaagtaaacaatataccttctcagtctactaggcatagcaccgttgctaccgagtgtctgtctaagaacacagaggagaatttattatcattgaagaatagcttaaatgactgcagtaaccaggtaatattggcaaaggcatctcaggaacatcaccttagtgaggaaacaaaatgttctgctagcttgttttcttcacagtgcagtgaattggaagacttgactgcaaatacaaacacccaggatcctttcttgattggttcttccaaacaaatgaggcatcagtctgaaagccagggagttggtctgagtgacaaggaattggtttcagatgatgaagaaagaggaacgggcttggaagaaaataatcaagaagagcaaagcatggattcaaacttaggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctgggagctcctctcactcttcagtccttctactgtcctggctactaaatattttatgtacatcagcctgaaaaggacttctggctatgcaagggtcccttaaagattttctgcttgaagtctcccttggaaatctgccatgagcacaaaattatggtaatttttcacctgagaagattttaaaaccatttaaacgccaccaattgagcaagatgctgattcattatttatcagccctattctttctattcaggctgttgttggcttagggctggaagcacagagtggcttggcctcaagagaatagctggtttccctaagtttacttctctaaaaccctgtgttcacaaaggcagagagtcagacccttcaatggaaggagagtgcttgggatcgattatgtgacttaaagtcagaatagtccttgggcagttctcaaatgttggagtggaacattggggaggaaattctgaggcaggtattagaaatgaaaaggaaacttgaaacctgggcatggtggctcacgcctgtaatcccagcactttgggaggccaaggtgggcagatcactggaggtcaggagttcgaaaccagcctggccaacatggtgaaaccccatctctactaaaaatacagaaattagccggtcatggtggtggacacctgtaatcccagctactcaggtggctaaggcaggagaatcacttcagcccgggaggtggaggttgcagtgagccaagatcataccacggcactccagcctgggtgacagtgagactgtggctcaaaaaaaaaaaaaaaaaaaggaaaatgaaactagaagagatttctaaaagtctgagatatatttgctagatttctaaagaatgtgttctaaaacagcagaagattttcaagaaccggtttccaaagacagtcttctaattcctcattagtaataagtaaaatgtttattgttgtagctctggtatataatccattcctcttaaaatataagacctctggcatgaatatttcatatctataaaatgacagatcccaccaggaaggaagctgttgctttctttgaggtgatttttttcctttgctccctgttgctgaaaccatacagcttcataaataattttgcttgctgaaggaagaaaaagtgtttttcataaacccattatccaggactgtttatagctgttggaaggactaggtcttccctagcccccccagtgtgcaagggcagtgaagacttgattgtacaaaatacgttttgtaaatgttgtgctgttaacactgcaaataaacttggtagcaaacacttcc

SEQ ID NO: 572 - DNA, 3444 bp, Homo sapiens
ttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagcagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctgggagctcctctcactcttcagtccttctactgtcctggctactaaatattttatgtacatcagcctgaaaaggacttctggctatgcaagggtcccttaaagattttctgcttgaagtctcccttggaaatctgccatgagcacaaaattatggtaatttttcacctgagaagattttaaaaccatttaaacgccaccaattgagcaagatgctgattcattatttatcagccctattctttctattcaggctgttgttggcttagggctggaagcacagagtggcttggcctcaagagaatagctggtttccctaagtttacttctctaaaaccctgtgttcacaaaggcagagagtcagacccttcaatggaaggagagtgcttgggatcgattatgtgacttaaagtcagaatagtccttgggcagttctcaaatgttggagtggaacattggggaggaaattctgaggcaggtattagaaatgaaaaggaaacttgaaacctgggcatggtggctcacgcctgtaatcccagcactttgggaggccaaggtgggcagatcactggaggtcaggagttcgaaaccagcctggccaacatggtgaaaccccatctctactaaaaatacagaaattagccggtcatggtggtggacacctgtaatcccagctactcaggtggctaaggcaggagaatcacttcagcccgggaggtggaggttgcagtgagccaagatcataccacggcactccagcctgggtgacagtgagactgtggctcaaaaaaaaaaaaaaaaaaaggaaaatgaaactagaagagatttctaaaagtctgagatatatttgctagatttctaaagaatgtgttctaaaacagcagaagattttcaagaaccggtttccaaagacagtcttctaattcctcattagtaataagtaaaatgtttattgttgtagctctggtatataatccattcctcttaaaatataagacctctggcatgaatatttcatatctataaaatgacagatcccaccaggaaggaagctgttgctttctttgaggtgatttttttcctttgctccctgttgctgaaaccatacagcttcataaataattttgcttgctgaaggaagaaaaagtgtttttcataaacccattatccaggactgtttatagctgttggaaggactaggtcttccctagcccccccagtgtgcaagggcagtgaagacttgattgtacaaaatacgttttgtaaatgttgtgctgttaacactgcaaataaacttggtagcaaacacttcc

SEQ ID NO: 573 - DNA, 3780 bp, Homo sapiens
gtaccttgatttcgtattctgagaggctgctgcttagcggtagccccttggtttccgtggcaacggaaaagcgcgggaattacagataaattaaaactgcgactgcgcggcgtgagctcgctgagacttcctggacgggggacaggctgtggggtttctcagataactgggcccctgcgctcaggaggccttcaccctctgctctgggtaaagttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaagggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagcagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctgggagctcctctcactcttcagtccttctactgtcctggctactaaatattttatgtacatcagcctgaaaaggacttctggctatgcaagggtcccttaaagattttctgcttgaagtctcccttggaaatctgccatgagcacaaaattatggtaatttttcacctgagaagattttaaaaccatttaaacgccaccaattgagcaagatgctgattcattatttatcagccctattctttctattcaggctgttgttggcttagggctggaagcacagagtggcttggcctcaagagaatagctggtttccctaagtttacttctctaaaaccctgtgttcacaaaggcagagagtcagacccttcaatggaaggagagtgcttgggatcgattatgtgacttaaagtcagaatagtccttgggcagttctcaaatgttggagtggaacattggggaggaaattctgaggcaggtattagaaatgaaaaggaaacttgaaacctgggcatggtggctcacgcctgtaatcccagcactttgggaggccaaggtgggcagatcactggaggtcaggagttcgaaaccagcctggccaacatggtgaaaccccatctctactaaaaatacagaaattagccggtcatggtggtggacacctgtaatcccagctactcaggtggctaaggcaggagaatcacttcagcccgggaggtggaggttgcagtgagccaagatcataccacggcactccagcctgggtgacagtgagactgtggctcaaaaaaaaaaaaaaaaaaaggaaaatgaaactagaagagatttctaaaagtctgagatatatttgctagatttctaaagaatgtgttctaaaacagcagaagattttcaagaaccggtttccaaagacagtcttctaattcctcattagtaataagtaaaatgtttattgttgtagctctggtatataatccattcctcttaaaatataagacctctggcatgaatatttcatatctataaaatgacagatcccaccaggaaggaagctgttgctttctttgaggtgatttttttcctttgctccctgttgctgaaaccatacagcttcataaataattttgcttgctgaaggaagaaaaagtgtttttcataaacccattatccaggactgtttatagctgttggaaggactaggtcttccctagcccccccagtgtgcaagggcagtgaagacttgattgtacaaaatacgttttgtaaatgttgtgctgttaacactgcaaataaacttggtagcaaacacttcc

SEQ ID NO: 574 - DNA, 6411 bp, Homo sapiens
gtaccttgatttcgtattctgagaggctgctgcttagcggtagccccttggtttccgtggcaacggaaaagcgcgggaattacagataaattaaaactgcgactgcgcggcgtgagctcgctgagacttcctggacgggggacaggctgtggggtttctcagataactgggcccctgcgctcaggaggccttcaccctctgctctgggtaaagttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagagataaagaaaaaaaagtacaaccaaatgccagtcaggcacagcagaaacctacaactcatggaaggtaaagaacctgcaactggagccaagaagagtaacaagccaaatgaacagacaagtaaaagacatgacagcgatactttcccagagctgaagttaacaaatgcacctggttcttttactaagtgttcaaataccagtgaacttaaagaatttgtcaatcctagccttccaagagaagaaaaagaagagaaactagaaacagttaaagtgtctaataatgctgaagaccccaaagatctcatgttaagtggagaaagggttttgcaaactgaaagatctgtagagagtagcagtatttcattggtacctggtactgattatggcactcaggaaagtatctcgttactggaagttagcactctagggaaggcaaaaacagaaccaaataaatgtgtgagtcagtgtgcagcatttgaaaaccccaagggactaattcatggttgttccaaagataatagaaatgacacagaaggctttaagtatccattgggacatgaagttaaccacagtcgggaaacaagcatagaaatggaagaaagtgaacttgatgctcagtatttgcagaatacattcaaggtttcaaagcgccagtcatttgctccgttttcaaatccaggaaatgcagaagaggaatgtgcaacattctctgcccactctgggtccttaaagaaacaaagtccaaaagtcacttttgaatgtgaacaaaaggaagaaaatcaaggaaagaatgagtctaatatcaagcctgtacagacagttaatatcactgcaggctttcctgtggttggtcagaaagataagccagttgataatgccaaatgtagtatcaaaggaggctctaggttttgtctatcatctcagttcagaggcaacgaaactggactcattactccaaataaacatggacttttacaaaacccatatcgtataccaccactttttcccatcaagtcatttgttaaaactaaatgtaagaaaaatctgctagaggaaaactttgaggaacattcaatgtcacctgaaagagaaatgggaaatgagaacattccaagtacagtgagcacaattagccgtaataacattagagaaaatgtttttaaagaagccagctcaagcaatattaatgaagtaggttccagtactaatgaagtgggctccagtattaatgaaataggttccagtgatgaaaacattcaagcagaactaggtagaaacagagggccaaaattgaatgctatgcttagattaggggttttgcaacctgaggtctataaacaaagtcttcctggaagtaattgtaagcatcctgaaataaaaaagcaagaatatgaagaagtagttcagactgttaatacagatttctctccatatctgatttcagataacttagaacagcctatgggaagtagtcatgcatctcaggtttgttctgagacacctgatgacctgttagatgatggtgaaataaaggaagatactagttttgctgaaaatgacattaaggaaagttctgctgtttttagcaaaagcgtccagaaaggagagcttagcaggagtcctagccctttcacccatacacatttggctcagggttaccgaagaggggccaagaaattagagtcctcagaagagaacttatctagtgaggatgaagagcttccctgcttccaacacttgttatttggtaaagtaaacaatataccttctcagtctactaggcatagcaccgttgctaccgagtgtctgtctaagaacacagaggagaatttattatcattgaagaatagcttaaatgactgcagtaaccaggtaatattggcaaaggcatctcaggaacatcaccttagtgaggaaacaaaatgttctgctagcttgttttcttcacagtgcagtgaattggaagacttgactgcaaatacaaacacccaggatcctttcttgattggttcttccaaacaaatgaggcatcagtctgaaagccagggagttggtctgagtgacaaggaattggtttcagatgatgaagaaagaggaacgggcttggaagaaaataatcaagaagagcaaagcatggattcaaacttaggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaaggggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctgggagctcctctcactcttcagtccttctactgtcctggctactaaatattttatgtacatcagcctgaaaaggacttctggctatgcaagggtcccttaaagattttctgcttgaagtctcccttggaaatctgccatgagcacaaaattatggtaatttttcacctgagaagattttaaaaccatttaaacgccaccaattgagcaagatgctgattcattatttatcagccctattctttctattcaggctgttgttggcttagggctggaagcacagagtggcttggcctcaagagaatagctggtttccctaagtttacttctctaaaaccctgtgttcacaaaggcagagagtcagacccttcaatggaaggagagtgcttgggatcgattatgtgacttaaagtcagaatagtccttgggcagttctcaaatgttggagtggaacattggggaggaaattctgaggcaggtattagaaatgaaaaggaaacttgaaacctgggcatggtggctcacgcctgtaatcccagcactttgggaggccaaggtgggcagatcactggaggtcaggagttcgaaaccagcctggccaacatggtgaaaccccatctctactaaaaatacagaaattagccggtcatggtggtggacacctgtaatcccagctactcaggtggctaaggcaggagaatcacttcagcccgggaggtggaggttgcagtgagccaagatcataccacggcactccagcctgggtgacagtgagactgtggctcaaaaaaaaaaaaaaaaaaaggaaaatgaaactagaagagatttctaaaagtctgagatatatttgctagatttctaaagaatgtgttctaaaacagcagaagattttcaagaaccggtttccaaagacagtcttctaattcctcattagtaataagtaaaatgtttattgttgtagctctggtatataatccattcctcttaaaatataagacctctggcatgaatatttcatatctataaaatgacagatcccaccaggaaggaagctgttgctttctttgaggtgatttttttcctttgctccctgttgctgaaaccatacagcttcataaataattttgcttgctgaaggaagaaaaagtgtttttcataaacccattatccaggactgtttatagctgttggaaggactaggtcttccctagcccccccagtgtgcaagggcagtgaagacttgattgtacaaaatacgttttgtaaatgttgtgctgttaacactgcaaataaacttggtagcaaacacttcc

SEQ ID NO: 575 - DNA, 7094 bp, Homo sapiens
gagctcgctgagacttcctggacgggggacaggctgtggggtttctcagataactgggcccctgcgctcaggaggccttcaccctctgctctgggtaaagttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagagataaagaaaaaaaagtacaaccaaatgccagtcaggcacagcagaaacctacaactcatggaaggtaaagaacctgcaactggagccaagaagagtaacaagccaaatgaacagacaagtaaaagacatgacagcgatactttcccagagctgaagttaacaaatgcacctggttcttttactaagtgttcaaataccagtgaacttaaagaatttgtcaatcctagccttccaagagaagaaaaagaagagaaactagaaacagttaaagtgtctaataatgctgaagaccccaaagatctcatgttaagtggagaaagggttttgcaaactgaaagatctgtagagagtagcagtatttcattggtacctggtactgattatggcactcaggaaagtatctcgttactggaagttagcactctagggaaggcaaaaacagaaccaaataaatgtgtgagtcagtgtgcagcatttgaaaaccccaagggactaattcatggttgttccaaagataatagaaatgacacagaaggctttaagtatccattgggacatgaagttaaccacagtcgggaaacaagcatagaaatggaagaaagtgaacttgatgctcagtatttgcagaatacattcaaggtttcaaagcgccagtcatttgctccgttttcaaatccaggaaatgcagaagaggaatgtgcaacattctctgcccactctgggtccttaaagaaacaaagtccaaaagtcacttttgaatgtgaacaaaaggaagaaaatcaaggaaagaatgagtctaatatcaagcctgtacagacagttaatatcactgcaggctttcctgtggttggtcagaaagataagccagttgataatgccaaatgtagtatcaaaggaggctctaggttttgtctatcatctcagttcagaggcaacgaaactggactcattactccaaataaacatggacttttacaaaacccatatcgtataccaccactttttcccatcaagtcatttgttaaaactaaatgtaagaaaaatctgctagaggaaaactttgaggaacattcaatgtcacctgaaagagaaatgggaaatgagaacattccaagtacagtgagcacaattagccgtaataacattagagaaaatgtttttaaagaagccagctcaagcaatattaatgaagtaggttccagtactaatgaagtgggctccagtattaatgaaataggttccagtgatgaaaacattcaagcagaactaggtagaaacagagggccaaaattgaatgctatgcttagattaggggttttgcaacctgaggtctataaacaaagtcttcctggaagtaattgtaagcatcctgaaataaaaaagcaagaatatgaagaagtagttcagactgttaatacagatttctctccatatctgatttcagataacttagaacagcctatgggaagtagtcatgcatctcaggtttgttctgagacacctgatgacctgttagatgatggtgaaataaaggaagatactagttttgctgaaaatgacattaaggaaagttctgctgtttttagcaaaagcgtccagaaaggagagcttagcaggagtcctagccctttcacccatacacatttggctcagggttaccgaagaggggccaagaaattagagtcctcagaagagaacttatctagtgaggatgaagagcttccctgcttccaacacttgttatttggtaaagtaaacaatataccttctcagtctactaggcatagcaccgttgctaccgagtgtctgtctaagaacacagaggagaatttattatcattgaagaatagcttaaatgactgcagtaaccaggtaatattggcaaaggcatctcaggaacatcaccttagtgaggaaacaaaatgttctgctagcttgttttcttcacagtgcagtgaattggaagacttgactgcaaatacaaacacccaggatcctttcttgattggttcttccaaacaaatgaggcatcagtctgaaagccagggagttggtctgagtgacaaggaattggtttcagatgatgaagaaagaggaacgggcttggaagaaaataatcaagaagagcaaagcatggattcaaacttaggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagcagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctgggagctcctctcactcttcagtccttctactgtcctggctactaaatattttatgtacatcagcctgaaaaggacttctggctatgcaagggtcccttaaagattttctgcttgaagtctcccttggaaatctgccatgagcacaaaattatggtaatttttcacctgagaagattttaaaaccatttaaacgccaccaattgagcaagatgctgattcattatttatcagccctattctttctattcaggctgttgttggcttagggctggaagcacagagtggcttggcctcaagagaatagctggtttccctaagtttacttctctaaaaccctgtgttcacaaaggcagagagtcagacccttcaatggaaggagagtgcttgggatcgattatgtgacttaaagtcagaatagtccttgggcagttctcaaatgttggagtggaacattggggaggaaattctgaggcaggtattagaaatgaaaaggaaacttgaaacctgggcatggtggctcacgcctgtaatcccagcactttgggaggccaaggtgggcagatcactggaggtcaggagttcgaaaccagcctggccaacatggtgaaaccccatctctactaaaaatacagaaattagccggtcatggtggtggacacctgtaatcccagctactcaggtggctaaggcaggagaatcacttcagcccgggaggtggaggttgcagtgagccaagatcataccacggcactccagcctgggtgacagtgagactgtggctcaaaaaaaaaaaaaaaaaaaggaaaatgaaactagaagagatttctaaaagtctgagatatatttgctagatttctaaagaatgtgttctaaaacagcagaagattttcaagaaccggtttccaaagacagtcttctaattcctcattagtaataagtaaaatgtttattgttgtagctctggtatataatccattcctcttaaaatataagacctctggcatgaatatttcatatctataaaatgacagatcccaccaggaaggaagctgttgctttctttgaggtgatttttttcctttgctccctgttgctgaaaccatacagcttcataaataattttgcttgctgaaggaagaaaaagtgtttttcataaacccattatccaggactgtttatagctgttggaaggactaggtcttccctagcccccccagtgtgcaagggcagtgaagacttgattgtacaaaatacgttttgtaaatgttgtgctgttaacactgcaaataaacttggtagcaaacacttcca

SEQ ID NO: 576 - DNA, 2420 bp, Homo sapiens
attgctcagcggtttccgtggcaacagtaaagcgtgggaattacagataaattaaaactgtggaacccctttcctcggctgccgccaaggtgttcggtccttccgaggaagctaaggccgcgttggggtgagaccctcacttcatccgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctg

SEQ ID NO: 577 - DNA, 7269 bp, Homo sapiens
gtaccttgatttcgtattctgagaggctgctgcttagcggtagccccttggtttccgtggcaacggaaaagcgcgggaattacagataaattaaaactgcgactgcgcggcgtgagctcgctgagacttcctggacgggggacaggctgtggggtttctcagataactgggcccctgcgctcaggaggccttcaccctctgctctgggtaaagttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagagataaagaaaaaaaagtacaaccaaatgccagtcaggcacagcagaaacctacaactcatggaaggtaaagaacctgcaactggagccaagaagagtaacaagccaaatgaacagacaagtaaaagacatgacagcgatactttcccagagctgaagttaacaaatgcacctggttcttttactaagtgttcaaataccagtgaacttaaagaatttgtcaatcctagccttccaagagaagaaaaagaagagaaactagaaacagttaaagtgtctaataatgctgaagaccccaaagatctcatgttaagtggagaaagggttttgcaaactgaaagatctgtagagagtagcagtatttcattggtacctggtactgattatggcactcaggaaagtatctcgttactggaagttagcactctagggaaggcaaaaacagaaccaaataaatgtgtgagtcagtgtgcagcatttgaaaaccccaagggactaattcatggttgttccaaagataatagaaatgacacagaaggctttaagtatccattgggacatgaagttaaccacagtcgggaaacaagcatagaaatggaagaaagtgaacttgatgctcagtatttgcagaatacattcaaggtttcaaagcgccagtcatttgctccgttttcaaatccaggaaatgcagaagaggaatgtgcaacattctctgcccactctgggtccttaaagaaacaaagtccaaaagtcacttttgaatgtgaacaaaaggaagaaaatcaaggaaagaatgagtctaatatcaagcctgtacagacagttaatatcactgcaggctttcctgtggttggtcagaaagataagccagttgataatgccaaatgtagtatcaaaggaggctctaggttttgtctatcatctcagttcagaggcaacgaaactggactcattactccaaataaacatggacttttacaaaacccatatcgtataccaccactttttcccatcaagtcatttgttaaaactaaatgtaagaaaaatctgctagaggaaaactttgaggaacattcaatgtcacctgaaagagaaatgggaaatgagaacattccaagtacagtgagcacaattagccgtaataacattagagaaaatgtttttaaagaagccagctcaagcaatattaatgaagtaggttccagtactaatgaagtgggctccagtattaatgaaataggttccagtgatgaaaacattcaagcagaactaggtagaaacagagggccaaaattgaatgctatgcttagattaggggttttgcaacctgaggtctataaacaaagtcttcctggaagtaattgtaagcatcctgaaataaaaaagcaagaatatgaagaagtagttcagactgttaatacagatttctctccatatctgatttcagataacttagaacagcctatgggaagtagtcatgcatctcaggtttgttctgagacacctgatgacctgttagatgatggtgaaataaaggaagatactagttttgctgaaaatgacattaaggaaagttctgctgtttttagcaaaagcgtccagaaaggagagcttagcaggagtcctagccctttcacccatacacatttggctcagggttaccgaagaggggccaagaaattagagtcctcagaagagaacttatctagtgaggatgaagagcttccctgcttccaacacttgttatttggtaaagtaaacaatataccttctcagtctactaggcatagcaccgttgctaccgagtgtctgtctaagaacacagaggagaatttattatcattgaagaatagcttaaatgactgcagtaaccaggtaatattggcaaaggcatctcaggaacatcaccttagtgaggaaacaaaatgttctgctagcttgttttcttcacagtgcagtgaattggaagacttgactgcaaatacaaacacccaggatcctttcttgattggttcttccaaacaaatgaggcatcagtctgaaagccagggagttggtctgagtgacaaggaattggtttcagatgatgaagaaagaggaacgggcttggaagaaaataatcaagaagagcaaagcatggattcaaacttaggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagattcgcatatacatggccaaaggaacaactccatgttttctaaaaggcctagagaacatatatcagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctgggagctcctctcactcttcagtccttctactgtcctggctactaaatattttatgtacatcagcctgaaaaggacttctggctatgcaagggtcccttaaagattttctgcttgaagtctcccttggaaatctgccatgagcacaaaattatggtaatttttcacctgagaagattttaaaaccatttaaacgccaccaattgagcaagatgctgattcattatttatcagccctattctttctattcaggctgttgttggcttagggctggaagcacagagtggcttggcctcaagagaatagctggtttccctaagtttacttctctaaaaccctgtgttcacaaaggcagagagtcagacccttcaatggaaggagagtgcttgggatcgattatgtgacttaaagtcagaatagtccttgggcagttctcaaatgttggagtggaacattggggaggaaattctgaggcaggtattagaaatgaaaaggaaacttgaaacctgggcatggtggctcacgcctgtaatcccagcactttgggaggccaaggtgggcagatcactggaggtcaggagttcgaaaccagcctggccaacatggtgaaaccccatctctactaaaaatacagaaattagccggtcatggtggtggacacctgtaatcccagctactcaggtggctaaggcaggagaatcacttcagcccgggaggtggaggttgcagtgagccaagatcataccacggcactccagcctgggtgacagtgagactgtggctcaaaaaaaaaaaaaaaaaaaggaaaatgaaactagaagagatttctaaaagtctgagatatatttgctagatttctaaagaatgtgttctaaaacagcagaagattttcaagaaccggtttccaaagacagtcttctaattcctcattagtaataagtaaaatgtttattgttgtagctctggtatataatccattcctcttaaaatataagacctctggcatgaatatttcatatctataaaatgacagatcccaccaggaaggaagctgttgctttctttgaggtgatttttttcctttgctccctgttgctgaaaccatacagcttcataaataattttgcttgctgaaggaagaaaaagtgtttttcataaacccattatccaggactgtttatagctgttggaaggactaggtcttccctagcccccccagtgtgcaagggcagtgaagacttgattgtacaaaatacgttttgtaaatgttgtgctgttaacactgcaaataaacttggtagcaaacacttcc

SEQ ID NO: 578 - DNA, 5693 bp, Homo sapiens
cctctgctctgggtaaaggtagtagagtcccgggaaagggacagggggcccaagtgatgctctggggtactggcgtgggagagtggatttccgaagctgacagatggttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagagataaagaaaaaaaagtacaaccaaatgccagtcaggcacagcagaaacctacaactcatggaaggtaaagaacctgcaactggagccaagaagagtaacaagccaaatgaacagacaagtaaaagacatgacagcgatactttcccagagctgaagttaacaaatgcacctggttcttttactaagtgttcaaataccagtgaacttaaagaatttgtcaatcctagccttccaagagaagaaaaagaagagaaactagaaacagttaaagtgtctaataatgctgaagaccccaaagatctcatgttaagtggagaaagggttttgcaaactgaaagatctgtagagagtagcagtatttcattggtacctggtactgattatggcactcaggaaagtatctcgttactggaagttagcactctagggaaggcaaaaacagaaccaaataaatgtgtgagtcagtgtgcagcatttgaaaaccccaagggactaattcatggttgttccaaagataatagaaatgacacagaaggctttaagtatccattgggacatgaagttaaccacagtcgggaaacaagcatagaaatggaagaaagtgaacttgatgctcagtatttgcagaatacattcaaggtttcaaagcgccagtcatttgctccgttttcaaatccaggaaatgcagaagaggaatgtgcaacattctctgcccactctgggtccttaaagaaacaaagtccaaaagtcacttttgaatgtgaacaaaaggaagaaaatcaaggaaagaatgagtctaatatcaagcctgtacagacagttaatatcactgcaggctttcctgtggttggtcagaaagataagccagttgataatgccaaatgtagtatcaaaggaggctctaggttttgtctatcatctcagttcagaggcaacgaaactggactcattactccaaataaacatggacttttacaaaacccatatcgtataccaccactttttcccatcaagtcatttgttaaaactaaatgtaagaaaaatctgctagaggaaaactttgaggaacattcaatgtcacctgaaagagaaatgggaaatgagaacattccaagtacagtgagcacaattagccgtaataacattagagaaaatgtttttaaagaagccagctcaagcaatattaatgaagtaggttccagtactaatgaagtgggctccagtattaatgaaataggttccagtgatgaaaacattcaagcagaactaggtagaaacagagggccaaaattgaatgctatgcttagattaggggttttgcaacctgaggtctataaacaaagtcttcctggaagtaattgtaagcatcctgaaataaaaaagcaagaatatgaagaagtagttcagactgttaatacagatttctctccatatctgatttcagataacttagaacagcctatgggaagtagtcatgcatctcaggtttgttctgagacacctgatgacctgttagatgatggtgaaataaaggaagatactagttttgctgaaaatgacattaaggaaagttctgctgtttttagcaaaagcgtccagaaaggagagcttagcaggagtcctagccctttcacccatacacatttggctcagggttaccgaagaggggccaagaaattagagtcctcagaagagaacttatctagtgaggatgaagagcttccctgcttccaacacttgttatttggtaaagtaaacaatataccttctcagtctactaggcatagcaccgttgctaccgagtgtctgtctaagaacacagaggagaatttattatcattgaagaatagcttaaatgactgcagtaaccaggtaatattggcaaaggcatctcaggaacatcaccttagtgaggaaacaaaatgttctgctagcttgttttcttcacagtgcagtgaattggaagacttgactgcaaatacaaacacccaggatcctttcttgattggttcttccaaacaaatgaggcatcagtctgaaagccagggagttggtctgagtgacaaggaattggtttcagatgatgaagaaagaggaacgggcttggaagaaaataatcaagaagagcaaagcatggattcaaacttaggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagcagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactga

SEQ ID NO: 579 - DNA, 582 bp, Homo sapiens
gagctcgctgagacttcctggacgggggacaggctgtggggtttctcagataactgggcccctgcgctcaggaggccttcaccctctgctctggttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaac

SEQ ID NO: 580 - DNA, 3273 bp, Homo sapiens
cttagcggtagccccttggtttccgtggcaacggaaaagcgcgggaattacagataaattaaaactgcgactgcgcggcgtgagctcgctgagacttcctggacgggggacaggctgtggggtttctcagataactgggcccctgcgctcaggaggccttcaccctctgctctggttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctgggagctcctctcactcttcagtccttctactgtcctggctactaaatattttatgtacatcagcctgaaaaggacttctggctatgcaagggtcccttaaagattttctgcttgaagtctcccttggaaatctgccatgagcacaaaattatggtaatttttcacctgagaagattttaaaaccatttaaacgccaccaattgagcaagatgctgattcattatttatcagccctattctttctattcaggctgttgttggcttagggctggaagcacagagtggcttggcctcaagagaatagctggtttccctaagtttacttctctaaaaccctgtgttcacaaaggcagagagtcagacccttcaatggaaggagagtgcttgggatcgattatgtgacttaaagtcagaatagtccttgggcagttctcaaatgttggagtggaacattggggaggaaattctgaggcaggtattagaaatgaaaaggaaacttgaaacctgggcatggtggctcacgcctgtaatcccagcactttgggaggccaaggtgggcagatcactggaggtcaggagttcgaaaccagcctggccaacatggtgaaaccccatctctactaaaaatacagaaattagccggtcatggtggtggacacctgtaatcccagctactcaggtggctaaggcaggagaatcacttcagcccgggaggtggaggttgcagtgagccaagatcataccacggcactccagcctgggtgacagtgagactgtggctcaaaaaaaaaaaaaaaaaaa

SEQ ID NO: 581 - DNA, 2108 bp, Homo sapiens
agataactgggcccctgcgctcaggaggccttcaccctctgctctgggtaaaggtagtagagtcccgggaaagggacagggggcccaagtgatgctctggggtactggcgtgggagagtggatttccgaagctgacagatggttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagag

SEQ ID NO: 582 - DNA, 5939 bp, Homo sapiens
gtaccttgatttcgtattctgagaggctgctgcttagcggtagccccttggtttccgtggcaacggaaaagcgcgggaattacagataaattaaaactgcgactgcgcggcgtgagctcgctgagacttcctggacgggggacaggctgtggggtttctcagataactgggcccctgcgctcaggaggccttcaccctctgctctgggtaaagttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagagataaagaaaaaaaagtacaaccaaatgccagtcaggcacagcagaaacctacaactcatggaaggtaaagaacctgcaactggagccaagaagagtaacaagccaaatgaacagacaagtaaaagacatgacagcgatactttcccagagctgaagttaacaaatgcacctggttcttttactaagtgttcaaataccagtgaacttaaagaatttgtcaatcctagccttccaagagaagaaaaagaagagaaactagaaacagttaaagtgtctaataatgctgaagaccccaaagatctcatgttaagtggagaaagggttttgcaaactgaaagatctgtagagagtagcagtatttcattggtacctggtactgattatggcactcaggaaagtatctcgttactggaagttagcactctagggaaggcaaaaacagaaccaaataaatgtgtgagtcagtgtgcagcatttgaaaaccccaagggactaattcatggttgttccaaagataatagaaatgacacagaaggctttaagtatccattgggacatgaagttaaccacagtcgggaaacaagcatagaaatggaagaaagtgaacttgatgctcagtatttgcagaatacattcaaggtttcaaagcgccagtcatttgctccgttttcaaatccaggaaatgcagaagaggaatgtgcaacattctctgcccactctgggtccttaaagaaacaaagtccaaaagtcacttttgaatgtgaacaaaaggaagaaaatcaaggaaagaatgagtctaatatcaagcctgtacagacagttaatatcactgcaggctttcctgtggttggtcagaaagataagccagttgataatgccaaatgtagtatcaaaggaggctctaggttttgtctatcatctcagttcagaggcaacgaaactggactcattactccaaataaacatggacttttacaaaacccatatcgtataccaccactttttcccatcaagtcatttgttaaaactaaatgtaagaaaaatctgctagaggaaaactttgaggaacattcaatgtcacctgaaagagaaatgggaaatgagaacattccaagtacagtgagcacaattagccgtaataacattagagaaaatgtttttaaagaagccagctcaagcaatattaatgaagtaggttccagtactaatgaagtgggctccagtattaatgaaataggttccagtgatgaaaacattcaagcagaactaggtagaaacagagggccaaaattgaatgctatgcttagattaggggttttgcaacctgaggtctataaacaaagtcttcctggaagtaattgtaagcatcctgaaataaaaaagcaagaatatgaagaagtagttcagactgttaatacagatttctctccatatctgatttcagataacttagaacagcctatgggaagtagtcatgcatctcaggtttgttctgagacacctgatgacctgttagatgatggtgaaataaaggaagatactagttttgctgaaaatgacattaaggaaagttctgctgtttttagcaaaagcgtccagaaaggagagcttagcaggagtcctagccctttcacccatacacatttggctcagggttaccgaagaggggccaagaaattagagtcctcagaagagaacttatctagtgaggatgaagagcttccctgcttccaacacttgttatttggtaaagtaaacaatataccttctcagtctactaggcatagcaccgttgctaccgagtgtctgtctaagaacacagaggagaatttattatcattgaagaatagcttaaatgactgcagtaaccaggtaatattggcaaaggcatctcaggaacatcaccttagtgaggaaacaaaatgttctgctagcttgttttcttcacagtgcagtgaattggaagacttgactgcaaatacaaacacccaggatcctttcttgattggttcttccaaacaaatgaggcatcagtctgaaagccagggagttggtctgagtgacaaggaattggtttcagatgatgaagaaagaggaacgggcttggaagaaaataatcaagaagagcaaagcatggattcaaacttaggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagattcgcatatacatggccaaaggaacaactccatgttttctaaaaggcctagagaacatatatcagcagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagctta

SEQ ID NO: 583 - DNA, 769 bp, Homo sapiens
ctggacgggggacaggctgtggggtttctcagataactgggcccctgcgctcaggaggccttcaccctctgctctgggtaaagttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaagg

SEQ ID NO: 584 - DNA, 1980 bp, Homo sapiens
gctgagacttcctggacgggggacaggctgtggggtttctcagataactgggcccctgcgctcaggaggccttcaccctctgctctgggtaaagttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaagagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaag

SEQ ID NO: 585 - DNA, 1972 bp, Homo sapiens
gacttcctggacgggggacaggctgtggggtttctcagataactgggcccctgcgctcaggaggccttcaccctctgctctggttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagcagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaa

SEQ ID NO: 586 - DNA, 1495 bp, Homo sapiens
gagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttggaaaccagtctcagtgtccaactctctaaccttggaactgtgagaactctgaggacaaagcagcggatacaacctcaaaagacgtctgtctacattgaattggctgcttgtgaattttctgagacggatgtaacaaatactgaacatcatcaacccagtaataatgatttgaacaccactgagaagcgtgcagctgagaggcatccagaaaagtatcagggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagcagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaa

SEQ ID NO: 587 - DNA, 455 bp, Homo sapiens
ataactgggcccctgcgctcaggaggccttcaccctctgctctgggtaaaggtagtagagtcccgggaaagggacagggggcccaagtgatgctctggggtactggcgtgggagagtggatttccgaagctgacagatggttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaagagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcat

SEQ ID NO: 588 - DNA, 2379 bp, Homo sapiens
ttcctggacgggggacaggctgtggggtttctcagataactgggcccctgcgctcaggaggccttcaccctctgctctggttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactga

SEQ ID NO: 589 - DNA, 1584 bp, Homo sapiens
ggaggccttcaccctctgctctgggtaaagttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaggtcttactctgttgtcccagctggagtacagtggtgcgatcatgaggcttactgttgccttgacctcctaggctcaagcgatcctatcacctcagtctcccaagtagctgggactattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaac

SEQ ID NO: 590 - DNA, 5732 bp, Homo sapiens
acagataaattaaaactgcgactgcgcggcgtgagctcgctgagacttcctggacgggggacaggctgtggggtttctcagataactgggcccctgcgctcaggaggccttcaccctctgctctggttcattggaacagaaagaaatggatttatctgctcttcgcgttgaagaagtacaaaatgtcattaatgctatgcagaaaatcttagagtgtcccatctgattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagagataaagaaaaaaaagtacaaccaaatgccagtcaggcacagcagaaacctacaactcatggaaggtaaagaacctgcaactggagccaagaagagtaacaagccaaatgaacagacaagtaaaagacatgacagcgatactttcccagagctgaagttaacaaatgcacctggttcttttactaagtgttcaaataccagtgaacttaaagaatttgtcaatcctagccttccaagagaagaaaaagaagagaaactagaaacagttaaagtgtctaataatgctgaagaccccaaagatctcatgttaagtggagaaagggttttgcaaactgaaagatctgtagagagtagcagtatttcattggtacctggtactgattatggcactcaggaaagtatctcgttactggaagttagcactctagggaaggcaaaaacagaaccaaataaatgtgtgagtcagtgtgcagcatttgaaaaccccaagggactaattcatggttgttccaaagataatagaaatgacacagaaggctttaagtatccattgggacatgaagttaaccacagtcgggaaacaagcatagaaatggaagaaagtgaacttgatgctcagtatttgcagaatacattcaaggtttcaaagcgccagtcatttgctccgttttcaaatccaggaaatgcagaagaggaatgtgcaacattctctgcccactctgggtccttaaagaaacaaagtccaaaagtcacttttgaatgtgaacaaaaggaagaaaatcaaggaaagaatgagtctaatatcaagcctgtacagacagttaatatcactgcaggctttcctgtggttggtcagaaagataagccagttgataatgccaaatgtagtatcaaaggaggctctaggttttgtctatcatctcagttcagaggcaacgaaactggactcattactccaaataaacatggacttttacaaaacccatatcgtataccaccactttttcccatcaagtcatttgttaaaactaaatgtaagaaaaatctgctagaggaaaactttgaggaacattcaatgtcacctgaaagagaaatgggaaatgagaacattccaagtacagtgagcacaattagccgtaataacattagagaaaatgtttttaaagaagccagctcaagcaatattaatgaagtaggttccagtactaatgaagtgggctccagtattaatgaaataggttccagtgatgaaaacattcaagcagaactaggtagaaacagagggccaaaattgaatgctatgcttagattaggggttttgcaacctgaggtctataaacaaagtcttcctggaagtaattgtaagcatcctgaaataaaaaagcaagaatatgaagaagtagttcagactgttaatacagatttctctccatatctgatttcagataacttagaacagcctatgggaagtagtcatgcatctcaggtttgttctgagacacctgatgacctgttagatgatggtgaaataaaggaagatactagttttgctgaaaatgacattaaggaaagttctgctgtttttagcaaaagcgtccagaaaggagagcttagcaggagtcctagccctttcacccatacacatttggctcagggttaccgaagaggggccaagaaattagagtcctcagaagagaacttatctagtgaggatgaagagcttccctgcttccaacacttgttatttggtaaagtaaacaatataccttctcagtctactaggcatagcaccgttgctaccgagtgtctgtctaagaacacagaggagaatttattatcattgaagaatagcttaaatgactgcagtaaccaggtaatattggcaaaggcatctcaggaacatcaccttagtgaggaaacaaaatgttctgctagcttgttttcttcacagtgcagtgaattggaagacttgactgcaaatacaaacacccaggatcctttcttgattggttcttccaaacaaatgaggcatcagtctgaaagccagggagttggtctgagtgacaaggaattggtttcagatgatgaagaaagaggaacgggcttggaagaaaataatcaagaagagcaaagcatggattcaaacttaggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagcagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagctta

SEQ ID NO: 591 - DNA, 1948 bp, Homo sapiens
acagataaattaaaactgcgactgcgcggcgtgagctcgctgagacttcctggacgggggacaggctgtggggtttctcagataactgggcccctgcgctcaggaggccttcaccctctgctctggttcattggaacagaaagaaatggatttatctgctcttcgcgttgaagaagtacaaaatgtcattaatgctatgcagaaaatcttagagtgtcccatctgattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagcagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtct

SEQ ID NO: 592 - DNA, 1612 bp, Homo sapiens
ttagcggtagccccttggtttccgtggcaacggaaaagcgcgggaattacagataaattaaaactgcgactgcgcggcgtgagctcgctgagacttcctggacgggggacaggctgtggggtttctcagataactgggcccctgcgctcaggaggccttcaccctctgctctggttcattggaacagaaagaaatggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaac

SEQ ID NO: 593 - DNA, 779 bp, Homo sapiens
ggaggccttcaccctctgctctgggtaaagctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaac

SEQ ID NO: 594 - DNA, 10930 bp, Homo sapiens
gggcttgtggcgcgagcttctgaaactaggcggcagaggcggagccgctgtggcactgctgcgcctctgctgcgcctcgggtgtcttttgcggcggtgggtcgccgccgggagaagcgtgaggggacagatttgtgaccggcgcggtttttgtcagcttactccggccaaaaaagaactgcacctctggagcggacttatttaccaagcattggaggaatatcgtaggtaaaaatgcctattggatccaaagagaggccaacattttttgaaatttttaagacacgctgcaacaaagcagatttaggaccaataagtcttaattggtttgaagaactttcttcagaagctccaccctataattctgaacctgcagaagaatctgaacataaaaacaacaattacgaaccaaacctatttaaaactccacaaaggaaaccatcttataatcagctggcttcaactccaataatattcaaagagcaagggctgactctgccgctgtaccaatctcctgtaaaagaattagataaattcaaattagacttaggaaggaatgttcccaatagtagacataaaagtcttcgcacagtgaaaactaaaatggatcaagcagatgatgtttcctgtccacttctaaattcttgtcttagtgaaagtcctgttgttctacaatgtacacatgtaacaccacaaagagataagtcagtggtatgtgggagtttgtttcatacaccaaagtttgtgaagggtcgtcagacaccaaaacatatttctgaaagtctaggagctgaggtggatcctgatatgtcttggtcaagttctttagctacaccacccacccttagttctactgtgctcatagtcagaaatgaagaagcatctgaaactgtatttcctcatgatactactgctaatgtgaaaagctatttttccaatcatgatgaaagtctgaagaaaaatgatagatttatcgcttctgtgacagacagtgaaaacacaaatcaaagagaagctgcaagtcatggatttggaaaaacatcagggaattcatttaaagtaaatagctgcaaagaccacattggaaagtcaatgccaaatgtcctagaagatgaagtatatgaaacagttgtagatacctctgaagaagatagtttttcattatgtttttctaaatgtagaacaaaaaatctacaaaaagtaagaactagcaagactaggaaaaaaattttccatgaagcaaacgctgatgaatgtgaaaaatctaaaaaccaagtgaaagaaaaatactcatttgtatctgaagtggaaccaaatgatactgatccattagattcaaatgtagcaaatcagaagccctttgagagtggaagtgacaaaatctccaaggaagttgtaccgtctttggcctgtgaatggtctcaactaaccctttcaggtctaaatggagcccagatggagaaaatacccctattgcatatttcttcatgtgaccaaaatatttcagaaaaagacctattagacacagagaacaaaagaaagaaagattttcttacttcagagaattctttgccacgtatttctagcctaccaaaatcagagaagccattaaatgaggaaacagtggtaaataagagagatgaagagcagcatcttgaatctcatacagactgcattcttgcagtaaagcaggcaatatctggaacttctccagtggcttcttcatttcagggtatcaaaaagtctatattcagaataagagaatcacctaaagagactttcaatgcaagtttttcaggtcatatgactgatccaaactttaaaaaagaaactgaagcctctgaaagtggactggaaatacatactgtttgctcacagaaggaggactccttatgtccaaatttaattgataatggaagctggccagccaccaccacacagaattctgtagctttgaagaatgcaggtttaatatccactttgaaaaagaaaacaaataagtttatttatgctatacatgatgaaacatcttataaaggaaaaaaaataccgaaagaccaaaaatcagaactaattaactgttcagcccagtttgaagcaaatgcttttgaagcaccacttacatttgcaaatgctgattcaggtttattgcattcttctgtgaaaagaagctgttcacagaatgattctgaagaaccaactttgtccttaactagctcttttgggacaattctgaggaaatgttctagaaatgaaacatgttctaataatacagtaatctctcaggatcttgattataaagaagcaaaatgtaataaggaaaaactacagttatttattaccccagaagctgattctctgtcatgcctgcaggaaggacagtgtgaaaatgatccaaaaagcaaaaaagtttcagatataaaagaagaggtcttggctgcagcatgtcacccagtacaacattcaaaagtggaatacagtgatactgactttcaatcccagaaaagtcttttatatgatcatgaaaatgccagcactcttattttaactcctacttccaaggatgttctgtcaaacctagtcatgatttctagaggcaaagaatcatacaaaatgtcagacaagctcaaaggtaacaattatgaatctgatgttgaattaaccaaaaatattcccatggaaaagaatcaagatgtatgtgctttaaatgaaaattataaaaacgttgagctgttgccacctgaaaaatacatgagagtagcatcaccttcaagaaaggtacaattcaaccaaaacacaaatctaagagtaatccaaaaaaatcaagaagaaactacttcaatttcaaaaataactgtcaatccagactctgaagaacttttctcagacaatgagaataattttgtcttccaagtagctaatgaaaggaataatcttgctttaggaaatactaaggaacttcatgaaacagacttgacttgtgtaaacgaacccattttcaagaactctaccatggttttatatggagacacaggtgataaacaagcaacccaagtgtcaattaaaaaagatttggtttatgttcttgcagaggagaacaaaaatagtgtaaagcagcatataaaaatgactctaggtcaagatttaaaatcggacatctccttgaatatagataaaataccagaaaaaaataatgattacatgaacaaatgggcaggactcttaggtccaatttcaaatcacagttttggaggtagcttcagaacagcttcaaataaggaaatcaagctctctgaacataacattaagaagagcaaaatgttcttcaaagatattgaagaacaatatcctactagtttagcttgtgttgaaattgtaaataccttggcattagataatcaaaagaaactgagcaagcctcagtcaattaatactgtatctgcacatttacagagtagtgtagttgtttctgattgtaaaaatagtcatataacccctcagatgttattttccaagcaggattttaattcaaaccataatttaacacctagccaaaaggcagaaattacagaactttctactatattagaagaatcaggaagtcagtttgaatttactcagtttagaaaaccaagctacatattgcagaagagtacatttgaagtgcctgaaaaccagatgactatcttaaagaccacttctgaggaatgcagagatgctgatcttcatgtcataatgaatgccccatcgattggtcaggtagacagcagcaagcaatttgaaggtacagttgaaattaaacggaagtttgctggcctgttgaaaaatgactgtaacaaaagtgcttctggttatttaacagatgaaaatgaagtggggtttaggggcttttattctgctcatggcacaaaactgaatgtttctactgaagctctgcaaaaagctgtgaaactgtttagtgatattgagaatattagtgaggaaacttctgcagaggtacatccaataagtttatcttcaagtaaatgtcatgattctgttgtttcaatgtttaagatagaaaatcataatgataaaactgtaagtgaaaaaaataataaatgccaactgatattacaaaataatattgaaatgactactggcacttttgttgaagaaattactgaaaattacaagagaaatactgaaaatgaagataacaaatatactgctgccagtagaaattctcataacttagaatttgatggcagtgattcaagtaaaaatgatactgtttgtattcataaagatgaaacggacttgctatttactgatcagcacaacatatgtcttaaattatctggccagtttatgaaggagggaaacactcagattaaagaagatttgtcagatttaacttttttggaagttgcgaaagctcaagaagcatgtcatggtaatacttcaaataaagaacagttaactgctactaaaacggagcaaaatataaaagattttgagacttctgatacattttttcagactgcaagtgggaaaaatattagtgtcgccaaagagtcatttaataaaattgtaaatttctttgatcagaaaccagaagaattgcataacttttccttaaattctgaattacattctgacataagaaagaacaaaatggacattctaagttatgaggaaacagacatagttaaacacaaaatactgaaagaaagtgtcccagttggtactggaaatcaactagtgaccttccagggacaacccgaacgtgatgaaaagatcaaagaacctactctattgggttttcatacagctagcgggaaaaaagttaaaattgcaaaggaatctttggacaaagtgaaaaacctttttgatgaaaaagagcaaggtactagtgaaatcaccagttttagccatcaatgggcaaagaccctaaagtacagagaggcctgtaaagaccttgaattagcatgtgagaccattgagatcacagctgccccaaagtgtaaagaaatgcagaattctctcaataatgataaaaaccttgtttctattgagactgtggtgccacctaagctcttaagtgataatttatgtagacaaactgaaaatctcaaaacatcaaaaagtatctttttgaaagttaaagtacatgaaaatgtagaaaaagaaacagcaaaaagtcctgcaacttgttacacaaatcagtccccttattcagtcattgaaaattcagccttagctttttacacaagttgtagtagaaaaacttctgtgagtcagacttcattacttgaagcaaaaaaatggcttagagaaggaatatttgatggtcaaccagaaagaataaatactgcagattatgtaggaaattatttgtatgaaaataattcaaacagtactatagctgaaaatgacaaaaatcatctctccgaaaaacaagatacttatttaagtaacagtagcatgtctaacagctattcctaccattctgatgaggtatataatgattcaggatatctctcaaaaaataaacttgattctggtattgagccagtattgaagaatgttgaagatcaaaaaaacactagtttttccaaagtaatatccaatgtaaaagatgcaaatgcatacccacaaactgtaaatgaagatatttgcgttgaggaacttgtgactagctcttcaccctgcaaaaataaaaatgcagccattaaattgtccatatctaatagtaataattttgaggtagggccacctgcatttaggatagccagtggtaaaatcgtttgtgtttcacatgaaacaattaaaaaagtgaaagacatatttacagacagtttcagtaaagtaattaaggaaaacaacgagaataaatcaaaaatttgccaaacgaaaattatggcaggttgttacgaggcattggatgattcagaggatattcttcataactctctagataatgatgaatgtagcacgcattcacataaggtttttgctgacattcagagtgaagaaattttacaacataaccaaaatatgtctggattggagaaagtttctaaaatatcaccttgtgatgttagtttggaaacttcagatatatgtaaatgtagtatagggaagcttcataagtcagtctcatctgcaaatacttgtgggatttttagcacagcaagtggaaaatctgtccaggtatcagatgcttcattacaaaacgcaagacaagtgttttctgaaatagaagatagtaccaagcaagtcttttccaaagtattgtttaaaagtaacgaacattcagaccagctcacaagagaagaaaatactgctatacgtactccagaacatttaatatcccaaaaaggcttttcatataatgtggtaaattcatctgctttctctggatttagtacagcaagtggaaagcaagtttccattttagaaagttccttacacaaagttaagggagtgttagaggaatttgatttaatcagaactgagcatagtcttcactattcacctacgtctagacaaaatgtatcaaaaatacttcctcgtgttgataagagaaacccagagcactgtgtaaactcagaaatggaaaaaacctgcagtaaagaatttaaattatcaaataacttaaatgttgaaggtggttcttcagaaaataatcactctattaaagtttctccatatctctctcaatttcaacaagacaaacaacagttggtattaggaaccaaagtgtcacttgttgagaacattcatgttttgggaaaagaacaggcttcacctaaaaacgtaaaaatggaaattggtaaaactgaaactttttctgatgttcctgtgaaaacaaatatagaagtttgttctacttactccaaagattcagaaaactactttgaaacagaagcagtagaaattgctaaagcttttatggaagatgatgaactgacagattctaaactgccaagtcatgccacacattctctttttacatgtcccgaaaatgaggaaatggttttgtcaaattcaagaattggaaaaagaagaggagagccccttatcttagtgggagaaccctcaatcaaaagaaacttattaaatgaatttgacaggataatagaaaatcaagaaaaatccttaaaggcttcaaaaagcactccagatggcacaataaaagatcgaagattgtttatgcatcatgtttctttagagccgattacctgtgtaccctttcgcacaactaaggaacgtcaagagatacagaatccaaattttaccgcacctggtcaagaatttctgtctaaatctcatttgtatgaacatctgactttggaaaaatcttcaagcaatttagcagtttcaggacatccattttatcaagtttctgctacaagaaatgaaaaaatgagacacttgattactacaggcagaccaaccaaagtctttgttccaccttttaaaactaaatcacattttcacagagttgaacagtgtgttaggaatattaacttggaggaaaacagacaaaagcaaaacattgatggacatggctctgatgatagtaaaaataagattaatgacaatgagattcatcagtttaacaaaaacaactccaatcaagcagtagctgtaactttcacaaagtgtgaagaagaacctttagatttaattacaagtcttcagaatgccagagatatacaggatatgcgaattaagaagaaacaaaggcaacgcgtctttccacagccaggcagtctgtatcttgcaaaaacatccactctgcctcgaatctctctgaaagcagcagtaggaggccaagttccctctgcgtgttctcataaacagctgtatacgtatggcgtttctaaacattgcataaaaattaacagcaaaaatgcagagtcttttcagtttcacactgaagattattttggtaaggaaagtttatggactggaaaaggaatacagttggctgatggtggatggctcataccctccaatgatggaaaggctggaaaagaagaattttatagggctctgtgtgacactccaggtgtggatccaaagcttatttctagaatttgggtttataatcactatagatggatcatatggaaactggcagctatggaatgtgcctttcctaaggaatttgctaatagatgcctaagcccagaaagggtgcttcttcaactaaaatacagatatgatacggaaattgatagaagcagaagatcggctataaaaaagataatggaaagggatgacacagctgcaaaaacacttgttctctgtgtttctgacataatttcattgagcgcaaatatatctgaaacttctagcaataaaactagtagtgcagatacccaaaaagtggccattattgaacttacagatgggtggtatgctgttaaggcccagttagatcctcccctcttagctgtcttaaagaatggcagactgacagttggtcagaagattattcttcatggagcagaactggtgggctctcctgatgcctgtacacctcttgaagccccagaatctcttatgttaaagatttctgctaacagtactcggcctgctcgctggtataccaaacttggattctttcctgaccctagaccttttcctctgcccttatcatcgcttttcagtgatggaggaaatgttggttgtgttgatgtaattattcaaagagcataccctatacagtggatggagaagacatcatctggattatacatatttcgcaatgaaagagaggaagaaaaggaagcagcaaaatatgtggaggcccaacaaaagagactagaagccttattcactaaaattcaggaggaatttgaagaacatgaagaaaacacaacaaaaccatatttaccatcacgtgcactaacaagacagcaagttcgtgctttgcaagatggtgcagagctttatgaagcagtgaagaatgcagcagacccagcttaccttgagggttatttcagtgaagagcagttaagagccttgaataatcacaggcaaatgttgaatgataagaaacaagctcagatccagttggaaattaggaaggccatggaatctgctgaacaaaaggaacaaggtttatcaagggatgtcacaaccgtgtggaagttgcgtattgtaagctattcaaaaaaagaaaaagattcagttatactgagtatttggcgtccatcatcagatttatattctctgttaacagaaggaaagagatacagaatttatcatcttgcaacttcaaaatctaaaagtaaatctgaaagagctaacatacagttagcagcgacaaaaaaaactcagtatcaacaactaccggtttcagatgaaattttatttcagatttaccagccacgggagccccttcacttcagcaaatttttagatccagactttcagccatcttgttctgaggtggacctaataggatttgtcgtttctgttgtgaaaaaaacaggacttgcccctttcgtctatttgtcagacgaatgttacaatttactggcaataaagttttggatagaccttaatgaggacattattaagcctcatatgttaattgctgcaagcaacctccagtggcgaccagaatccaaatcaggccttcttactttatttgctggagatttttctgtgttttctgctagtccaaaagagggccactttcaagagacattcaacaaaatgaaaaatactgttgagaatattgacatactttgcaatgaagcagaaaacaagcttatgcatatactgcatgcaaatgatcccaagtggtccaccccaactaaagactgtacttcagggccgtacactgctcaaatcattcctggtacaggaaacaagcttctgatgtcttctcctaattgtgagatatattatcaaagtcctttatcactttgtatggccaaaaggaagtctgtttccacacctgtctcagcccagatgacttcaaagtcttgtaaaggggagaaagagattgatgaccaaaagaactgcaaaaagagaagagccttggatttcttgagtagactgcctttacctccacctgttagtcccatttgtacatttgtttctccggctgcacagaaggcatttcagccaccaaggagttgtggcaccaaatacgaaacacccataaagaaaaaagaactgaattctcctcagatgactccatttaaaaaattcaatgaaatttctcttttggaaagtaattcaatagctgacgaagaacttgcattgataaatacccaagctcttttgtctggttcaacaggagaaaaacaatttatatctgtcagtgaatccactaggactgctcccaccagttcagaagattatctcagactgaaacgacgttgtactacatctctgatcaaagaacaggagagttcccaggccagtacggaagaatgtgagaaaaataagcaggacacaattacaactaaaaaatatatctaagcatttgcaaaggcgacaataaattattgacgcttaacctttccagtttataagactggaatataatttcaaaccacacattagtacttatgttgcacaatgagaaaagaaattagtttcaaatttacctcagcgtttgtgtatcgggcaaaaatcgttttgcccgattccgtattggtatacttttgcttcagttgcatatcttaaaactaaatgtaatttattaactaatcaagaaaaacatctttggctgagctcggtggctcatgcctgtaatcccaacactttgagaagctgaggtgggaggagtgcttgaggccaggagttcaagaccagcctgggcaacatagggagacccccatctttacaaagaaaaaaaaaaggggaaaagaaaatcttttaaatctttggatttgatcactacaagtattattttacaa

SEQ ID NO: 595 - DNA, 2009 bp, Homo sapiens
ggcagaggcggagccgctgtggcactgctgcgcctctgctgcgcctcgggtgtcttttgcggcggtgggtcgccgccgggagaagcgtgaggggacagatttgtgaccggcgcggtttttgtcagcttactccggccaaaaaagaactgcacctctggagcggacttatttaccaagcattggaggaatatcgtaggtaaaaatgcctattggatccaaagagaggccaacattttttgaaatttttaagacacgctgcaacaaagcaggaccaataagtcttaattggtttgaagaactttcttcagaagctccaccctataattctgaacctgcagaagaatctgaacataaaaacaacaattacgaaccaaacctatttaaaactccacaaaggaaaccatcttataatcagctggcttcaactccaataatattcaaagagcaagggctgactctgccgctgtaccaatctcctgtaaaagaattagataaattcaaattagacttaggaaggaatgttcccaatagtagacataaaagtcttcgcacagtgaaaactaaaatggatcaagcagatgatgtttcctgtccacttctaaattcttgtcttagtgaaagtcctgttgttctacaatgtacacatgtaacaccacaaagagataagtcagtggtatgtgggagtttgtttcatacaccaaagtttgtgaagggtcgtcagacaccaaaacatatttctgaaagtctaggagctgaggtggatcctgatatgtcttggtcaagttctttagctacaccacccacccttagttctactgtgctcatagtcagaaatgaagaagcatctgaaactgtatttcctcatgatactactgctaatgtgaaaagctatttttccaatcatgatgaaagtctgaagaaaaatgatagatttatcgcttctgtgacagacagtgaaaacacaaatcaaagagaagctgcaagtcatggatttggaaaaacatcagggaattcatttaaagtaaatagctgcaaagaccacattggaaagtcaatgccaaatgtcctagaagatgaagtatatgaaacagttgtagatacctctgaagaagatagtttttcattatgtttttctaaatgtagaacaaaaaatctacaaaaagtaagaactagcaagactaggaaaaaaattttccatgaagcaaacgctgatgaatgtgaaaaatctaaaaaccaagtgaaagaaaaatactcatttgtatctgaagtggaaccaaatgatactgatccattagattcaaatgtagcaaatcagaagccctttgagagtggaagtgacaaaatctccaaggaagttgtaccgtctttggcctgtgaatggtctcaactaaccctttcaggtctaaatggagcccagatggagaaaatacccctattgcatatttcttcatgtgaccaaaatatttcagaaaaagacctattagacacagagaacaaaagaaagaaagattttcttacttcagagaattctttgccacgtatttctagcctaccaaaatcagagaagccattaaatgaggaaacagtggtaaataagagagatgaagagcagcatcttgaatctcatacagactgcattcttgcagtaaagcaggcaatatctggaacttctccagtggcttcttcatttcagggtatcaaaaagtctatattcagaataagagaatcacctaaagagactttcaatgcaagtttttcaggtcatatgactgatccaaactttaaaaaagaaactgaagcctctgaaagtggactggaaatacatactgtttgctcacagaaggaggactccttatgtccaaatttaattgataatggaagctggccagccaccaccacacagaattctgtagctttgaagaatgcaggtttaatatccactttgaaaaagaaaacaaataagtttatttatgctatacatgatgaaacatcttataaaggaaaaaaaa

SEQ ID NO: 596 - DNA, 10984 bp, Homo sapiens
gtggcgcgagcttctgaaactaggcggcagaggcggagccgctgtggcactgctgcgcctctgctgcgcctcgggtgtcttttgcggcggtgggtcgccgccgggagaagcgtgaggggacagatttgtgaccggcgcggtttttgtcagcttactccggccaaaaaagaactgcacctctggagcggacttatttaccaagcattggaggaatatcgtaggtaaaaatgcctattggatccaaagagaggccaacattttttgaaatttttaagacacgctgcaacaaagcagatttaggaccaataagtcttaattggtttgaagaactttcttcagaagctccaccctataattctgaacctgcagaagaatctgaacataaaaacaacaattacgaaccaaacctatttaaaactccacaaaggaaaccatcttataatcagctggcttcaactccaataatattcaaagagcaagggctgactctgccgctgtaccaatctcctgtaaaagaattagataaattcaaattagacttaggaaggaatgttcccaatagtagacataaaagtcttcgcacagtgaaaactaaaatggatcaagcagatgatgtttcctgtccacttctaaattcttgtcttagtgaaagtcctgttgttctacaatgtacacatgtaacaccacaaagagataagtcagtggtatgtgggagtttgtttcatacaccaaagtttgtgaagggtcgtcagacaccaaaacatatttctgaaagtctaggagctgaggtggatcctgatatgtcttggtcaagttctttagctacaccacccacccttagttctactgtgctcatagtcagaaatgaagaagcatctgaaactgtatttcctcatgatactactgctaatgtgaaaagctatttttccaatcatgatgaaagtctgaagaaaaatgatagatttatcgcttctgtgacagacagtgaaaacacaaatcaaagagaagctgcaagtcatggatttggaaaaacatcagggaattcatttaaagtaaatagctgcaaagaccacattggaaagtcaatgccaaatgtcctagaagatgaagtatatgaaacagttgtagatacctctgaagaagatagtttttcattatgtttttctaaatgtagaacaaaaaatctacaaaaagtaagaactagcaagactaggaaaaaaattttccatgaagcaaacgctgatgaatgtgaaaaatctaaaaaccaagtgaaagaaaaatactcatttgtatctgaagtggaaccaaatgatactgatccattagattcaaatgtagcaaatcagaagccctttgagagtggaagtgacaaaatctccaaggaagttgtaccgtctttggcctgtgaatggtctcaactaaccctttcaggtctaaatggagcccagatggagaaaatacccctattgcatatttcttcatgtgaccaaaatatttcagaaaaagacctattagacacagagaacaaaagaaagaaagattttcttacttcagagaattctttgccacgtatttctagcctaccaaaatcagagaagccattaaatgaggaaacagtggtaaataagagagatgaagagcagcatcttgaatctcatacagactgcattcttgcagtaaagcaggcaatatctggaacttctccagtggcttcttcatttcagggtatcaaaaagtctatattcagaataagagaatcacctaaagagactttcaatgcaagtttttcaggtcatatgactgatccaaactttaaaaaagaaactgaagcctctgaaagtggactggaaatacatactgtttgctcacagaaggaggactccttatgtccaaatttaattgataatggaagctggccagccaccaccacacagaattctgtagctttgaagaatgcaggtttaatatccactttgaaaaagaaaacaaataagtttatttatgctatacatgatgaaacatcttataaaggaaaaaaaataccgaaagaccaaaaatcagaactaattaactgttcagcccagtttgaagcaaatgcttttgaagcaccacttacatttgcaaatgctgattcaggtttattgcattcttctgtgaaaagaagctgttcacagaatgattctgaagaaccaactttgtccttaactagctcttttgggacaattctgaggaaatgttctagaaatgaaacatgttctaataatacagtaatctctcaggatcttgattataaagaagcaaaatgtaataaggaaaaactacagttatttattaccccagaagctgattctctgtcatgcctgcaggaaggacagtgtgaaaatgatccaaaaagcaaaaaagtttcagatataaaagaagaggtcttggctgcagcatgtcacccagtacaacattcaaaagtggaatacagtgatactgactttcaatcccagaaaagtcttttatatgatcatgaaaatgccagcactcttattttaactcctacttccaaggatgttctgtcaaacctagtcatgatttctagaggcaaagaatcatacaaaatgtcagacaagctcaaaggtaacaattatgaatctgatgttgaattaaccaaaaatattcccatggaaaagaatcaagatgtatgtgctttaaatgaaaattataaaaacgttgagctgttgccacctgaaaaatacatgagagtagcatcaccttcaagaaaggtacaattcaaccaaaacacaaatctaagagtaatccaaaaaaatcaagaagaaactacttcaatttcaaaaataactgtcaatccagactctgaagaacttttctcagacaatgagaataattttgtcttccaagtagctaatgaaaggaataatcttgctttaggaaatactaaggaacttcatgaaacagacttgacttgtgtaaacgaacccattttcaagaactctaccatggttttatatggagacacaggtgataaacaagcaacccaagtgtcaattaaaaaagatttggtttatgttcttgcagaggagaacaaaaatagtgtaaagcagcatataaaaatgactctaggtcaagatttaaaatcggacatctccttgaatatagataaaataccagaaaaaaataatgattacatgaacaaatgggcaggactcttaggtccaatttcaaatcacagttttggaggtagcttcagaacagcttcaaataaggaaatcaagctctctgaacataacattaagaagagcaaaatgttcttcaaagatattgaagaacaatatcctactagtttagcttgtgttgaaattgtaaataccttggcattagataatcaaaagaaactgagcaagcctcagtcaattaatactgtatctgcacatttacagagtagtgtagttgtttctgattgtaaaaatagtcatataacccctcagatgttattttccaagcaggattttaattcaaaccataatttaacacctagccaaaaggcagaaattacagaactttctactatattagaagaatcaggaagtcagtttgaatttactcagtttagaaaaccaagctacatattgcagaagagtacatttgaagtgcctgaaaaccagatgactatcttaaagaccacttctgaggaatgcagagatgctgatcttcatgtcataatgaatgccccatcgattggtcaggtagacagcagcaagcaatttgaaggtacagttgaaattaaacggaagtttgctggcctgttgaaaaatgactgtaacaaaagtgcttctggttatttaacagatgaaaatgaagtggggtttaggggcttttattctgctcatggcacaaaactgaatgtttctactgaagctctgcaaaaagctgtgaaactgtttagtgatattgagaatattagtgaggaaacttctgcagaggtacatccaataagtttatcttcaagtaaatgtcatgattctgttgtttcaatgtttaagatagaaaatcataatgataaaactgtaagtgaaaaaaataataaatgccaactgatattacaaaataatattgaaatgactactggcacttttgttgaagaaattactgaaaattacaagagaaatactgaaaatgaagataacaaatatactgctgccagtagaaattctcataacttagaatttgatggcagtgattcaagtaaaaatgatactgtttgtattcataaagatgaaacggacttgctatttactgatcagcacaacatatgtcttaaattatctggccagtttatgaaggagggaaacactcagattaaagaagatttgtcagatttaacttttttggaagttgcgaaagctcaagaagcatgtcatggtaatacttcaaataaagaacagttaactgctactaaaacggagcaaaatataaaagattttgagacttctgatacattttttcagactgcaagtgggaaaaatattagtgtcgccaaagagtcatttaataaaattgtaaatttctttgatcagaaaccagaagaattgcataacttttccttaaattctgaattacattctgacataagaaagaacaaaatggacattctaagttatgaggaaacagacatagttaaacacaaaatactgaaagaaagtgtcccagttggtactggaaatcaactagtgaccttccagggacaacccgaacgtgatgaaaagatcaaagaacctactctattgggttttcatacagctagcgggaaaaaagttaaaattgcaaaggaatctttggacaaagtgaaaaacctttttgatgaaaaagagcaaggtactagtgaaatcaccagttttagccatcaatgggcaaagaccctaaagtacagagaggcctgtaaagaccttgaattagcatgtgagaccattgagatcacagctgccccaaagtgtaaagaaatgcagaattctctcaataatgataaaaaccttgtttctattgagactgtggtgccacctaagctcttaagtgataatttatgtagacaaactgaaaatctcaaaacatcaaaaagtatctttttgaaagttaaagtacatgaaaatgtagaaaaagaaacagcaaaaagtcctgcaacttgttacacaaatcagtccccttattcagtcattgaaaattcagccttagctttttacacaagttgtagtagaaaaacttctgtgagtcagacttcattacttgaagcaaaaaaatggcttagagaaggaatatttgatggtcaaccagaaagaataaatactgcagattatgtaggaaattatttgtatgaaaataattcaaacagtactatagctgaaaatgacaaaaatcatctctccgaaaaacaagatacttatttaagtaacagtagcatgtctaacagctattcctaccattctgatgaggtatataatgattcaggatatctctcaaaaaataaacttgattctggtattgagccagtattgaagaatgttgaagatcaaaaaaacactagtttttccaaagtaatatccaatgtaaaagatgcaaatgcatacccacaaactgtaaatgaagatatttgcgttgaggaacttgtgactagctcttcaccctgcaaaaataaaaatgcagccattaaattgtccatatctaatagtaataattttgaggtagggccacctgcatttaggatagccagtggtaaaatcgtttgtgtttcacatgaaacaattaaaaaagtgaaagacatatttacagacagtttcagtaaagtaattaaggaaaacaacgagaataaatcaaaaatttgccaaacgaaaattatggcaggttgttacgaggcattggatgattcagaggatattcttcataactctctagataatgatgaatgtagcacgcattcacataaggtttttgctgacattcagagtgaagaaattttacaacataaccaaaatatgtctggattggagaaagtttctaaaatatcaccttgtgatgttagtttggaaacttcagatatatgtaaatgtagtatagggaagcttcataagtcagtctcatctgcaaatacttgtgggatttttagcacagcaagtggaaaatctgtccaggtatcagatgcttcattacaaaacgcaagacaagtgttttctgaaatagaagatagtaccaagcaagtcttttccaaagtattgtttaaaagtaacgaacattcagaccagctcacaagagaagaaaatactgctatacgtactccagaacatttaatatcccaaaaaggcttttcatataatgtggtaaattcatctgctttctctggatttagtacagcaagtggaaagcaagtttccattttagaaagttccttacacaaagttaagggagtgttagaggaatttgatttaatcagaactgagcatagtcttcactattcacctacgtctagacaaaatgtatcaaaaatacttcctcgtgttgataagagaaacccagagcactgtgtaaactcagaaatggaaaaaacctgcagtaaagaatttaaattatcaaataacttaaatgttgaaggtggttcttcagaaaataatcactctattaaagtttctccatatctctctcaatttcaacaagacaaacaacagttggtattaggaaccaaagtgtcacttgttgagaacattcatgttttgggaaaagaacaggcttcacctaaaaacgtaaaaatggaaattggtaaaactgaaactttttctgatgttcctgtgaaaacaaatatagaagtttgttctacttactccaaagattcagaaaactactttgaaacagaagcagtagaaattgctaaagcttttatggaagatgatgaactgacagattctaaactgccaagtcatgccacacattctctttttacatgtcccgaaaatgaggaaatggttttgtcaaattcaagaattggaaaaagaagaggagagccccttatcttagtgggagaaccctcaatcaaaagaaacttattaaatgaatttgacaggataatagaaaatcaagaaaaatccttaaaggcttcaaaaagcactccagatggcacaataaaagatcgaagattgtttatgcatcatgtttctttagagccgattacctgtgtaccctttcgcacaactaaggaacgtcaagagatacagaatccaaattttaccgcacctggtcaagaatttctgtctaaatctcatttgtatgaacatctgactttggaaaaatcttcaagcaatttagcagtttcaggacatccattttatcaagtttctgctacaagaaatgaaaaaatgagacacttgattactacaggcagaccaaccaaagtctttgttccaccttttaaaactaaatcacattttcacagagttgaacagtgtgttaggaatattaacttggaggaaaacagacaaaagcaaaacattgatggacatggctctgatgatagtaaaaataagattaatgacaatgagattcatcagtttaacaaaaacaactccaatcaagcagtagctgtaactttcacaaagtgtgaagaagaacctttagatttaattacaagtcttcagaatgccagagatatacaggatatgcgaattaagaagaaacaaaggcaacgcgtctttccacagccaggcagtctgtatcttgcaaaaacatccactctgcctcgaatctctctgaaagcagcagtaggaggccaagttccctctgcgtgttctcataaacagctgtatacgtatggcgtttctaaacattgcataaaaattaacagcaaaaatgcagagtcttttcagtttcacactgaagattattttggtaaggaaagtttatggactggaaaaggaatacagttggctgatggtggatggctcataccctccaatgatggaaaggctggaaaagaagaattttatagggctctgtgtgacactccaggtgtggatccaaagcttatttctagaatttgggtttataatcactatagatggatcatatggaaactggcagctatggaatgtgcctttcctaaggaatttgctaatagatgcctaagcccagaaagggtgcttcttcaactaaaatacagatatgatacggaaattgatagaagcagaagatcggctataaaaaagataatggaaagggatgacacagctgcaaaaacacttgttctctgtgtttctgacataatttcattgagcgcaaatatatctgaaacttctagcaataaaactagtagtgcagatacccaaaaagtggccattattgaacttacagatgggtggtatgctgttaaggcccagttagatcctcccctcttagctgtcttaaagaatggcagactgacagttggtcagaagattattcttcatggagcagaactggtgggctctcctgatgcctgtacacctcttgaagccccagaatctcttatgttaaagatttctgctaacagtactcggcctgctcgctggtataccaaacttggattctttcctgaccctagaccttttcctctgcccttatcatcgcttttcagtgatggaggaaatgttggttgtgttgatgtaattattcaaagagcataccctatacagtggatggagaagacatcatctggattatacatatttcgcaatgaaagagaggaagaaaaggaagcagcaaaatatgtggaggcccaacaaaagagactagaagccttattcactaaaattcaggaggaatttgaagaacatgaagaaaacacaacaaaaccatatttaccatcacgtgcactaacaagacagcaagttcgtgctttgcaagatggtgcagagctttatgaagcagtgaagaatgcagcagacccagcttaccttgagggttatttcagtgaagagcagttaagagccttgaataatcacaggcaaatgttgaatgataagaaacaagctcagatccagttggaaattaggaaggccatggaatctgctgaacaaaaggaacaaggtttatcaagggatgtcacaaccgtgtggaagttgcgtattgtaagctattcaaaaaaagaaaaagattcagttatactgagtatttggcgtccatcatcagatttatattctctgttaacagaaggaaagagatacagaatttatcatcttgcaacttcaaaatctaaaagtaaatctgaaagagctaacatacagttagcagcgacaaaaaaaactcagtatcaacaactaccggtttcagatgaaattttatttcagatttaccagccacgggagccccttcacttcagcaaatttttagatccagactttcagccatcttgttctgaggtggacctaataggatttgtcgtttctgttgtgaaaaaaacaggacttgcccctttcgtctatttgtcagacgaatgttacaatttactggcaataaagttttggatagaccttaatgaggacattattaagcctcatatgttaattgctgcaagcaacctccagtggcgaccagaatccaaatcaggccttcttactttatttgctggagatttttctgtgttttctgctagtccaaaagagggccactttcaagagacattcaacaaaatgaaaaatactgttgagaatattgacatactttgcaatgaagcagaaaacaagcttatgcatatactgcatgcaaatgatcccaagtggtccaccccaactaaagactgtacttcagggccgtacactgctcaaatcattcctggtacaggaaacaagcttctgatgtcttctcctaattgtgagatatattatcaaagtcctttatcactttgtatggccaaaaggaagtctgtttccacacctgtctcagcccagatgacttcaaagtcttgtaaaggggagaaagagattgatgaccaaaagaactgcaaaaagagaagagccttggatttcttgagtagactgcctttacctccacctgttagtcccatttgtacatttgtttctccggctgcacagaaggcatttcagccaccaaggagttgtggcaccaaatacgaaacacccataaagaaaaaagaactgaattctcctcagatgactccatttaaaaaattcaatgaaatttctcttttggaaagtaattcaatagctgacgaagaacttgcattgataaatacccaagctcttttgtctggttcaacaggagaaaaacaatttatatctgtcagtgaatccactaggactgctcccaccagttcagaagattatctcagactgaaacgacgttgtactacatctctgatcaaagaacaggagagttcccaggccagtacggaagaatgtgagaaaaataagcaggacacaattacaactaaaaaatatatctaagcatttgcaaaggcgacaataaattattgacgcttaacctttccagtttataagactggaatataatttcaaaccacacattagtacttatgttgcacaatgagaaaagaaattagtttcaaatttacctcagcgtttgtgtatcgggcaaaaatcgttttgcccgattccgtattggtatacttttgcttcagttgcatatcttaaaactaaatgtaatttattaactaatcaagaaaaacatctttggctgagctcggtggctcatgcctgtaatcccaacactttgagaagctgaggtgggaggagtgcttgaggccaggagttcaagaccagcctgggcaacatagggagacccccatctttacaaagaaaaaaaaaaggggaaaagaaaatcttttaaatctttggatttgatcactacaagtattattttacaatcaacaaaatggtcatccaaactcaaacttgagaaaatatcttgctttcaaattggcact

SEQ ID NO: 597 - DNA, 3221 bp, Homo sapiens
tttgcctgccaggagtgggtgagggaggagcagccgccgccttcacagacacctggtagtgtcaggagagggcatgcactgccctggtgaggctcctctggctgcccccaggcccacacccaaggatccctgcctcagaaacgtgctggccaaagcgctctatgacaatgtggccgagtccccggatgagctctccttccgcaagggtgacatcatgacggtgctggagcaggacacgcagggcctggacggctggtggctctgctcgctgcatgggcgccagggcatcgtgcctgggaaccgcctcaagatcttggtgggcatgtatgataagaagccagcagggcctggccccggccctcccgccaccccggcccagcctcagcctggcctccatgccccagcgcctccggcctcccagtacacgcccatgctccccaacacctaccagccccagccagacagcgtctacctggtgcccactcccagcaaggctcagcaaggcctctaccaagtcccgggtcccagccctcagttccagtctcccccagccaagcagacatccaccttctcgaagcagacaccccatcacccgtttcccagcccggccacagacctgtaccaggtgcccccagggcctggaggccctgcccaggatatttaccaggtgccaccttctgccgggatggggcatgacatctaccaggtccccccgtccatggacacacgcagctgggagggcacgaagcccccggcaaaggtggtggtgcccacccgcgtggggcagggctatgtatacgaggccgcccagccggagcaggacgagtacgacatcccgcgacacctgctggccccggggccacaggacatctatgatgtgcccccggttcgggggctgcttcccagccagtatggccaggaggtgtatgacacaccccccatggctgtcaagggtcccaatggccgagacccgttgctggaggtgtatgacgtgccccccagtgtggagaagggcctgccaccgtccaaccaccacgcagtctacgacgttcctccatcggtgagcaaggatgtgcccgatggcccactgctgcgtgaggagacctacgatgtgccccccgccttcgccaaggccaagccctttgacccggcccgcaccccactggtactggctgcgccccctccagactccccgccggccgaggacgtgtatgacgtgccgcccccggctcctgacctctacgacgtgccccctggcttgcggcggcctggcccgggcaccctgtacgatgtgccccgtgaacgggtgcttcctcctgaggtggctgatggtggcgtggtcgacagtggtgtgtatgcggtgcctcccccagctgaacgtgaagccccggcagagggcaagcgcctgtcggcctccagcaccggcagcacacgcagcagccagtctgcgtcctccttggaggtggcagggccgggccgggaacccctggagctggaagttgctgtggaggccctggcacggctgcagcagggtgtgagcgccaccgttgcccaccttctggacctggcaggcagcgccggtgcgactgggagctggcgtagcccctctgagccacaggagccgctggtgcaggacctgcaggctgctgtggccgctgtccagagtgccgtccacgagctgttggagtttgcccgcagcgcggtgggcaatgctgcccacacatctgaccgtgccctgcatgccaagcttagccggcagctgcagaagatggaggacgtgcaccagacgctggtggcacatggtcaggccctcgacgctggccggggaggctctggagccacccttgaggacctggaccggctggtggcctgctcgcgggctgtgcccgaggacgccaagcagctggcctccttcctgcacggcaatgcctcactgctcttcagacggaccaaggccactgccccggggcctgaggggggtggcaccctgcaccccaaccccactgacaagaccagcagcatccagtcacgacccctgccctcaccccctaagttcacctcccaggactcgccagatgggcagtacgagaacagcgaggggggctggatggaggactatgactacgtccacctacaggggaaggaggagtttgagaagacccagaaggagctgctggaaaagggcagcatcacgcggcagggcaagagccagctggagttgcagcagctgaagcagtttgaacgactggaacaggaggtgtcacggcccatagaccacgacctggccaactggacgccagcccaacccctggccccggggcgaacaggcggcctggggccctcggaccggcagctgctgctcttctacctggagcagtgtgaggccaacctgaccacactgaccaacgccgtggacgccttctttaccgccgtggccaccaaccagccgcccaagatctttgtggcgcacagcaagttcgtcatcctcagcgcccacaagctggtgttcatcggggacacactgtcacggcaggccaaggctgctgacgtgcgcagccaggtgacccactacagcaacctgctgtgcgacctcctgcgcggcatcgtggccaccaccaaggccgctgccttgcagtacccatcgccttccgcggcccaggacatggtggagagggtcaaggagctgggccacagcacccagcagttccgccgcgtcctaggccagctggcagccgcctgagggtggtgaccccaggagggaggcaggggaggggtgcggcggtcccagctccctggctcccatgtcaagagtcgctgtgccacaggcttagggacaggaccccagctctgcgtcggtcctggtgccctggatgcccaggaatctgtatatatttatggccgggcagggtgtggggccatgcctcctcaggagccgaagcccaggggccggccagtggccttccccagcatgcaccacgggcccgggttgggtcaccagacggggctggagtgtgagggtcctgcagcctgcaggacctcgtgccaccccgagggctgagcctggtcccacgagggtgccgtgtcccctgacagggccagtgcagtttggtgtgtcctccgccttaccaggagaagaacctgaagaactatttttcgttattggttttccaatcatttgactaagagtctccatttaaataaagtttttaaaaggaagagca

SEQ ID NO: 598 - DNA, 3221 bp, Homo sapiens
ggccgaggcggcagctgcgcggcggcaccggggcggctgcggcgcgctcggagccccgagggcacgcggcccgggcagctcggtgtgcgcccccgcgagagccggggccccaggcccgccggacaccatgaaccacctgaacgtgctggccaaagcgctctatgacaatgtggccgagtccccggatgagctctccttccgcaagggtgacatcatgacggtgctggagcaggacacgcagggcctggacggctggtggctctgctcgctgcatgggcgccagggcatcgtgcctgggaaccgcctcaagatcttggtgggcatgtatgataagaagccagcagggcctggccccggccctcccgccaccccggcccagcctcagcctggcctccatgccccagcgcctccggcctcccagtacacgcccatgctccccaacacctaccagccccagccagacagcgtctacctggtgcccactcccagcaaggctcagcaaggcctctaccaagtcccgggtcccagccctcagttccagtctcccccagccaagcagacatccaccttctcgaagcagacaccccatcacccgtttcccagcccggccacagacctgtaccaggtgcccccagggcctggaggccctgcccaggatatttaccaggtgccaccttctgccgggatggggcatgacatctaccaggtccccccgtccatggacacacgcagctgggagggcacgaagcccccggcaaaggtggtggtgcccacccgcgtggggcagggctatgtatacgaggccgcccagccggagcaggacgagtacgacatcccgcgacacctgctggccccggggccacaggacatctatgatgtgcccccggttcgggggctgcttcccagccagtatggccaggaggtgtatgacacaccccccatggctgtcaagggtcccaatggccgagacccgttgctggaggtgtatgacgtgccccccagtgtggagaagggcctgccaccgtccaaccaccacgcagtctacgacgttcctccatcggtgagcaaggatgtgcccgatggcccactgctgcgtgaggagacctacgatgtgccccccgccttcgccaaggccaagccctttgacccggcccgcaccccactggtactggctgcgccccctccagactccccgccggccgaggacgtgtatgacgtgccgcccccggctcctgacctctacgacgtgccccctggcttgcggcggcctggcccgggcaccctgtacgatgtgccccgtgaacgggtgcttcctcctgaggtggctgatggtggcgtggtcgacagtggtgtgtatgcggtgcctcccccagctgaacgtgaagccccggcagagggcaagcgcctgtcggcctccagcaccggcagcacacgcagcagccagtctgcgtcctccttggaggtggcagggccgggccgggaacccctggagctggaagttgctgtggaggccctggcacggctgcagcagggtgtgagcgccaccgttgcccaccttctggacctggcaggcagcgccggtgcgactgggagctggcgtagcccctctgagccacaggagccgctggtgcaggacctgcaggctgctgtggccgctgtccagagtgccgtccacgagctgttggagtttgcccgcagcgcggtgggcaatgctgcccacacatctgaccgtgccctgcatgccaagcttagccggcagctgcagaagatggaggacgtgcaccagacgctggtggcacatggtcaggccctcgacgctggccggggaggctctggagccacccttgaggacctggaccggctggtggcctgctcgcgggctgtgcccgaggacgccaagcagctggcctccttcctgcacggcaatgcctcactgctcttcagacggaccaaggccactgccccggggcctgaggggggtggcaccctgcaccccaaccccactgacaagaccagcagcatccagtcacgacccctgccctcaccccctaagttcacctcccaggactcgccagatgggcagtacgagaacagcgaggggggctggatggaggactatgactacgtccacctacaggggaaggaggagtttgagaagacccagaaggagctgctggaaaagggcagcatcacgcggcagggcaagagccagctggagttgcagcagctgaagcagtttgaacgactggaacaggaggtgtcacggcccatagaccacgacctggccaactggacgccagcccaacccctggccccggggcgaacaggcggcctggggccctcggaccggcagctgctgctcttctacctggagcagtgtgaggccaacctgaccacactgaccaacgccgtggacgccttctttaccgccgtggccaccaaccagccgcccaagatctttgtggcgcacagcaagttcgtcatcctcagcgcccacaagctggtgttcatcggggacacactgtcacggcaggccaaggctgctgacgtgcgcagccaggtgacccactacagcaacctgctgtgcgacctcctgcgcggcatcgtggccaccaccaaggccgctgccttgcagtacccatcgccttccgcggcccaggacatggtggagagggtcaaggagctgggccacagcacccagcagttccgccgcgtcctaggccagctggcagccgcctgagggtggtgaccccaggagggaggcaggggaggggtgcggcggtcccagctccctggctcccatgtcaagagtcgctgtgccacaggcttagggacaggaccccagctctgcgtcggtcctggtgccctggatgcccaggaatctgtatatatttatggccgggcagggtgtggggccatgcctcctcaggagccgaagcccaggggccggccagtggccttccccagcatgcaccacgggcccgggttgggtcaccagacggggctggagtgtgagggtcctgcagcctgcaggacctcgtgccaccccgagggctgagcctggtcccacgagggtgccgtgtcccctgacagggccagtgcagtttggtgtgtcctccgccttaccaggagaagaacctgaagaactatttttcgttattggttttccaatcatttgactaagagtctccatttaaataaagtttttaaaaggaagagca

SEQ ID NO: 599 - DNA, 3293 bp, Homo sapiens
ggctggaccggctctgggtggccgaggcggcagctgcgcggcggcaccggggcggctgcggcgcgctcggagccccgagggcacgcggcccgggcagctcggtgtgcgcccccgcgagagccggggccccaggcccgccggacaccatgaaccacctgaacgtgctggccaaagcgctctatgacaatgtggccgagtccccggatgagctctccttccgcaagggtgacatcatgacggtgctggagcaggacacgcagggcctggacggctggtggctctgctcgctgcatgggcgccagggcatcgtgcctgggaaccgcctcaagatcttggtgggcatgtatgataagaagccagcagggcctggccccggccctcccgccaccccggcccagcctcagcctggcctccatgccccagcgcctccggcctcccagtacacgcccatgctccccaacacctaccagccccagccagacagcgtctacctggtgcccactcccagcaaggctcagcaaggcctctaccaagtcccgggtcccagccctcagttccagtctcccccagccaagcagacatccaccttctcgaagcagacaccccatcacccgtttcccagcccggccacagacctgtaccaggtgcccccagggcctggaggccctgcccaggatatttaccaggtgccaccttctgccgggatggggcatgacatctaccaggtccccccgtccatggacacacgcagctgggagggcacgaagcccccggcaaaggtggtggtgcccacccgcgtggggcagggctatgtatacgaggccgcccagccggagcaggacgagtacgacatcccgcgacacctgctggccccggggccacaggacatctatgatgtgcccccggttcgggggctgcttcccagccagtatggccaggaggtgtatgacacaccccccatggctgtcaagggtcccaatggccgagacccgttgctggaggtgtatgacgtgccccccagtgtggagaagggcctgccaccgtccaaccaccacgcagtgagcaaatgccagggcaatgccagggccaggctgaggctgtggggtgtctgggtctacgacgttcctccatcggtgagcaaggatgtgcccgatggcccactgctgcgtgaggagacctacgatgtgccccccgccttcgccaaggccaagccctttgacccggcccgcaccccactggtactggctgcgccccctccagactccccgccggccgaggacgtgtatgacgtgccgcccccggctcctgacctctacgacgtgccccctggcttgcggcggcctggcccgggcaccctgtacgatgtgccccgtgaacgggtgcttcctcctgaggtggctgatggtggcgtggtcgacagtggtgtgtatgcggtgcctcccccagctgaacgtgaagccccggcagagggcaagcgcctgtcggcctccagcaccggcagcacacgcagcagccagtctgcgtcctccttggaggtggcagggccgggccgggaacccctggagctggaagttgctgtggaggccctggcacggctgcagcagggtgtgagcgccaccgttgcccaccttctggacctggcaggcagcgccggtgcgactgggagctggcgtagcccctctgagccacaggagccgctggtgcaggacctgcaggctgctgtggccgctgtccagagtgccgtccacgagctgttggagtttgcccgcagcgcggtgggcaatgctgcccacacatctgaccgtgccctgcatgccaagcttagccggcagctgcagaagatggaggacgtgcaccagacgctggtggcacatggtcaggccctcgacgctggccggggaggctctggagccacccttgaggacctggaccggctggtggcctgctcgcgggctgtgcccgaggacgccaagcagctggcctccttcctgcacggcaatgcctcactgctcttcagacggaccaaggccactgccccggggcctgaggggggtggcaccctgcaccccaaccccactgacaagaccagcagcatccagtcacgacccctgccctcaccccctaagttcacctcccaggactcgccagatgggcagtacgagaacagcgaggggggctggatggaggactatgactacgtccacctacaggggaaggaggagtttgagaagacccagaaggagctgctggaaaagggcagcatcacgcggcagggcaagagccagctggagttgcagcagctgaagcagtttgaacgactggaacaggaggtgtcacggcccatagaccacgacctggccaactggacgccagcccaacccctggccccggggcgaacaggcggcctggggccctcggaccggcagctgctgctcttctacctggagcagtgtgaggccaacctgaccacactgaccaacgccgtggacgccttctttaccgccgtggccaccaaccagccgcccaagatctttgtggcgcacagcaagttcgtcatcctcagcgcccacaagctggtgttcatcggggacacactgtcacggcaggccaaggctgctgacgtgcgcagccaggtgacccactacagcaacctgctgtgcgacctcctgcgcggcatcgtggccaccaccaaggccgctgccttgcagtacccatcgccttccgcggcccaggacatggtggagagggtcaaggagctgggccacagcacccagcagttccgccgcgtcctaggccagctggcagccgcctgagggtggtgaccccaggagggaggcaggggaggggtgcggcggtcccagctccctggctcccatgtcaagagtcgctgtgccacaggcttagggacaggaccccagctctgcgtcggtcctggtgccctggatgcccaggaatctgtatatatttatggccgggcagggtgtggggccatgcctcctcaggagccgaagcccaggggccggccagtggccttccccagcatgcaccacgggcccgggttgggtcaccagacggggctggagtgtgagggtcctgcagcctgcaggacctcgtgccaccccgagggctgagcctggtcccacgagggtgccgtgtcccctgacagggccagtgcagtttggtgtgtcctccgccttaccaggagaagaacctgaagaactatttttcgttattggttttccaatcatttgactaagagtctccatttaaataaagtttttaaaaggaagagc

SEQ ID NO: 600 - DNA, 3515 bp, Homo sapiens
atgcgcggcgcggctggagcggccggacagtccggcgtccgggaacgctcaggagccggaggagccggaaagcgccgggacccctcgcggggcctctgagcggcgcgggcggacccgagcccccagcccgctggcgccgctgcccgccaggccccgggggcggcggccaagatgtccgtgcctatgaaaaaatgagggcttccagactgtgctgatgtgagccccgccatccgttctggttcagagcataatcgtctcgtcttcagaaagaaggaagacagaacatgcctgccaagcccttcctctcttctgttctgctctcctggaaagttctggacttctctggcccagggcctcaggggactggccagccctgctcctgtgggcactgggcagagggacaaggcggaccacctgagcctgctggagggccgaacgtgctggccaaagcgctctatgacaatgtggccgagtccccggatgagctctccttccgcaagggtgacatcatgacggtgctggagcaggacacgcagggcctggacggctggtggctctgctcgctgcatgggcgccagggcatcgtgcctgggaaccgcctcaagatcttggtgggcatgtatgataagaagccagcagggcctggccccggccctcccgccaccccggcccagcctcagcctggcctccatgccccagcgcctccggcctcccagtacacgcccatgctccccaacacctaccagccccagccagacagcgtctacctggtgcccactcccagcaaggctcagcaaggcctctaccaagtcccgggtcccagccctcagttccagtctcccccagccaagcagacatccaccttctcgaagcagacaccccatcacccgtttcccagcccggccacagacctgtaccaggtgcccccagggcctggaggccctgcccaggatatttaccaggtgccaccttctgccgggatggggcatgacatctaccaggtccccccgtccatggacacacgcagctgggagggcacgaagcccccggcaaaggtggtggtgcccacccgcgtggggcagggctatgtatacgaggccgcccagccggagcaggacgagtacgacatcccgcgacacctgctggccccggggccacaggacatctatgatgtgcccccggttcgggggctgcttcccagccagtatggccaggaggtgtatgacacaccccccatggctgtcaagggtcccaatggccgagacccgttgctggaggtgtatgacgtgccccccagtgtggagaagggcctgccaccgtccaaccaccacgcagtctacgacgttcctccatcggtgagcaaggatgtgcccgatggcccactgctgcgtgaggagacctacgatgtgccccccgccttcgccaaggccaagccctttgacccggcccgcaccccactggtactggctgcgccccctccagactccccgccggccgaggacgtgtatgacgtgccgcccccggctcctgacctctacgacgtgccccctggcttgcggcggcctggcccgggcaccctgtacgatgtgccccgtgaacgggtgcttcctcctgaggtggctgatggtggcgtggtcgacagtggtgtgtatgcggtgcctcccccagctgaacgtgaagccccggcagagggcaagcgcctgtcggcctccagcaccggcagcacacgcagcagccagtctgcgtcctccttggaggtggcagggccgggccgggaacccctggagctggaagttgctgtggaggccctggcacggctgcagcagggtgtgagcgccaccgttgcccaccttctggacctggcaggcagcgccggtgcgactgggagctggcgtagcccctctgagccacaggagccgctggtgcaggacctgcaggctgctgtggccgctgtccagagtgccgtccacgagctgttggagtttgcccgcagcgcggtgggcaatgctgcccacacatctgaccgtgccctgcatgccaagcttagccggcagctgcagaagatggaggacgtgcaccagacgctggtggcacatggtcaggccctcgacgctggccggggaggctctggagccacccttgaggacctggaccggctggtggcctgctcgcgggctgtgcccgaggacgccaagcagctggcctccttcctgcacggcaatgcctcactgctcttcagacggaccaaggccactgccccggggcctgaggggggtggcaccctgcaccccaaccccactgacaagaccagcagcatccagtcacgacccctgccctcaccccctaagttcacctcccaggactcgccagatgggcagtacgagaacagcgaggggggctggatggaggactatgactacgtccacctacaggggaaggaggagtttgagaagacccagaaggagctgctggaaaagggcagcatcacgcggcagggcaagagccagctggagttgcagcagctgaagcagtttgaacgactggaacaggaggtgtcacggcccatagaccacgacctggccaactggacgccagcccaacccctggccccggggcgaacaggcggcctggggccctcggaccggcagctgctgctcttctacctggagcagtgtgaggccaacctgaccacactgaccaacgccgtggacgccttctttaccgccgtggccaccaaccagccgcccaagatctttgtggcgcacagcaagttcgtcatcctcagcgcccacaagctggtgttcatcggggacacactgtcacggcaggccaaggctgctgacgtgcgcagccaggtgacccactacagcaacctgctgtgcgacctcctgcgcggcatcgtggccaccaccaaggccgctgccttgcagtacccatcgccttccgcggcccaggacatggtggagagggtcaaggagctgggccacagcacccagcagttccgccgcgtcctaggccagctggcagccgcctgagggtggtgaccccaggagggaggcaggggaggggtgcggcggtcccagctccctggctcccatgtcaagagtcgctgtgccacaggcttagggacaggaccccagctctgcgtcggtcctggtgccctggatgcccaggaatctgtatatatttatggccgggcagggtgtggggccatgcctcctcaggagccgaagcccaggggccggccagtggccttccccagcatgcaccacgggcccgggttgggtcaccagacggggctggagtgtgagggtcctgcagcctgcaggacctcgtgccaccccgagggctgagcctggtcccacgagggtgccgtgtcccctgacagggccagtgcagtttggtgtgtcctccgccttaccaggagaagaacctgaagaactatttttcgttattggttttccaatcatttgactaagagtctccatttaaataaagtttttaaaaggaagagc

SEQ ID NO: 601 - DNA, 3177 bp, Homo sapiens
tgctctggaccccagccccacttgctctagatgctcacccaccgtccccaggaagcagaacagaggggtcggacccctggtccttcctttgagtggaacgtgctggccaaagcgctctatgacaatgtggccgagtccccggatgagctctccttccgcaagggtgacatcatgacggtgctggagcaggacacgcagggcctggacggctggtggctctgctcgctgcatgggcgccagggcatcgtgcctgggaaccgcctcaagatcttggtgggcatgtatgataagaagccagcagggcctggccccggccctcccgccaccccggcccagcctcagcctggcctccatgccccagcgcctccggcctcccagtacacgcccatgctccccaacacctaccagccccagccagacagcgtctacctggtgcccactcccagcaaggctcagcaaggcctctaccaagtcccgggtcccagccctcagttccagtctcccccagccaagcagacatccaccttctcgaagcagacaccccatcacccgtttcccagcccggccacagacctgtaccaggtgcccccagggcctggaggccctgcccaggatatttaccaggtgccaccttctgccgggatggggcatgacatctaccaggtccccccgtccatggacacacgcagctgggagggcacgaagcccccggcaaaggtggtggtgcccacccgcgtggggcagggctatgtatacgaggccgcccagccggagcaggacgagtacgacatcccgcgacacctgctggccccggggccacaggacatctatgatgtgcccccggttcgggggctgcttcccagccagtatggccaggaggtgtatgacacaccccccatggctgtcaagggtcccaatggccgagacccgttgctggaggtgtatgacgtgccccccagtgtggagaagggcctgccaccgtccaaccaccacgcagtctacgacgttcctccatcggtgagcaaggatgtgcccgatggcccactgctgcgtgaggagacctacgatgtgccccccgccttcgccaaggccaagccctttgacccggcccgcaccccactggtactggctgcgccccctccagactccccgccggccgaggacgtgtatgacgtgccgcccccggctcctgacctctacgacgtgccccctggcttgcggcggcctggcccgggcaccctgtacgatgtgccccgtgaacgggtgcttcctcctgaggtggctgatggtggcgtggtcgacagtggtgtgtatgcggtgcctcccccagctgaacgtgaagccccggcagagggcaagcgcctgtcggcctccagcaccggcagcacacgcagcagccagtctgcgtcctccttggaggtggcagggccgggccgggaacccctggagctggaagttgctgtggaggccctggcacggctgcagcagggtgtgagcgccaccgttgcccaccttctggacctggcaggcagcgccggtgcgactgggagctggcgtagcccctctgagccacaggagccgctggtgcaggacctgcaggctgctgtggccgctgtccagagtgccgtccacgagctgttggagtttgcccgcagcgcggtgggcaatgctgcccacacatctgaccgtgccctgcatgccaagcttagccggcagctgcagaagatggaggacgtgcaccagacgctggtggcacatggtcaggccctcgacgctggccggggaggctctggagccacccttgaggacctggaccggctggtggcctgctcgcgggctgtgcccgaggacgccaagcagctggcctccttcctgcacggcaatgcctcactgctcttcagacggaccaaggccactgccccggggcctgaggggggtggcaccctgcaccccaaccccactgacaagaccagcagcatccagtcacgacccctgccctcaccccctaagttcacctcccaggactcgccagatgggcagtacgagaacagcgaggggggctggatggaggactatgactacgtccacctacaggggaaggaggagtttgagaagacccagaaggagctgctggaaaagggcagcatcacgcggcagggcaagagccagctggagttgcagcagctgaagcagtttgaacgactggaacaggaggtgtcacggcccatagaccacgacctggccaactggacgccagcccaacccctggccccggggcgaacaggcggcctggggccctcggaccggcagctgctgctcttctacctggagcagtgtgaggccaacctgaccacactgaccaacgccgtggacgccttctttaccgccgtggccaccaaccagccgcccaagatctttgtggcgcacagcaagttcgtcatcctcagcgcccacaagctggtgttcatcggggacacactgtcacggcaggccaaggctgctgacgtgcgcagccaggtgacccactacagcaacctgctgtgcgacctcctgcgcggcatcgtggccaccaccaaggccgctgccttgcagtacccatcgccttccgcggcccaggacatggtggagagggtcaaggagctgggccacagcacccagcagttccgccgcgtcctaggccagctggcagccgcctgagggtggtgaccccaggagggaggcaggggaggggtgcggcggtcccagctccctggctcccatgtcaagagtcgctgtgccacaggcttagggacaggaccccagctctgcgtcggtcctggtgccctggatgcccaggaatctgtatatatttatggccgggcagggtgtggggccatgcctcctcaggagccgaagcccaggggccggccagtggccttccccagcatgcaccacgggcccgggttgggtcaccagacggggctggagtgtgagggtcctgcagcctgcaggacctcgtgccaccccgagggctgagcctggtcccacgagggtgccgtgtcccctgacagggccagtgcagtttggtgtgtcctccgccttaccaggagaagaacctgaagaactatttttcgttattggttttccaatcatttgactaagagtctccatttaaataaagtttttaaaaggaagagc

SEQ ID NO: 602 - DNA, 2925 bp, Homo sapiens
aggagccggaaagcgccgggacccctcgcggggcctctgagcggcgcgggcggacccgagcccccagcccgctggcgccgctgcccgccaggccccgggggcggcggccaagatgtccgtgccttgccgctctcctaccccatgtcgctgaagcagatgagttggagcaggactcaggagggtactaggcccaggttttaggctgaacctaggaatgagtaatgagaggaggcagatcagctggaggaccagcccgagtccccagatgtcggcacaatgcaggggaagaacgtgctggccaaagcgctctatgacaatgtggccgagtccccggatgagctctccttccgcaagggtgacatcatgacggtgctggagcaggacacgcagggcctggacggctggtggctctgctcgctgcatgggcgccagggcatcgtgcctgggaaccgcctcaagatcttggtggtggtgcccacccgcgtggggcagggctatgtatacgaggccgcccagccggagcaggacgagtacgacatcccgcgacacctgctggccccggggccacaggacatctatgatgtgcccccggttcgggggctgcttcccagccagtatggccaggaggtgtatgacacaccccccatggctgtcaagggtcccaatggccgagacccgttgctggaggtgtatgacgtgccccccagtgtggagaagggcctgccaccgtccaaccaccacgcagtctacgacgttcctccatcggtgagcaaggatgtgcccgatggcccactgctgcgtgaggagacctacgatgtgccccccgccttcgccaaggccaagccctttgacccggcccgcaccccactggtactggctgcgccccctccagactccccgccggccgaggacgtgtatgacgtgccgcccccggctcctgacctctacgacgtgccccctggcttgcggcggcctggcccgggcaccctgtacgatgtgccccgtgaacgggtgcttcctcctgaggtggctgatggtggcgtggtcgacagtggtgtgtatgcggtgcctcccccagctgaacgtgaagccccggcagagggcaagcgcctgtcggcctccagcaccggcagcacacgcagcagccagtctgcgtcctccttggaggtggcagggccgggccgggaacccctggagctggaagttgctgtggaggccctggcacggctgcagcagggtgtgagcgccaccgttgcccaccttctggacctggcaggcagcgccggtgcgactgggagctggcgtagcccctctgagccacaggagccgctggtgcaggacctgcaggctgctgtggccgctgtccagagtgccgtccacgagctgttggagtttgcccgcagcgcggtgggcaatgctgcccacacatctgaccgtgccctgcatgccaagcttagccggcagctgcagaagatggaggacgtgcaccagacgctggtggcacatggtcaggccctcgacgctggccggggaggctctggagccacccttgaggacctggaccggctggtggcctgctcgcgggctgtgcccgaggacgccaagcagctggcctccttcctgcacggcaatgcctcactgctcttcagacggaccaaggccactgccccggggcctgaggggggtggcaccctgcaccccaaccccactgacaagaccagcagcatccagtcacgacccctgccctcaccccctaagttcacctcccaggactcgccagatgggcagtacgagaacagcgaggggggctggatggaggactatgactacgtccacctacaggggaaggaggagtttgagaagacccagaaggagctgctggaaaagggcagcatcacgcggcagggcaagagccagctggagttgcagcagctgaagcagtttgaacgactggaacaggaggtgtcacggcccatagaccacgacctggccaactggacgccagcccaacccctggccccggggcgaacaggcggcctggggccctcggaccggcagctgctgctcttctacctggagcagtgtgaggccaacctgaccacactgaccaacgccgtggacgccttctttaccgccgtggccaccaaccagccgcccaagatctttgtggcgcacagcaagttcgtcatcctcagcgcccacaagctggtgttcatcggggacacactgtcacggcaggccaaggctgctgacgtgcgcagccaggtgacccactacagcaacctgctgtgcgacctcctgcgcggcatcgtggccaccaccaaggccgctgccttgcagtacccatcgccttccgcggcccaggacatggtggagagggtcaaggagctgggccacagcacccagcagttccgccgcgtcctaggccagctggcagccgcctgagggtggtgaccccaggagggaggcaggggaggggtgcggcggtcccagctccctggctcccatgtcaagagtcgctgtgccacaggcttagggacaggaccccagctctgcgtcggtcctggtgccctggatgcccaggaatctgtatatatttatggccgggcagggtgtggggccatgcctcctcaggagccgaagcccaggggccggccagtggccttccccagcatgcaccacgggcccgggttgggtcaccagacggggctggagtgtgagggtcctgcagcctgcaggacctcgtgccaccccgagggctgagcctggtcccacgagggtgccgtgtcccctgacagggccagtgcagtttggtgtgtcctccgccttaccaggagaagaacctgaagaactatttttcgttattggttttccaatcatttgactaagagtctccatttaaataaagtttttaaaaggaagagc

SEQ ID NO: 603 - DNA, 3264 bp, Homo sapiens
atgcgcggcgcggctggagcggccggacagtccggcgtccgggaacgctcaggagccggaggagccggaaagcgccgggacccctcgcggggcctctgagcggcgcgggcggacccgagcccccagcccgctggcgccgctgcccgccaggccccgggggcggcggccaagatgtccgtgcctaacgtgctggccaaagcgctctatgacaatgtggccgagtccccggatgagctctccttccgcaagggtgacatcatgacggtgctggagcaggacacgcagggcctggacggctggtggctctgctcgctgcatgggcgccagggcatcgtgcctgggaaccgcctcaagatcttggtgggcatgtatgataagaagccagcagggcctggccccggccctcccgccaccccggcccagcctcagcctggcctccatgccccagcgcctccggcctcccagtacacgcccatgctccccaacacctaccagccccagccagacagcgtctacctggtgcccactcccagcaaggctcagcaaggcctctaccaagtcccgggtcccagccctcagttccagtctcccccagccaagcagacatccaccttctcgaagcagacaccccatcacccgtttcccagcccggccacagacctgtaccaggtgcccccagggcctggaggccctgcccaggatatttaccaggtgccaccttctgccgggatggggcatgacatctaccaggtccccccgtccatggacacacgcagctgggagggcacgaagcccccggcaaaggtggtggtgcccacccgcgtggggcagggctatgtatacgaggccgcccagccggagcaggacgagtacgacatcccgcgacacctgctggccccggggccacaggacatctatgatgtgcccccggttcgggggctgcttcccagccagtatggccaggaggtgtatgacacaccccccatggctgtcaagggtcccaatggccgagacccgttgctggaggtgtatgacgtgccccccagtgtggagaagggcctgccaccgtccaaccaccacgcagtctacgacgttcctccatcggtgagcaaggatgtgcccgatggcccactgctgcgtgaggagacctacgatgtgccccccgccttcgccaaggccaagccctttgacccggcccgcaccccactggtactggctgcgccccctccagactccccgccggccgaggacgtgtatgacgtgccgcccccggctcctgacctctacgacgtgccccctggcttgcggcggcctggcccgggcaccctgtacgatgtgccccgtgaacgggtgcttcctcctgaggtggctgatggtggcgtggtcgacagtggtgtgtatgcggtgcctcccccagctgaacgtgaagccccggcagagggcaagcgcctgtcggcctccagcaccggcagcacacgcagcagccagtctgcgtcctccttggaggtggcagggccgggccgggaacccctggagctggaagttgctgtggaggccctggcacggctgcagcagggtgtgagcgccaccgttgcccaccttctggacctggcaggcagcgccggtgcgactgggagctggcgtagcccctctgagccacaggagccgctggtgcaggacctgcaggctgctgtggccgctgtccagagtgccgtccacgagctgttggagtttgcccgcagcgcggtgggcaatgctgcccacacatctgaccgtgccctgcatgccaagcttagccggcagctgcagaagatggaggacgtgcaccagacgctggtggcacatggtcaggccctcgacgctggccggggaggctctggagccacccttgaggacctggaccggctggtggcctgctcgcgggctgtgcccgaggacgccaagcagctggcctccttcctgcacggcaatgcctcactgctcttcagacggaccaaggccactgccccggggcctgaggggggtggcaccctgcaccccaaccccactgacaagaccagcagcatccagtcacgacccctgccctcaccccctaagttcacctcccaggactcgccagatgggcagtacgagaacagcgaggggggctggatggaggactatgactacgtccacctacaggggaaggaggagtttgagaagacccagaaggagctgctggaaaagggcagcatcacgcggcagggcaagagccagctggagttgcagcagctgaagcagtttgaacgactggaacaggaggtgtcacggcccatagaccacgacctggccaactggacgccagcccaacccctggccccggggcgaacaggcggcctggggccctcggaccggcagctgctgctcttctacctggagcagtgtgaggccaacctgaccacactgaccaacgccgtggacgccttctttaccgccgtggccaccaaccagccgcccaagatctttgtggcgcacagcaagttcgtcatcctcagcgcccacaagctggtgttcatcggggacacactgtcacggcaggccaaggctgctgacgtgcgcagccaggtgacccactacagcaacctgctgtgcgacctcctgcgcggcatcgtggccaccaccaaggccgctgccttgcagtacccatcgccttccgcggcccaggacatggtggagagggtcaaggagctgggccacagcacccagcagttccgccgcgtcctaggccagctggcagccgcctgagggtggtgaccccaggagggaggcaggggaggggtgcggcggtcccagctccctggctcccatgtcaagagtcgctgtgccacaggcttagggacaggaccccagctctgcgtcggtcctggtgccctggatgcccaggaatctgtatatatttatggccgggcagggtgtggggccatgcctcctcaggagccgaagcccaggggccggccagtggccttccccagcatgcaccacgggcccgggttgggtcaccagacggggctggagtgtgagggtcctgcagcctgcaggacctcgtgccaccccgagggctgagcctggtcccacgagggtgccgtgtcccctgacagggccagtgcagtttggtgtgtcctccgccttaccaggagaagaacctgaagaactatttttcgttattggttttccaatcatttgactaagagtctccatttaaataaagtttttaaaaggaagagc

SEQ ID NO: 604 - DNA, 3354 bp, Homo sapiens
agtgtttcccaagtgcctgctatgtgcgaggctctgtgctggggcgggtgcatgtgtgcgttgggggcgtggacaggaggggtgggaaaggcctgtgacatttcctctggtggtttccacgaacccaggcgtcacccctcggtggagataaagtggagccacccagctccaccgtgtctcagcctggggtcggcctctgctgcttctggactcagtgaccctgggctgtcagggagcttctgagccttggttttcctgtctagtaagatggagaacgtgctggccaaagcgctctatgacaatgtggccgagtccccggatgagctctccttccgcaagggtgacatcatgacggtgctggagcaggacacgcagggcctggacggctggtggctctgctcgctgcatgggcgccagggcatcgtgcctgggaaccgcctcaagatcttggtgggcatgtatgataagaagccagcagggcctggccccggccctcccgccaccccggcccagcctcagcctggcctccatgccccagcgcctccggcctcccagtacacgcccatgctccccaacacctaccagccccagccagacagcgtctacctggtgcccactcccagcaaggctcagcaaggcctctaccaagtcccgggtcccagccctcagttccagtctcccccagccaagcagacatccaccttctcgaagcagacaccccatcacccgtttcccagcccggccacagacctgtaccaggtgcccccagggcctggaggccctgcccaggatatttaccaggtgccaccttctgccgggatggggcatgacatctaccaggtccccccgtccatggacacacgcagctgggagggcacgaagcccccggcaaaggtggtggtgcccacccgcgtggggcagggctatgtatacgaggccgcccagccggagcaggacgagtacgacatcccgcgacacctgctggccccggggccacaggacatctatgatgtgcccccggttcgggggctgcttcccagccagtatggccaggaggtgtatgacacaccccccatggctgtcaagggtcccaatggccgagacccgttgctggaggtgtatgacgtgccccccagtgtggagaagggcctgccaccgtccaaccaccacgcagtctacgacgttcctccatcggtgagcaaggatgtgcccgatggcccactgctgcgtgaggagacctacgatgtgccccccgccttcgccaaggccaagccctttgacccggcccgcaccccactggtactggctgcgccccctccagactccccgccggccgaggacgtgtatgacgtgccgcccccggctcctgacctctacgacgtgccccctggcttgcggcggcctggcccgggcaccctgtacgatgtgccccgtgaacgggtgcttcctcctgaggtggctgatggtggcgtggtcgacagtggtgtgtatgcggtgcctcccccagctgaacgtgaagccccggcagagggcaagcgcctgtcggcctccagcaccggcagcacacgcagcagccagtctgcgtcctccttggaggtggcagggccgggccgggaacccctggagctggaagttgctgtggaggccctggcacggctgcagcagggtgtgagcgccaccgttgcccaccttctggacctggcaggcagcgccggtgcgactgggagctggcgtagcccctctgagccacaggagccgctggtgcaggacctgcaggctgctgtggccgctgtccagagtgccgtccacgagctgttggagtttgcccgcagcgcggtgggcaatgctgcccacacatctgaccgtgccctgcatgccaagcttagccggcagctgcagaagatggaggacgtgcaccagacgctggtggcacatggtcaggccctcgacgctggccggggaggctctggagccacccttgaggacctggaccggctggtggcctgctcgcgggctgtgcccgaggacgccaagcagctggcctccttcctgcacggcaatgcctcactgctcttcagacggaccaaggccactgccccggggcctgaggggggtggcaccctgcaccccaaccccactgacaagaccagcagcatccagtcacgacccctgccctcaccccctaagttcacctcccaggactcgccagatgggcagtacgagaacagcgaggggggctggatggaggactatgactacgtccacctacaggggaaggaggagtttgagaagacccagaaggagctgctggaaaagggcagcatcacgcggcagggcaagagccagctggagttgcagcagctgaagcagtttgaacgactggaacaggaggtgtcacggcccatagaccacgacctggccaactggacgccagcccaacccctggccccggggcgaacaggcggcctggggccctcggaccggcagctgctgctcttctacctggagcagtgtgaggccaacctgaccacactgaccaacgccgtggacgccttctttaccgccgtggccaccaaccagccgcccaagatctttgtggcgcacagcaagttcgtcatcctcagcgcccacaagctggtgttcatcggggacacactgtcacggcaggccaaggctgctgacgtgcgcagccaggtgacccactacagcaacctgctgtgcgacctcctgcgcggcatcgtggccaccaccaaggccgctgccttgcagtacccatcgccttccgcggcccaggacatggtggagagggtcaaggagctgggccacagcacccagcagttccgccgcgtcctaggccagctggcagccgcctgagggtggtgaccccaggagggaggcaggggaggggtgcggcggtcccagctccctggctcccatgtcaagagtcgctgtgccacaggcttagggacaggaccccagctctgcgtcggtcctggtgccctggatgcccaggaatctgtatatatttatggccgggcagggtgtggggccatgcctcctcaggagccgaagcccaggggccggccagtggccttccccagcatgcaccacgggcccgggttgggtcaccagacggggctggagtgtgagggtcctgcagcctgcaggacctcgtgccaccccgagggctgagcctggtcccacgagggtgccgtgtcccctgacagggccagtgcagtttggtgtgtcctccgccttaccaggagaagaacctgaagaactatttttcgttattggttttccaatcatttgactaagagtctccatttaaataaagtttttaaaaggaagagc

SEQ ID NO: 605 - DNA, 4659 bp, Homo sapiens
actttcctgggaagttttcctctcgctgcggaacccccggggccctgactggccgcttcctccccgctggccgtagggagttttctgtccgacaccccctcttcctggccgggcagcctggcttcggcagacccccgggccatgtttccacacttgggcactggcatctctgagcatctcagtctcacctcctgagaacagcaagtgatcctggctaccccgggtaaccaggcctcaggtgcaggccccacatgacagatggacagactgaagtgggaggtgggaggcggacaccccggcgtcctgccaggaagggacaccatctgcacctggcgagctgtggcctccagccatcgtttccctgcctagttaggggcttttccctccagagccctgtccactctggccttgtttctggaactgctcctcacccggaggaccccatcctttccgtgaagcaggcagtgggggctttctggcaagtggcctcttcattaactatcccagagtgagtgcagatgaccagagggaagctggccaagtgcaaagcattgttattgtggaattaaagagcccgctcctgctcgcctccagaagtggtaatgtatttacagatgaaaaaatgagggcttccagactgtgctgatgtgagccccgccatccgttctggttcagagcataatcgtctcgtcttcagaaagaaggaagacagaacatgcctgccaagcccttcctctcttctgttctgctctcctggaaagttctggacttctctggcccagggcctcaggggactggccagccctgctcctgtgggcactgggcagagggacaaggcggaccacctgagcctgctggagggccggtatcccagggcagtagtgattagggaatgtcactctggccacatcccagcctgggcgggcctctatggggaggtccccgtttgatttggtttggttgtccacagtcagagccaagctctgggcatggagtctgggatggcaccctgaccccttgccttacaggactttgggcagccttctttggcactgtgcctcatctgtaacaagagaggaacagcgggctgggtaggacttggacagataggcactgtcgtggggacctgcagcctggccacaccatcacgggctctgagtcatctcctaccctctcccttgtagtcacagcccaggagaattctgctgggggtgggcagaggtctttgccatctgccccctacgtggctggctggcagatcaccgtggctctctctcctgggaccttgggcagtgtgtgaggtggtggggccaagaggagaattcatttttggaacagtcttgaagtgttcggaaaattgctttcatgtgctgaggaggccctgcggaggcttccagactgagctgcctgctcaagccctgcccttggaacccagagtggcgactgctcagggacacgtctgggttttaagcacacccatccatttgggcagtcttttcctagatgggctgacgcagcaggcactttggcccacagaaattataagatgcttcagaaggggatgggaggggaagcaggaacgtgctggccaaagcgctctatgacaatgtggccgagtccccggatgagctctccttccgcaagggtgacatcatgacggtgctggagcaggacacgcagggcctggacggctggtggctctgctcgctgcatgggcgccagggcatcgtgcctgggaaccgcctcaagatcttggtgggcatgtatgataagaagccagcagggcctggccccggccctcccgccaccccggcccagcctcagcctggcctccatgccccagcgcctccggcctcccagtacacgcccatgctccccaacacctaccagccccagccagacagcgtctacctggtgcccactcccagcaaggctcagcaaggcctctaccaagtcccgggtcccagccctcagttccagtctcccccagccaagcagacatccaccttctcgaagcagacaccccatcacccgtttcccagcccggccacagacctgtaccaggtgcccccagggcctggaggccctgcccaggatatttaccaggtgccaccttctgccgggatggggcatgacatctaccaggtccccccgtccatggacacacgcagctgggagggcacgaagcccccggcaaaggtggtggtgcccacccgcgtggggcagggctatgtatacgaggccgcccagccggagcaggacgagtacgacatcccgcgacacctgctggccccggggccacaggacatctatgatgtgcccccggttcgggggctgcttcccagccagtatggccaggaggtgtatgacacaccccccatggctgtcaagggtcccaatggccgagacccgttgctggaggtgtatgacgtgccccccagtgtggagaagggcctgccaccgtccaaccaccacgcagtctacgacgttcctccatcggtgagcaaggatgtgcccgatggcccactgctgcgtgaggagacctacgatgtgccccccgccttcgccaaggccaagccctttgacccggcccgcaccccactggtactggctgcgccccctccagactccccgccggccgaggacgtgtatgacgtgccgcccccggctcctgacctctacgacgtgccccctggcttgcggcggcctggcccgggcaccctgtacgatgtgccccgtgaacgggtgcttcctcctgaggtggctgatggtggcgtggtcgacagtggtgtgtatgcggtgcctcccccagctgaacgtgaagccccggcagagggcaagcgcctgtcggcctccagcaccggcagcacacgcagcagccagtctgcgtcctccttggaggtggcagggccgggccgggaacccctggagctggaagttgctgtggaggccctggcacggctgcagcagggtgtgagcgccaccgttgcccaccttctggacctggcaggcagcgccggtgcgactgggagctggcgtagcccctctgagccacaggagccgctggtgcaggacctgcaggctgctgtggccgctgtccagagtgccgtccacgagctgttggagtttgcccgcagcgcggtgggcaatgctgcccacacatctgaccgtgccctgcatgccaagcttagccggcagctgcagaagatggaggacgtgcaccagacgctggtggcacatggtcaggccctcgacgctggccggggaggctctggagccacccttgaggacctggaccggctggtggcctgctcgcgggctgtgcccgaggacgccaagcagctggcctccttcctgcacggcaatgcctcactgctcttcagacggaccaaggccactgccccggggcctgaggggggtggcaccctgcaccccaaccccactgacaagaccagcagcatccagtcacgacccctgccctcaccccctaagttcacctcccaggactcgccagatgggcagtacgagaacagcgaggggggctggatggaggactatgactacgtccacctacaggggaaggaggagtttgagaagacccagaaggagctgctggaaaagggcagcatcacgcggcagggcaagagccagctggagttgcagcagctgaagcagtttgaacgactggaacaggaggtgtcacggcccatagaccacgacctggccaactggacgccagcccaacccctggccccggggcgaacaggcggcctggggccctcggaccggcagctgctgctcttctacctggagcagtgtgaggccaacctgaccacactgaccaacgccgtggacgccttctttaccgccgtggccaccaaccagccgcccaagatctttgtggcgcacagcaagttcgtcatcctcagcgcccacaagctggtgttcatcggggacacactgtcacggcaggccaaggctgctgacgtgcgcagccaggtgacccactacagcaacctgctgtgcgacctcctgcgcggcatcgtggccaccaccaaggccgctgccttgcagtacccatcgccttccgcggcccaggacatggtggagagggtcaaggagctgggccacagcacccagcagttccgccgcgtcctaggccagctggcagccgcctgagggtggtgaccccaggagggaggcaggggaggggtgcggcggtcccagctccctggctcccatgtcaagagtcgctgtgccacaggcttagggacaggaccccagctctgcgtcggtcctggtgccctggatgcccaggaatctgtatatatttatggccgggcagggtgtggggccatgcctcctcaggagccgaagcccaggggccggccagtggccttccccagcatgcaccacgggcccgggttgggtcaccagacggggctggagtgtgagggtcctgcagcctgcaggacctcgtgccaccccgagggctgagcctggtcccacgagggtgccgtgtcccctgacagggccagtgcagtttggtgtgtcctccgccttaccaggagaagaacctgaagaactatttttcgttattggttttccaatcatttgactaagagtctccatttaaataaagtttttaaaaggaagagc

SEQ ID NO: 606 - DNA, 1445 bp, Homo sapiens
gatgacgcacacggaagcaccgataggctctgcctcccgaagaaaagggagccgcgcagcgcctacgggagtccggcggcagcagccggtaccggcaaccacgggcagctctcagggaatctccgtcgtgaggccagaggctccagtccccgcgagtccagatgcctgtccagcctccaagcaaagacacagaagagatggaagcagagggtgattctgctgctgagatgaatggggaggaggaagagagtgaggaggagcggagcggcagccagacagagtcagaagaggagagctccgagatggatgatgaggactatgagcgacgccgcagcgagtgtgtcagtgagatgctggacctagagaagcagttctcggagctaaaggagaagttgttcagggaacgactgagtcagctgcggttgcggctggaggaagtgggggctgagagagcccctgaatacacggagccccttggggggctgcagcggagcctcaagattcgcattcaggtggcagggatctacaagggcttctgtctggatgtgatcaggaataagtacgaatgtgagctgcagggagccaaacagcacctggagagtgagaagctgctgctctatgacacgctgcagggggagctgcaggagcggatccagaggctggaggaggaccgccagagcctggacctcagctctgaatggtgggatgacaaactgcacgccagaggcagctccaggtcttgggactccctgccgcccagcaagaggaagaaggcacctctggtttctggcccatacatcgtgtacatgcttcaagagatcgacatcctggaggactggacagccatcaaaaaggctagggcagctgtgtcccctcagaagagaaaatcggatggaccttgaccctgctgttcacagccagggggaccctcagagcagctggcactgcacccaggattctcgtcttcctcctgcagacaggcggacccacaggcccctcagggtctgcccagccaggctcctgtggtgctgctgggccctcccactccatctggcactggcctggactcctcctctgccctcctcgaggcctgcacagctgtggccgtggagctgacctgaccaggcaaggctgctgtctccatccctgagccgcctgccacctcccactcctgaagatccatctcttggggctcccctgacagagaagacagccgaagtcaaagccacatcctcttgctgatgttggatgcaggctgtccggcctcagggccagggagccagtttccactgtgcgggaactctgagtcagacgtgattatctgggggtctgtccaccctggctggatctggaggcaagatgccaggccccccaggtgttctcagggcagttcttggtgtctgcttctcagattccaaggactggaattaaaacctttcctggga

SEQ ID NO: 607 - DNA, 1363 bp, Homo sapiens
gcacacggaagcaccgataggctctgcctcccgaagaaaagggagccgcgcagcgcctacgggagtccggcggcagcagccggtaccggcaaccacgggcagctctcagggaatctccgtcgtgaggccagaggctccagtccccgcgagtccagatgcctgtccagcctccaagcaaagacacagaagagatggaagcagagggtgattctgctgctgagatgaatggggaggaggaagagagtgaggaggagcggagcggcagccagacagagtcagaagaggagagctccgagatggatgatgaggactatgagcgacgccgcagcgagtgtgtcagtgagatgctggacctagagaagcagttctcggagctaaaggagaagttgttcagggaacgactgagtcagctgcggttgcggctggaggaagtgggggctgagagagcccctgaatacacggagccccttggggggctgcagcggagcctcaagattcgcattcaggtggcagggatctacaagggcttctgtctggatgtgatcaggaataagtacgaatgtgagctgcagggagccaaacagcacctggagagtgagaagctgctgctctatgacacgctgcagggggagctgcaggagcggatccagaggctggaggaggaccgccagagcctggacctcagctctgaatggtgggatgacaaactgcacgccagaggcagctccaggtcttgggactccctgccgcccagcaagaggaagaaggcacctctggtttctggcccatacatcgtgtacatgcttcaagagatcgacatcctggaggactggacagccatcaaaaaggctagggcagctgtgtcccctcagaagagaaaatcggatgacaggcggacccacaggcccctcagggtctgcccagccaggctcctgtggtgctgctgggccctcccactccatctggcactggcctggactcctcctctgccctcctcgaggcctgcacagctgtggccgtggagctgacctgaccaggcaaggctgctgtctccatccctgagccgcctgccacctcccactcctgaagatccatctcttggggctcccctgacagagaagacagccgaagtcaaagccacatcctcttgctgatgttggatgcaggctgtccggcctcagggccagggagccagtttccactgtgcgggaactctgagtcagacgtgattatctgggggtctgtccaccctggctggatctggaggcaagatgccaggccccccaggtgttctcagggcagttcttggtgtctgcttctcagattccaaggactggaattaaaacctttcctgggactctgg

SEQ ID NO: 608 - DNA, 963 bp, Homo sapiens
agaagggagcgggaggccccctgggcgctgcggagaagctggattgacctctgcgagagtggggagggtctgccttccctaggggcctgccccggaggagctgccattctgaaaagataaattgcctgtgtacagcgctttacagtgtgcttttccatcccttaccacctgtgagctcctcaacactcagagcaggaatggttatccgctttttgcacccgggagtccagatgcctgtccagcctccaagcaaagacacagaagagatggaagcagagggtgattctgctgctgagatgaatggggaggaggaagagagtgaggaggagcggagcggcagccagacagagtcagaagaggagagctccgagatggatgatgaggactatgagcgacgccgcagcgagtgtgtcagtgagatgctggacctagagaagcagttctcggagctaaaggagaagttgttcagggaacgactgagtcagctgcggttgcggctggaggaagtgggggctgagagagcccctgaatacacggagccccttggggggctgcagcggagcctcaagattcgcattcaggtggcagggatctacaagggcttctgtctggatgtgatcaggaataagtacgaatgtgagctgcagggagccaaacagcacctggagagtgagaagctgctgctctatgacacgctgcagggggagctgcaggagcggatccagaggctggaggaggaccgccagagcctggacctcagctctgaatggtgggatgacaaactgcacgccagaggcagctccaggtcttgggactccctgccgcccagcaagaggaagaaggcacctctggtttctggcccatacatcgtgtacatgcttcaagagatcgacatcctggaggactggacagccatcaaaaaggctagggcagctgtgtcccctcagaagagaaaatcggatg

SEQ ID NO: 609 - DNA, 2338 bp, Homo sapiens
cgcgcccctccctcctcgcggacctggcggtgccggcgcccggagtggccctttaaaaggcagcttattgtccggagggggcgggcggggggcgccgaccgcggcctgaggcccggcccctcccctctccctccctctgtccccgcgtcgctcgctggctagctcgctggctcgctcgcccgtccggcgcacgctccgcctccgtcagttggctccgctgtcgggtgcgcggcgtggagcggcagccggtctggacgcgcggccggggctgggggctgggagcgcggcgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagaaagaaaagtaaactgttttcgcggctgcgcagaaagaagaacagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagctccggaaaggcccaccagtccctccgcctcccaaacacaccccgtccaaggaagtcaagcaggagcagatcctcagcctgtttgaggacacgtttgtccctgagatcagcgtgaccaccccctcccagccagcagaggcctcggaggtggcgggtgggacccaacctgcggctggagcccaggagccaggggagacggcggcaagtgaagcagcctccagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaa

SEQ ID NO: 610 - DNA, 2693 bp, Homo sapiens
tccccgccccggggcggtgcagctggagcgtcaggggagtcccgctcgccgcagccccagcgccgcgcgcgcccctccctcctcgcggacctggcggtgccggcgcccggagtggccctttaaaaggcagcttattgtccggagggggcgggcggggggcgccgaccgcggcctgaggcccggcccctcccctctccctccctctgtccccgcgtcgctcgctggctagctcgctggctcgctcgcccgtccggcgcacgctccgcctccgtcagttggctccgctgtcgggtgcgcggcgtggagcggcagccggtctggacgcgcggccggggctgggggctgggagcgcggcgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaagcctgtctcgctgcttgagaaagccgccccccagtggtgccaaggcaaactgcaggctcatctcgtagctcaaactaacctgctccgaaatcaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagctccggaaaggcccaccagtccctccgcctcccaaacacaccccgtccaaggaagtcaagcaggagcagatcctcagcctgtttgaggacacgtttgtccctgagatcagcgtgaccaccccctcccagtttgaggccccggggcctttctcggagcaggccagtctgctggacctggactttgaccccctcccgcccgtgacgagccctgtgaaggcacccacgccctctggtcagtcaattccatgggacctctgggagcccacagagagtccagccggcagcctgccttccggggagcccagcgctgccgagggcacctttgctgtgtcctggcccagccagacggccgagccggggcctgcccaaccagcagaggcctcggaggtggcgggtgggacccaacctgcggctggagcccaggagccaggggagacggcggcaagtgaagcagcctccagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaa

SEQ ID NO: 611 - DNA, 2401 bp, Homo sapiens
cgcgcccctccctcctcgcggacctggcggtgccggcgcccggagtggccctttaaaaggcagcttattgtccggagggggcgggcggggggcgccgaccgcggcctgaggcccggcccctcccctctccctccctctgtccccgcgtcgctcgctggctagctcgctggctcgctcgcccgtccggcgcacgctccgcctccgtcagttggctccgctgtcgggtgcgcggcgtggagcggcagccggtctggacgcgcggccggggctgggggctgggagcgcggcgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagctccggaaaggcccaccagtccctccgcctcccaaacacaccccgtccaaggaagtcaagcaggagcagatcctcagcctgtttgaggacacgtttgtccctgagatcagcgtgaccaccccctcccagcccacagagagtccagccggcagcctgccttccggggagcccagcgctgccgagggcacctttgctgtgtcctggcccagccagacggccgagccggggcctgcccaaccagcagaggcctcggaggtggcgggtgggacccaacctgcggctggagcccaggagccaggggagacggcggcaagtgaagcagcctccagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaa

SEQ ID NO: 612 - DNA, 2074 bp, Homo sapiens
cgcgcccctccctcctcgcggacctggcggtgccggcgcccggagtggccctttaaaaggcagcttattgtccggagggggcgggcggggggcgccgaccgcggcctgaggcccggcccctcccctctccctccctctgtccccgcgtcgctcgctggctagctcgctggctcgctcgcccgtccggcgcacgctccgcctccgtcagttggctccgctgtcgggtgcgcggcgtggagcggcagccggtctggacgcgcggccggggctgggggctgggagcgcggcgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaa

SEQ ID NO: 613 - DNA, 2365 bp, Homo sapiens
cgcgcccctccctcctcgcggacctggcggtgccggcgcccggagtggccctttaaaaggcagcttattgtccggagggggcgggcggggggcgccgaccgcggcctgaggcccggcccctcccctctccctccctctgtccccgcgtcgctcgctggctagctcgctggctcgctcgcccgtccggcgcacgctccgcctccgtcagttggctccgctgtcgggtgcgcggcgtggagcggcagccggtctggacgcgcggccggggctgggggctgggagcgcggcgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaagcctgtctcgctgcttgagaaagccgccccccagtggtgccaaggcaaactgcaggctcatctcgtagctcaaactaacctgctccgaaatcaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagcccacagagagtccagccggcagcctgccttccggggagcccagcgctgccgagggcacctttgctgtgtcctggcccagccagacggccgagccggggcctgcccaaccagcagaggcctcggaggtggcgggtgggacccaacctgcggctggagcccaggagccaggggagacggcggcaagtgaagcagcctccagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaa

SEQ ID NO: 614 - DNA, 2209 bp, Homo sapiens
cgcgcccctccctcctcgcggacctggcggtgccggcgcccggagtggccctttaaaaggcagcttattgtccggagggggcgggcggggggcgccgaccgcggcctgaggcccggcccctcccctctccctccctctgtccccgcgtcgctcgctggctagctcgctggctcgctcgcccgtccggcgcacgctccgcctccgtcagttggctccgctgtcgggtgcgcggcgtggagcggcagccggtctggacgcgcggccggggctgggggctgggagcgcggcgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagaaagaaaagtaaactgttttcgcggctgcgcagaaagaagaacagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagccagcagaggcctcggaggtggcgggtgggacccaacctgcggctggagcccaggagccaggggagacggcggcaagtgaagcagcctccagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaa

SEQ ID NO: 615 - DNA, 2497 bp, Homo sapiens
cgcgcccctccctcctcgcggacctggcggtgccggcgcccggagtggccctttaaaaggcagcttattgtccggagggggcgggcggggggcgccgaccgcggcctgaggcccggcccctcccctctccctccctctgtccccgcgtcgctcgctggctagctcgctggctcgctcgcccgtccggcgcacgctccgcctccgtcagttggctccgctgtcgggtgcgcggcgtggagcggcagccggtctggacgcgcggccggggctgggggctgggagcgcggcgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaagcctgtctcgctgcttgagaaagccgccccccagtggtgccaaggcaaactgcaggctcatctcgtagctcaaactaacctgctccgaaatcaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagtttgaggccccggggcctttctcggagcaggccagtctgctggacctggactttgaccccctcccgcccgtgacgagccctgtgaaggcacccacgccctctggtcagtcaattccatgggacctctgggagcccacagagagtccagccggcagcctgccttccggggagcccagcgctgccgagggcacctttgctgtgtcctggcccagccagacggccgagccggggcctgcccaaccagcagaggcctcggaggtggcgggtgggacccaacctgcggctggagcccaggagccaggggagacggcggcaagtgaagcagcctccagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaa

SEQ ID NO: 616 - DNA, 2293 bp, Homo sapiens
cgcgcccctccctcctcgcggacctggcggtgccggcgcccggagtggccctttaaaaggcagcttattgtccggagggggcgggcggggggcgccgaccgcggcctgaggcccggcccctcccctctccctccctctgtccccgcgtcgctcgctggctagctcgctggctcgctcgcccgtccggcgcacgctccgcctccgtcagttggctccgctgtcgggtgcgcggcgtggagcggcagccggtctggacgcgcggccggggctgggggctgggagcgcggcgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagctccggaaaggcccaccagtccctccgcctcccaaacacaccccgtccaaggaagtcaagcaggagcagatcctcagcctgtttgaggacacgtttgtccctgagatcagcgtgaccaccccctcccagccagcagaggcctcggaggtggcgggtgggacccaacctgcggctggagcccaggagccaggggagacggcggcaagtgaagcagcctccagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaa

SEQ ID NO: 617 - DNA, 2272 bp, Homo sapiens
cgcgcccctccctcctcgcggacctggcggtgccggcgcccggagtggccctttaaaaggcagcttattgtccggagggggcgggcggggggcgccgaccgcggcctgaggcccggcccctcccctctccctccctctgtccccgcgtcgctcgctggctagctcgctggctcgctcgcccgtccggcgcacgctccgcctccgtcagttggctccgctgtcgggtgcgcggcgtggagcggcagccggtctggacgcgcggccggggctgggggctgggagcgcggcgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagcccacagagagtccagccggcagcctgccttccggggagcccagcgctgccgagggcacctttgctgtgtcctggcccagccagacggccgagccggggcctgcccaaccagcagaggcctcggaggtggcgggtgggacccaacctgcggctggagcccaggagccaggggagacggcggcaagtgaagcagcctccagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaa

SEQ ID NO: 618 - DNA, 2143 bp, Homo sapiens
cctcctcgcggacctggcggtgccggcgcccggagtggccctttaaaaggcagcttattgtccggagggggcgggcggggggcgccgaccgcggcctgaggcccggcccctcccctctccctccctctgtccccgcgtcgctcgctggctagctcgctggctcgctcgcccgtccggcgcacgctccgcctccgtcagttggctccgctgtcgggtgcgcggcgtggagcggcagccggtctggacgcgcggccggggctgggggctgggagcgcggcgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagccagcagaggcctcggaggtggcgggtgggacccaacctgcggctggagcccaggagccaggggagacggcggcaagtgaagcagcctccagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaa

SEQ ID NO: 619 - DNA, 2297 bp, Homo sapiens
gagaggggcatcgcgccgcccggcgcgcgccgcccccctgcctcgcggcgcggggtctcgcgggccccgctcccgccctccgctcgcctggcccggaccggaagcggcgccgcacggcctgggcctggcgcggggggcgggcaccggggcccggtcggacatgggcaagaagcacaagaagcacaagtcggacaaacacctctacgaggagtatgtagagaagcccttgaagctggtcctcaaagtaggagggaacgaagtcaccgaactctccacgggcagctcggggcacgactccagcctcttcgaagacaaaaacgatcatgacaaacacaaggacagaaagcggaaaaagagaaagaaaggagagaagcagattccaggggaagaaaaggggagaaaacggagaagagttaaggaggataaaaagaagcgagatcgagaccgggtggagaatgaggcagaaaaagatctccagtgtcacgcccctgtgagattagacttgcctcctgagaagcctctcacaagctctttagccaaacaagaagaagtagaacagacaccccttcaagaagctttgaatcaactgatgagacaattgcagagaaaagatccaagtgctttcttttcatttcctgtgactgattttattgctcctggctactccatgatcattaaacacccaatggattttagtaccatgaaagaaaagatcaagaacaatgactatcagtccatagaagaactaaaggataacttcaaactaatgtgtactaatgccatgatttacaataaaccagagaccatttattataaagctgcaaagaagctgttgcactcaggaatgaaaattcttagccaggaaagaattcagagcctgaagcagagcatagacttcatggctgacttgcagaaaactcgaaagcagaaagatggaacagacacctcacagagtggggaggacggaggctgctggcagagagagagagaggactctggagatgccgaagcacacgccttcaagagtcccagcaaagaaaataaaaagaaagacaaagatatgcttgaagataagtttaaaagcaataatttagagagagagcaggagcagcttgaccgcatcgtgaaggaatctggaggaaagctgaccaggcggcttgtgaacagtcagtgcgaatttgaaagaagaaaaccagatggaacaacgacgttgggacttctccatcctgtggatcccattgtaggagagccaggctactgccctgtgagactgggaatgacaactggaagacttcagtctggagtgaatactttgcaggggttcaaagaggataaaaggaacaaagtcactccagtgttatatttgaattatgggccctacagttcttatgcaccgcattatgactccacatttgcaaatatcagcaaggatgattctgatttaatctattcaacctatggggaagactctgatcttccaagtgatttcagcatccatgagtttttggccacgtgccaagattatccgtatgtcatggcagatagtttactggatgttttaacaaaaggagggcattccaggaccctacaagagatggagatgtcattgcctgaagatgaaggccatactaggacacttgacacagcaaaagaaatggagattacagaagtagagccaccagggcgtttggactccagtactcaagacaggctcatagcgctgaaagcagtaacaaattttggcgttccagttgaagtttttgactctgaagaagctgaaatattccagaagaaacttgatgagaccaccagattgctcagggaactccaggaagcccagaatgaacgtttgagcaccagaccccctccgaacatgatctgtctcttgggtccctcatacagagaaatgcatcttgctgaacaagtgaccaataatcttaaagaacttgcacagcaagtaactccaggtgatatcgtaagcacgtatggagttcgaaaagcaatggggatttccattccttcccccgtcatggaaaacaactttgtggatttgacagaagacactgaagaacctaaaaagacggatgttgctgagtgtggacctggtggaagttgaggctgcctggtatttgattatatattatgtacatactttttcattcttaacttagaaatgcttttcagaagatattaaatatttgtaaattgtgtttttaattaaactttggaacagcgaatttggatgttccagaggttggacttgtattaggtaataaagctggacctgggactcgtga

SEQ ID NO: 620 - DNA, 2145 bp, Homo sapiens
cggacatgggcaagaagcacaagaagcacaagtcggacaaacacctctacgaggagtatgtagagaagcccttgaagctggtcctcaaagtaggagggaacgaagtcaccgaactctccacgggcagctcggggcacgactccagcctcttcgaagacaaaaacgatcatgacaaacacaaggacagaaagcggaaaaagagaaagaaaggagagaagcagattccaggggaagaaaaggggagaaaacggagaagagttaaggaggataaaaagaagcgagatcgagaccgggtggagaatgaggcagaaaaagatctccagtgtcacgcccctgtgagattagacttgcctcctgagaagcctctcacaagctctttagccaaacaagaagaagtagaacagacaccccttcaagaagctttgaatcaactgatgagacaattgcagagaaaagatccaagtgctttcttttcatttcctgtgactgattttattgctcctggctactccatgatcattaaacacccaatggattttagtaccatgaaagaaaagatcaagaacaatgactatcagtccatagaagaactaaaggataacttcaaactaatgtgtactaatgccatgatttacaataaaccagagaccatttattataaagctgcaaagaagctgttgcactcaggaatgaaaattcttagccaggaaagaattcagagcctgaagcagagcatagacttcatggctgacttgcagaaaactcgaaagcagaaagatggaacagacacctcacagagtggggaggacggaggctgctggcagagagagagagaggactctggagatgccgaagcacacgccttcaagagtcccagcaaagaaaataaaaagaaagacaaagatatgcttgaagataagtttaaaagcaataatttagagagagagcaggagcagcttgaccgcatcgtgaaggaatctggaggaaagctgaccaggcggcttgtgaacagtcagtgcgaatttgaaagaagaaaaccagatggaacaacgacgttgggacttctccatcctgtggatcccattgtaggagagccaggctactgccctgtgagactgggaatgacaactggaagacttcagtctggagtgaatactttgcaggggttcaaagaggataaaaggaacaaagtcactccagtgttatatttgaattatgggccctacagttcttatgcaccgcattatgactccacatttgcaaatatcagcaaggatgattctgatttaatctattcaacctatggggaagactctgatcttccaagtgatttcagcatccatgagtttttggccacgtgccaagattatccgtatgtcatggcagatagtttactggatgttttaacaaaaggagggcattccaggaccctacaagagatggagatgtcattgcctgaagatgaaggccatactaggacacttgacacagcaaaagaaatggagcagattacagaagtagagccaccagggcgtttggactccagtactcaagacaggctcatagcgctgaaagcagtaacaaattttggcgttccagttgaagtttttgactctgaagaagctgaaatattccagaagaaacttgatgagaccaccagattgctcagggaactccaggaagcccagaatgaacgtttgagcaccagaccccctccgaacatgatctgtctcttgggtccctcatacagagaaatgcatcttgctgaacaagtgaccaataatcttaaagaacttgcacagcaagtaactccaggtgatatcgtaagcacgtatggagttcgaaaagcaatggggatttccattccttcccccgtcatggaaaacaactttgtggatttgacagaagacactgaagaacctaaaaagacggatgttgctgagtgtggacctggtggaagttgaggctgcctggtatttgattatatattatgtacatactttttcattcttaacttagaaatgcttttcagaagatattaaatatttgtaaattgtgtttttaattaaactttggaacagcgaatttggatgttccagaggttggacttgtattaggtaataaagctggacctgggactcgtga

SEQ ID NO: 621 - DNA, 2145 bp, Homo sapiens; identical to SEQ ID NO: 620

SEQ ID NO: 622 - DNA, 2579 bp, Homo sapiens
gctcagactgtccttcctctctggactgtaagaatatgtctccagggccagtgtctgctgcgatcgagtcccaccttccaagtcctggcatctcaatgcatctgggaagctacctgcattaagtcaggactgagcacacaggtgaactccagaaagaagaagctatggccgcagtgattctggagagcatctttctgaagcgatcccaacagaaaaagaaaacatcacctctaaacttcaagaagcgcctgtttctcttgaccgtgcacaaactctcctactatgagtatgactttgaacgtgggagaagaggcagtaagaagggttcaatagatgttgagaagatcacttgtgttgaaacagtggttcctgaaaaaaatcctcctccagaaagacagattccgagaagaggtgaagagtccagtgaaatggagcaaatttcaatcattgaaaggttcccttatcccttccaggttgtatatgatgaagggcctctctacgtcttctccccaactgaagaactaaggaagcggtggattcaccagctcaaaaacgtaatccggtacaacagtgatctggttcagaaatatcacccttgcttctggatcgatgggcagtatctctgctgctctcagacagccaaaaatgctatgggctgccaaattttggagaacaggaatggaagcttaaaacctgggagttctcaccggaagacaaaaaagcctcttcccccaacgcctgaggaggaccagatcttgaaaaagccactaccgcctgagccagcagcagcaccagtctccacaagtgagctgaaaaaggttgtggccctttatgattacatgccaatgaatgcaaatgatctacagctgcggaagggtgatgaatattttatcttggaggaaagcaacttaccatggtggagagcacgagataaaaatgggcaggaaggctacattcctagtaactatgtcactgaagcagaagactccatagaaatgtatgagtggtattccaaacacatgactcggagtcaggctgagcaactgctaaagcaagaggggaaagaaggaggtttcattgtcagagactccagcaaagctggcaaatatacagtgtctgtgtttgctaaatccacaggggaccctcaaggggtgatacgtcattatgttgtgtgttccacacctcagagccagtattacctggctgagaagcaccttttcagcaccatccctgagctcattaactaccatcagcacaactctgcaggactcatatccaggctcaaatatccagtgtctcaacaaaacaagaatgcaccttccactgcaggcctgggatacggatcatgggaaattgatccaaaggacctgaccttcttgaaggagctggggactggacaatttggggtagtgaagtatgggaaatggagaggccagtacgacgtggccatcaagatgatcaaagaaggctccatgtctgaagatgaattcattgaagaagccaaagtcatgatgaatctttcccatgagaagctggtgcagttgtatggcgtctgcaccaagcagcgccccatcttcatcatcactgagtacatggccaatggctgcctcctgaactacctgagggagatgcgccaccgcttccagactcagcagctgctagagatgtgcaaggatgtctgtgaagccatggaatacctggagtcaaagcagttccttcaccgagacctggcagctcgaaactgtttggtaaacgatcaaggagttgttaaagtatctgatttcggcctgtccaggtatgtcctggatgatgaatacacaagctcagtaggctccaaatttccagtccggtggtccccaccggaagtcctgatgtatagcaagttcagcagcaaatctgacatttgggcttttggggttttgatgtgggaaatttactccctggggaagatgccatatgagagatttactaacagtgagactgctgaacacattgcccaaggcctacgtctctacaggcctcatctggcttcagagaaggtatataccatcatgtacagttgctggcatgagaaagcagatgagcgtcccactttcaaaattcttctgagcaatattctagatgtcatggatgaagaatcctgagctcgccaataagcttcttggttctacttctcttctccacaagccccaatttcactttctcagaggaaatcccaagcttaggagccctggagcctttgtgctcccactcaatacaaaaaggcccctctctacatctgggaatgcacctcttctttgattccctgggatagtggcttctgagcaaaggccaagaaattattgtgcctgaaatttcccgagagaattaagacagactgaatttgcgatgaaaatattttttaggagggaggatgtaaatagccgcacaaaggggtccaacagctctttgagtaggcatttggtagagcttgggggtgtgtgtgtgggggtggaccgaatttggcaagaatgaaatggtgtcataaagatgggaggggagggtgttttgataaaataaaattactagaaagcttgaaa

SEQ ID NO: 623 - DNA, 1065 bp, Homo sapiens
gtgatacgtcattatgttgtgtgttccacacctcagagccagtattacctggctgagaagcaccttttcagcaccatccctgagctcattaactaccatcagcacaactctgcaggactcatatccaggactcagcagctgctagagatgtgcaaggatgtctgtgaagccatggaatacctggagtcaaagcagttccttcaccgagacctggcagctcgaaactgtttggtaaacgatcaaggagttgttaaagtatctgatttcggcctgtccaggtatgtcctggatgatgaatacacaagctcagtaggctccaaatttccagtccggtggtccccaccggaagtcctgatgtatagcaagttcagcagcaaatctgacatttgggcttttggggttttgatgtgggaaatttactccctggggaagatgccatatgagagatttactaacagtgagactgctgaacacattgcccaaggcctacgtctctacaggcctcatctggcttcagagaaggtatataccatcatgtacagttgctggcatgagaaagcagatgagcgtcccactttcaaaattcttctgagcaatattctagatgtcatggatgaagaatcctgagctcgccaataagcttcttggttctacttctcttctccacaagccccaatttcactttctcagaggaaatcccaagcttaggagccctggagcctttgtgctcccactcaatacaaaaaggcccctctctacatctgggaatgcacctcttctttgattccctgggatagtggcttctgagcaaaggccaagaaattattgtgcctgaaatttcccgagagaattaagacagactgaatttgcgatgaaaatattttttaggagggaggatgtaaatagccgcacaaaggggtccaacagctctttgagtaggcatttggtagagcttgggggtgtgtgtgtgggggtggaccgaatttggcaagaatgaaatggtgtcataaagatgggaggggagggtgttttgataaaataaaattactagaaagcttgaaagtc

SEQ ID NO: 624 - DNA, 858 bp, Homo sapiens
gtgatacgtcattatgttgtgtgttccacacctcagagccagtattacctggctgagaagcaccttttcagcaccatccctgagctcattaactaccatcagcacaactctgcaggactcatatccaggctcaaatatccagtgtctcaacaaaacaagaatgcaccttccactgcaggcctgggatacggggttttgatgtgggaaatttactccctggggaagatgccatatgagagatttactaacagtgagactgctgaacacattgcccaaggcctacgtctctacaggcctcatctggcttcagagaaggtatataccatcatgtacagttgctggcatgagaaagcagatgagcgtcccactttcaaaattcttctgagcaatattctagatgtcatggatgaagaatcctgagctcgccaataagcttcttggttctacttctcttctccacaagccccaatttcactttctcagaggaaatcccaagcttaggagccctggagcctttgtgctcccactcaatacaaaaaggcccctctctacatctgggaatgcacctcttctttgattccctgggatagtggcttctgagcaaaggccaagaaattattgtgcctgaaatttcccgagagaattaagacagactgaatttgcgatgaaaatattttttaggagggaggatgtaaatagccgcacaaaggggtccaacagctctttgagtaggcatttggtagagcttgggggtgtgtgtgtgggggtggaccgaatttggcaagaatgaaatggtgtcataaagatgggaggggagggtgttttgataaaataaaattactagaaagcttgaaagtc

SEQ ID NO: 625 - DNA, 1143 bp, Homo sapiens
cgtcattatgttgtgtgttccacacctcagagccagtattacctggctgagaagcaccttttcagcaccatccctgagctcattaactaccatcagcacaactctgcaggactcatatccaggctcaaatatccagtgtctcaacaaaacaagaatgcaccttccactgcaggcctgggatacggatcatgggaaattgatccaaaggacctgaccttcttgaaggagctggggactggacaatttggggtagtgaagtatgggaaatggagaggccagtacgacgtggccatcaagatgatcaaagaaggctccatgtctgaagatgaattcattgaagaagccaaagtcatgatgtatgtcctggatgatgaatacacaagctcagtaggctccaaatttccagtccggtggtccccaccggaagtcctgatgtatagcaagttcagcagcaaatctgacatttgggcttttggggttttgatgtgggaaatttactccctggggaagatgccatatgagagatttactaacagtgagactgctgaacacattgcccaaggcctacgtctctacaggcctcatctggcttcagagaaggtatataccatcatgtacagttgctggcatgagaaagcagatgagcgtcccactttcaaaattcttctgagcaatattctagatgtcatggatgaagaatcctgagctcgccaataagcttcttggttctacttctcttctccacaagccccaatttcactttctcagaggaaatcccaagcttaggagccctggagcctttgtgctcccactcaatacaaaaaggcccctctctacatctgggaatgcacctcttctttgattccctgggatagtggcttctgagcaaaggccaagaaattattgtgcctgaaatttcccgagagaattaagacagactgaatttgcgatgaaaatattttttaggagggaggatgtaaatagccgcacaaaggggtccaacagctctttgagtaggcatttggtagagcttgggggtgtgtgtgtgggggtggaccgaatttggcaagaatgaaatggtgtcataaagatgggaggggagggtgttttgataaaataaaattactagaaagcttgaaagtc

SEQ ID NO: 626 - DNA, 977 bp, Homo sapiens
gtgatacgtcattatgttgtgtgttccacacctcagagccagtattacctggctgagaagcaccttttcagcaccatccctgagctcattaactaccatcagcacaactctgcaggactcatatccaggctcaaatatccagtgtctcaacaaaacaagaatgcaccttccactgcaggcctgggatacggtatgtcctggatgatgaatacacaagctcagtaggctccaaatttccagtccggtggtccccaccggaagtcctgatgtatagcaagttcagcagcaaatctgacatttgggcttttggggttttgatgtgggaaatttactccctggggaagatgccatatgagagatttactaacagtgagactgctgaacacattgcccaaggcctacgtctctacaggcctcatctggcttcagagaaggtatataccatcatgtacagttgctggcatgagaaagcagatgagcgtcccactttcaaaattcttctgagcaatattctagatgtcatggatgaagaatcctgagctcgccaataagcttcttggttctacttctcttctccacaagccccaatttcactttctcagaggaaatcccaagcttaggagccctggagcctttgtgctcccactcaatacaaaaaggcccctctctacatctgggaatgcacctcttctttgattccctgggatagtggcttctgagcaaaggccaagaaattattgtgcctgaaatttcccgagagaattaagacagactgaatttgcgatgaaaatattttttaggagggaggatgtaaatagccgcacaaaggggtccaacagctctttgagtaggcatttggtagagcttgggggtgtgtgtgtgggggtggaccgaatttggcaagaatgaaatggtgtcataaagatgggaggggagggtgttttgataaaataaaattactagaaagcttgaaagtc

SEQ ID NO: 627 - DNA, 2203 bp, Homo sapiens
ctctctggactgtaagaatatgtctccagggccagtgtctgctgcgatcgagtcccaccttccaagtcctggcatctcaatgcatctgggaagctacctgcattaagtcaggactgagagctgtgtgttacacaccaaccttctggaggactcaaaaatggatccctttcctttcacattattgagtgatggaccagtggcacctaaggaagagctaccacattttcaggctgtgtgagtctggactggatcataagaaacaggagaaaagcagtcaaagaagcacacaggtgaactccagaaagaagaagctatggccgcagtgattctggagagcatctttctgaagcgatcccaacagaaaaagaaaacatcacctctaaacttcaagaagcgcctgtttctcttgaccgtgcacaaactctcctactatgagtatgactttgaacgtgggagaagaggcagtaagaagggttcaatagatgttgagaagatcacttgtgttgaaacagtggttcctgaaaaaaatcctcctccagaaagacagattccgagaagaggtgaagagtccagtgaaatggagcaaatttcaatcattgaaaggttcccttatcccttccaggttgtatatgatgaagggcctctctacgtcttctccccaactgaagaactaaggaagcggtggattcaccagctcaaaaacgtaatccggtacaacagtgatctggttcagaaatatcacccttgcttctggatcgatgggcagtatctctgctgctctcagacagccaaaaatgctatgggctgccaaattttggagaacaggaatggaagcttaaaacctgggagttctcaccggaagacaaaaaagcctcttcccccaacgcctgaggaggaccagatcttgaaaaagccactaccgcctgagccagcagcagcaccagtctccacaagtgagctgaaaaaggttgtggccctttatgattacatgccaatgaatgcaaatgatctacagctgcggaagggtgatgaatattttatcttggaggaaagcaacttaccatggtggagagcacgagataaaaatgggcaggaaggctacattcctagtaactatgtcactgaagcagaagactccatagaaatgtatgagtggtattccaaacacatgactcggagtcaggctgagcaactgctaaagcaagaggggaaagaaggaggtttcattgtcagagactccagcaaagctggcaaatatacagtgtctgtgtttgctaaatccacaggggaccctcaaggggtgatacgtcattatgttgtgtgttccacacctcagagccagtattacctggcagctcgaaactgtttggtaaacgatcaaggagttgttaaagtatctgatttcggcctgtccaggtatgtcctggatgatgaatacacaagctcagtaggctccaaatttccagtccggtggtccccaccggaagtcctgatgtatagcaagttcagcagcaaatctgacatttgggcttttggggttttgatgtgggaaatttactccctggggaagatgccatatgagagatttactaacagtgagactgctgaacacattgcccaaggcctacgtctctacaggcctcatctggcttcagagaaggtatataccatcatgtacagttgctggcatgagaaagcagatgagcgtcccactttcaaaattcttctgagcaatattctagatgtcatggatgaagaatcctgagctcgccaataagcttcttggttctacttctcttctccacaagccccaatttcactttctcagaggaaatcccaagcttaggagccctggagcctttgtgctcccactcaatacaaaaaggcccctctctacatctgggaatgcacctcttctttgattccctgggatagtggcttctgagcaaaggccaagaaattattgtgcctgaaatttcccgagagaattaagacagactgaatttgcgatgaaaatattttttaggagggaggatgtaaatagccgcacaaaggggtccaacagctctttgagtaggcatttggtagagcttgggggtgtgtgtgtgggggtggaccgaatttggcaagaatgaaatggtgtcataaagatgggaggggagggtgttttgataaaataaaattactagaaagcttgaaagtc

SEQ ID NO: 628 - DNA, 992 bp, Homo sapiens
gtgatacgtcattatgttgtgtgttccacacctcagagccagtattacctggctgagaagcaccttttcagcaccatccctgagctcattaactaccatcagcacaactctgcaggactcatatccaggctcaaatatccagtgtctcaacaaaacaagaatgcaccttccactgcaggcctgggatacggatcatgggaaattgatccaaaggacctgaccttcttgaaggagctggggactggacaatttggggtagtgaagtatgggaaatggagaggccagtacgacgtggccatcaagatgatcaaagaaggctccatgtctgaagatgaattcattgaagaagccaaagtcatgatgaatctttcccatgagaagctggtgcagttgtatggcgtctgcaccaagcagcgccccatcttcatcatcactgagtacatggccaatggctgcctcccatgtacagttgctggcatgagaaagcagatgagcgtcccactttcaaaattcttctgagcaatattctagatgtcatggatgaagaatcctgagctcgccaataagcttcttggttctacttctcttctccacaagccccaatttcactttctcagaggaaatcccaagcttaggagccctggagcctttgtgctcccactcaatacaaaaaggcccctctctacatctgggaatgcacctcttctttgattccctgggatagtggcttctgagcaaaggccaagaaattattgtgcctgaaatttcccgagagaattaagacagactgaatttgcgatgaaaatattttttaggagggaggatgtaaatagccgcacaaaggggtccaacagctctttgagtaggcatttggtagagcttgggggtgtgtgtgtgggggtggaccgaatttggcaagaatgaaatggtgtcataaagatgggaggggagggtgttttgataaaataaaattactagaaagcttgaaagtc

SEQ ID NO: 629 - DNA, 1366 bp, Homo sapiens
gtgatacgtcattatgttgtgtgttccacacctcagagccagtattacctggctgagaagcaccttttcagcaccatccctgagctcattaactaccatcagcacaactctgcaggactcatatccaggctcaaatatccagtgtctcaacaaaacaagaatgcaccttccactgcaggcctgggatacggatcatgggaaattgatccaaaggacctgaccttcttgaaggagctggggactggacaatttggggtagtgaagtatgggaaatggagaggccagtacgacgtggccatcaagatgatcaaagaaggctccatgtctgaagatgaattcattgaagaagccaaagtcatgatgaatctttcccatgagaagctggtgcagttgtatggcgtctgcaccaagcagcgccccatcttcatcatcactgagtacatggccaatggctgcctcctgaactacctgagggagatgcgccaccgcttccagactcagcagctgctagagatgtgcaaggatgtctgtgaagccatggaatacctggagtcaaagcagttccttcaccgagacctggtatgtcctggatgatgaatacacaagctcagtaggctccaaatttccagtccggtggtccccaccggaagtcctgatgtatagcaagttcagcagcaaatctgacatttgggcttttggggttttgatgtgggaaatttactccctggggaagatgccatatgagagatttactaacagtgagactgctgaacacattgcccaaggcctacgtctctacaggcctcatctggcttcagagaaggtatataccatcatgtacagttgctggcatgagaaagcagatgagcgtcccactttcaaaattcttctgagcaatattctagatgtcatggatgaagaatcctgagctcgccaataagcttcttggttctacttctcttctccacaagccccaatttcactttctcagaggaaatcccaagcttaggagccctggagcctttgtgctcccactcaatacaaaaaggcccctctctacatctgggaatgcacctcttctttgattccctgggatagtggcttctgagcaaaggccaagaaattattgtgcctgaaatttcccgagagaattaagacagactgaatttgcgatgaaaatattttttaggagggaggatgtaaatagccgcacaaaggggtccaacagctctttgagtaggcatttggtagagcttgggggtgtgtgtgtgggggtggaccgaatttggcaagaatgaaatggtgtcataaagatgggaggggagggtgttttgataaaataaaattactagaaagcttgaaagtc

SEQ ID NO: 630 - DNA, 698 bp, Homo sapiens
atacgtcattatgttgtgtgttccacacctcagagccagtattacctggctgagaagcaccttttcagcaccatccctgagctcattaactaccatcagcacaactctgcaggtgaagactcagcagctgctagagatgtgcaaggatgtctgtgaagccatggaatacctggagtcaaagcagttccttcaccgagacctggcagctcgaaactgtttggtaaacgatcaaggagttgttaaagtatctgatttcggcctgtccaggtatgtcctggatgatgaatacacaagctcagtaggctccaaatttccagtccggtggtccccaccggaagtcctgatgtatagcaagttcagcagcaaatctgacatttgggcttttggggttttgatgtgggaaatttactccctggggaagatgccatatgagagatttactaacagtgagactgctgaacacattgcccaaggcctacgtctctacaggcctcatctggcttcagagaaggtatataccatcatgtacagttgctggcatgagaaagcagatgagcgtcccactttcaaaattcttctgagcaatattctagatgtcatggatgaagaatcctgagctcgccaataagcttcttggttctacttctcttctccacaagccccaatttcactttctcagaggaaatcccaagcttagg

SEQ ID NO: 631 - DNA, 1485 bp, Homo sapiens
cgacgcgggagccgcacgcgccggacgaggctcgctgcgctccctgttgcccagcgcgggcccgttgaggcggagccctcagttcccggccaggacacggtctgggccgccgaatctccggccgaagagcggcggcggcagcggcgggaaaaaaatgaagaatgaaattgctgccgttgtcttctttttcacaaggctagttcgaaaacatgataagttgaaaaaagaggcagttgagaggtttgctgagaaattgaccctaatacttcaagaaaaatataaaaatcactggtatccagaaaaaccatcgaaaggacaggcctacagatgtattcgtgtcaataaatttcagagagttgatcctgatgtcctgaaagcctgtgaaaacagctgcatcttgtatagtgacctgggcttgccaaaggagctcactctctgggtggacccatgtgaggtgtgctgtcgtagagatggggtttcaccatgttggccagactgctctcaaactcctgacctcgtgatccgcccgccttggcctcccaaagcgctggattacaggcgtgagccactgcgcccggcctcctcctttttgattatgtatggagagaaaaacaatgcattcattgttgccagctttgaaaataaagatgagaacaaggatgagatctccaggaaagttaccagggcccttgataaggttacctctgattatcattcaggatcctcttcttcagatgaagaaacaagtaaggaaatggaagtgaaacccagttcggtgactgcagccgcaagtcctgtgtaccagatttcagaacttatatttccacctcttccaatgtggcaccctttgcccagaaaaaagccaggaatgtatcgagggaatggccatcagaatcactatcctcctcctgttccatttggttatccaaatcagggaagaaaaaataaaccatatcgcccaattccagtgacatgggtacctcctcctggaatgcattgtgaccggaatcactggattaatcctcacatgttagcacctcactaacttcgtttttgattgtgttggtgtcatgttgagaaaaaggtagaataaaccttactacacattaaaagttaaaagttcttactaatagtagtgaagttagatgggccaaaccatcaaacttatttttatagaagttattgagaataatctttcttaaaaaatatatgcactttagatattgatatagtttgagaaattttattaaagttagtcaagtgcctaagtttttaatattggacttgagtatttatatattgtgcatcaactctgttggatacgagaacactgtagaagtggacgatttgttctagcacctttgagaatttactttatggagcgtatgtaagttatttatatacaaggaaatctattttatgtcgttgtttaagagaattgtgtgaaatcatgtagttgcaaataaaaaatagtttgaggcatga

SEQ ID NO: 632 - DNA, 1456 bp, Homo sapiens
tcttccgggccgcgagccccctgcgcgccgctttggggctgcgctcactcgtgtgcgcgctcgtccgcccgccagtcctctcaacgcgcgcttggccgcccgacgacgcgggagccgcacgcgccggacgaggctcgctgcgctccctgttgcccagcgcgggcccgttgaggcggagccctcagttcccggccaggacacggtctgggccgccgaatctccggccgaagagcggcggcggcagcggcgggaaaaaaatgaagaatgaaattgctgccgttgtcttctttttcacaaggctagttcgaaaacatgataagttgaaaaaagaggcagttgagaggtttgctgagaaattgaccctaatacttcaagaaaaatataaaaatcactggtatccagaaaaaccatcgaaaggacaggcctacagatgtattcgtgtcaataaatttcagagagttgatcctgatgtcctgaaagcctgtgaaaacagctgcatcttgtatagtgacctgggcttgccaaaggagctcactctctgggtggacccatgtgaggtgtgctgtcggtatggagagaaaaacaatgcattcattgttgccagctttgaaaataaagatgagaacaaggatgagatctccaggaaagttaccagggcccttgataaggttacctctgattatcattcaggatcctcttcttcagatgaagaaacaagtaaggaaatggaagtgaaacccagttcggtgactgcagccgcaagtcctgtgtaccagatttcagaacttatatttccacctcttccaatgtggcaccctttgcccagaaaaaagccaggaatgtatcgagggaatggccatcagaatcactatcctcctcctgttccatttggttatccaaatcagggaagaaaaaataaaccatatcgcccaattccagtgacatgggtacctcctcctggaatgcattgtgaccggaatcactggattaatcctcacatgttagcacctcactaacttcgtttttgattgtgttggtgtcatgttgagaaaaaggtagaataaaccttactacacattaaaagttaaaagttcttactaatagtagtgaagttagatgggccaaaccatcaaacttatttttatagaagttattgagaataatctttcttaaaaaatatatgcactttagatattgatatagtttgagaaattttattaaagttagtcaagtgcctaagtttttaatattggacttgagtatttatatattgtgcatcaactctgttggatacgagaacactgtagaagtggacgatttgttctagcacctttgagaatttactttatggagcgtatgtaagttatttatatacaaggaaatctattttatgtcgttgtttaagagaattgtgtgaaatcatgtagttgcaaataaaaaatagtttgaggcatga

SEQ ID NO: 633 - DNA, 511 bp, Homo sapiens
ttccgggccgcgagccccctgcgcgccgctttggggctgcgctcactcgtgtgcgcgctcgtccgcccgccagtcctctcaacgcgcgcttggccgcccgacgacgcgggagccgcacgcgccggacgaggctcgctgcgctccctgttgcccagcgcgggcccgttgaggcggagccctcagttcccggccaggacacggtctgggccgccgaatctccggccgaagagcggcggcggcagcggcgccgtgagcagaggagccttgtggaacaaagtagaacttgaggagcagccgccgcggtgacgaggtcccaggatgacgtcaccgtgcgatatttaaaatgggagccttttgctctgagtggaaaaaaatgaagaatgaaattgctgccgttgtcttctttttcacaaggctagttcgaaaacatgataagttgaaaaaagaggcagttgagaggtttgctgagaaattgaccctaatacttcaagaaaaatataaaaatcactgg

SEQ ID NO: 634 - DNA, 2366 bp, Homo sapiens
gcagagcggcggcttctctcgcgaggacggacgccattatcgcatctccccgacaaacaccacgagaattccgcagcccacacggtgaccaaaagccagccccactgtgagttgaactctttcgtgttgaccggccactctccgtgctctggatgatgtcggaacacgacctggccgatgtggttcagattgcagtggaagacctgagccctgaccacccagttgttttggagaatcatgtagtgacagatgaagacgaacctgctttgaaacgccagcgactagaaatcaattgccaggatccatctataaagacaatctgcttgcggttggatagcattgaagccaaattgcaagccctggaggctacttgtaaatccttagaagaaaagctggatctggtcacgaacaagcagcacagccccatccaggtccccatggtggccggctcccctctcggggcaacccagacgtgcaacaaagtgcgatgcgtcgtcccccagactacagtaatactcaacaatgatcggcagaacgccattgtagccaagatggaagaccccttgagcaacagggcaccggattccctggaaaatgtcattagcaacgctgtgcctgggcgtcggcagaacaccattgtggtgaaggtgccgggccaagaagacagccaccacgaggacggggagagcggctcggaggccagcgactctgtgtccagctgtgggcaggcgggcagtcagagcatcgggagcaacgtcacgctcatcaccctgaactcggaagaggactaccccaatggcacctggctgggcgacgagaacaaccccgagatgcgggtacgctgcgccatcatcccctccgacatgctgcacatcagcaccaactgccgcacggccgagaagatggcgctcacgctgctggactacctcttccaccgcgaggtgcaggctgtgtccaacctctcggggcagggcaagcacgggaagaagcagctggacccgctcaccatctacggcatccggtgtcaccttttctataaatttggcatcacagaatccgactggtaccgaatcaagcagagcatcgactccaagtgccgcacggcgtggcggcgcaagcagcggggccagagcctggcggtcaagagcttctcgcggagaacgcccaactcgtcctcctactgcccttcagagccgatgatgagcaccccacctcctgccagcgagctcccgcagccacagccgcagccgcaggccctgcactacgcgctggccaacgcacagcaggtgcagatccaccagatcggagaagacggacaggtgcaagtaggacacctccacatcgcccaggtgccgcagggggagcaagtccagatcacgcaggacagcgagggcaacctccagatccatcacgtggggcaggacggtcagcttctagaggccacccgcatcccctgcctcctggccccatccgtcttcaaagccagcagtggccaggtgctgcagggtgcacagctgatcgccgtggcctcctcggaccccgcggcggcgggcgtggatgggtcgccactccagggcagcgacatccaggttcagtacgtgcagctggcgccagtgagtgaccacacggccggggcacagacggccgaagccctgcagcccacgctacagccggagatgcagctcgagcacggggccatccagattcagtgagcggtgcccatggcaccaggagcccctcgccggctccgcctacggcccggcccccacgcgccctgctctcacggcctcggcacaggcagcggctgcacgtgttctgctgaagtgcgtctgaaggccgctgcctccgcggggaacagcatcctatcaactgaaagagcagccgccgccgcccccagccggagacccctttcgtttgagtcctgctgttggtgtcggagcacgaggggaggcacggtgcggagagcgtcgcatatgcgcgggaaatcaagaactatgatatttttctgtttaaacagctttttttaatttgctatggtgtttataacaaaaaagaaaatttgaaaaaaaaaatcccaggggagtagcaggagccctttgctgtgtgctctgtccagtgtcatgagacgggagccctttgctgtgtgctctgtccagtgtcatgagacgggagccctttgctgtgtgctctgtccagtgtcatgagacgggagccctttgctgtgtgctctgtccagtgtcatgaggcaggtgtttgcaaagccagctctcggttccgatggggtattgctgacctacttttctaggggaaatgctcttaaacactgtaattatgcatttctaatgaaataaaatgtatttatgacc

SEQ ID NO: 635 - DNA, 2124 bp, Homo sapiens
gcagagcggcggcttctctcgcgaggacggacgccattatcgcatctccccgacaaacaccacgagaattccgcagcccacacggtgaccaaaagccagccccactgtgagttgaactctttcgtgttgaccggccactctccgtgctctggatgatgtcggaacacgacctggccgatgtggttcagattgcagtggaagacctgagccctgaccacccagttgttttggagaatcatgtagtgacagatgaagacgaacctgctttgaaacgccagcgactagaaatcaattgccaggatccatctataaagtcattcctgtattccatcaaccagacaatctgcttgcggttggatagcattgaagccaaattgcaagccctggaggctacttgtaaatccttagaagaaaagctggatctggtcacgaacaagcagcacagccccatccaggtccccatggtggccggctcccctctcggggcaacccagacgtgcaacgctgtgcctgggcgtcggcagaacaccattgtggtgaaggtgccgggccaagaagacagccaccacgaggacggggagagcggctcggaggccagcgactctgtgtccagctgtgggcaggcgggcagtcagagcatcgggagcaacgtcacgctcatcaccctgaactcggaagaggactaccccaatggcacctggctgggcgacgagaacaaccccgagatgcgggtacgctgcgccatcatcccctccgacatgctgcacatcagcaccaactgccgcacggccgagaagatggcgctcacgctgctggactacctcttccaccgcgaggtgcaggctgtgtccaacctctcggggcagggcaagcacgggaagaagcagctggacccgctcaccatctacggcatccggtgtcaccttttctataaatttggcatcacagaatccgactggtaccgaatcaagcagagcatcgactccaagtgccgcacggcgtggcggcgcaagcagcggggccagagcctggcggtcaagagcttctcgcggagaacgcccaactcgtcctcctactgcccttcagagccgatgatgagcaccccacctcctgccagcgagctcccgcagccacagccgcagccgcaggccctgcactacgcgctggccaacgcacagcaggtgcagatccaccagatcggagaagacggacaggtgcaagtaatcccacagggacacctccacatcgcccaggtgccgcagggggagcaagtccagatcacgcaggacagcgagggcaacctccagatccatcacgtggggcaggacggtcaggtgctgcagggtgcacagctgatcgccgtggcctcctcggaccccgcggcggcgggcgtggatgggtcgccactccagggcagcgacatccaggttcagtacgtgcagctggcgccagtgagtgaccacacggccggggcacagacggccgaagccctgcagcccacgctacagccggagatgcagctcgagcacggggccatccagattcagtgagcggtgcccatggcaccaggagcccctcgccggctccgcctacggcccggcccccacgcgccctgctctcacggcctcggcacaggcagcggctgcacgtgttctgctgaagtgcgtctgaaggccgctgcctccgcggggaacagcatcctatcaactgaaagagcagccgccgccgcccccagccggagacccctttcgtttgagtcctgctgttggtgtcggagcacgaggggaggcacggtgcggagagcgtcgcatatgcgcgggaaatcaagaactatgatatttttctgtttaaacagctttttttaatttgctatggtgtttataacaaaaaagaaaatttgaaaaaaaaaatcccaggggagtagcaggagccctttgctgtgtgctctgtccagtgtcatgagacgggagccctttgctgtgtgctctgtccagtgtcatgaggcaggtgtttgcaaagccagctctcggttccgatggggtattgctgacctacttttctaggggaaatgctcttaaacactgtaattatgcatttctaatgaaataaaatgtatttatgacc

SEQ ID NO: 636 - DNA, 2164 bp, Homo sapiens
aacaccacgagaattccgcagcccacacggtgaccaaaagccagccccactgtgagttgaactctttcgtgttgaccggccactctccgtgctctggatgatgtcggaacacgacctggccgatgtggttcagattgcagtggaagacctgagccctgaccacccagttgttttggagaatcatgtagtgacagatgaagacgaacctgctttgaaacgccagcgactagaaatcaattgccaggatccatctataaagtcattcctgtattccatcaaccagacaatctgcttgcggttggatagcattgaagccaaattgcaagccctggaggctacttgtaaatccttagaagaaaagctggatctggtcacgaacaagcagcacagccccatccaggtccccatggtggccggctcccctctcggggcaacccagacgtgcaacaaagtgcgatgcgctgtgcctgggcgtcggcagaacaccattgtggtgaaggtgccgggccaagaagacagccaccacgaggacggggagagcggctcggaggccagcgactctgtgtccagctgtgggcaggcgggcagtcagagcatcgggagcaacgtcacgctcatcaccctgaactcggaagaggactaccccaatggcacctggctgggcgacgagaacaaccccgagatgcgggtacgctgcgccatcatcccctccgacatgctgcacatcagcaccaactgccgcacggccgagaagatggcgctcacgctgctggactacctcttccaccgcgaggtgcaggctgtgtccaacctctcggggcagggcaagcacgggaagaagcagctggacccgctcaccatctacggcatccggtgtcaccttttctataaatttggcatcacagaatccgactggtaccgaatcaagcagagcatcgactccaagtgccgcacggcgtggcggcgcaagcagcggggccagagcctggcggtcaagagcttctcgcggagaacgcccaactcgtcctcctactgcccttcagagccgatgatgagcaccccacctcctgccagcgagctcccgcagccacagccgcagccgcaggccctgcactacgcgctggccaacgcacagcaggtgcagatccaccagatcggagaagacggacaggtgcaagtaatcccacagggacacctccacatcgcccaggtgccgcagggggagcaagtccagatcacgcaggacagcgagggcaacctccagatccatcacgtggggcaggacggtcaggtgctgcagggtgcacagctgatcgccgtggcctcctcggaccccgcggcggcgggcgtggatgggtcgccactccagggcagcgacatccaggttcagtacgtgcagctggcgccagtgagtgaccacacggccggggcacagacggccgaagccctgcagcccacgctacagccggagatgcagctcgagcacggggccatccagattcagtgagcggtgcccatggcaccaggagcccctcgccggctccgcctacggcccggcccccacgcgccctgctctcacggcctcggcacaggcagcggctgcacgtgttctgctgaagtgcgtctgaaggccgctgcctccgcggggaacagcatcctatcaactgaaagagcagccgccgccgcccccagccggagacccctttcgtttgagtcctgctgttggtgtcggagcacgaggggaggcacggtgcggagagcgtcgcatatgcgcgggaaatcaagaactatgatatttttctgtttaaacagctttttttaatttgctatggtgtttataacaaaaaagaaaatttgaaaaaaaaaatcccaggggagtagcaggagccctttgctgtgtgctctgtccagtgtcatgagacgggagccctttgctgtgtgctctgtccagtgtcatgagacgggagccctttgctgtgtgctctgtccagtgtcatgagacgggagccctttgctgtgtgctctgtccagtgtcatgaggcaggtgtttgcaaagccagctctcggttccgatggggtattgctgacctacttttctaggggaaatgctcttaaacactgtaattatgcatttctaatgaaataaaatgtatttatgaccaca

SEQ ID NO: 637 - DNA, 2300 bp, Homo sapiens
gcagagcggcggcttctctcgcgaggacggacgccattatcgcatctccccgacaaacaccacgagaattccgcagcccacacggtgaccaaaagccagccccactgtgagttgaactctttcgtgttgaccggccactctccgtgctctggatgatgtcggaacacgacctggccgatgtggttcagattgcagtggaagacctgagccctgaccacccaggtacagagctgtgggacattgttttggagaatcatgtagtgacagatgaagacgaacctgctttgaaacgccagcgactagaaatcaattgccaggatccatctataaagtcattcctgtattccatcaaccagacaatctgcttgcggttggatagcattgaagccaaattgcaagccctggaggctacttgtaaatccttagaagaaaagctggatctggtcacgaacaagcagcacagccccatccaggtccccatggtggccggctcccctctcggggcaacccagacgtgcaacaaagtgcgatgcgctgtgcctgggcgtcggcagaacaccattgtggtgaaggtgccgggccaagaagacagccaccacgaggacggggagagcggctcggaggccagcgactctgtgtccagctgtgggcaggcgggcagtcagagcatcgggagcaacgtcacgctcatcaccctgaactcggaagaggactaccccaatggcacctggctgggcgacgagaacaaccccgagatgcgggtacgctgcgccatcatcccctccgacatgctgcacatcagcaccaactgccgcacggccgagaagatggcgctcacgctgctggactacctcttccaccgcgaggtgcaggctgtgtccaacctctcggggcagggcaagcacgggaagaagcagctggacccgctcaccatctacggcatccggtgtcaccttttctataaatttggcatcacagaatccgactggtaccgaatcaagcagagcatcgactccaagtgccgcacggcgtggcggcgcaagcagcggggccagagcctggcggtcaagagcttctcgcggagaacgcccaactcgtcctcctactgcccttcagagccgatgatgagcaccccacctcctgccagcgagctcccgcagccacagccgcagccgcaggccctgcactacgcgctggccaacgcacagcaggtgcagatccaccagatcggagaagacggacaggtgcaagtaatcccacagggacacctccacatcgcccaggtgccgcagggggagcaagtccagatcacgcaggacagcgagggcaacctccagatccatcacgtggggcaggacggtcagcttctagaggccacccgcatcccctgcctcctggccccatccgtcttcaaagccagcagtggccaggtgctgcagggtgcacagctgatcgccgtggcctcctcggaccccgcggcggcgggcgtggatgggtcgccactccagggcagcgacatccaggttcagtacgtgcagctggcgccagtgagtgaccacacggccggggcacagacggccgaagccctgcagcccacgctacagccggagatgcagctcgagcacggggccatccagattcagtgagcggtgcccatggcaccaggagcccctcgccggctccgcctacggcccggcccccacgcgccctgctctcacggcctcggcacaggcagcggctgcacgtgttctgctgaagtgcgtctgaaggccgctgcctccgcggggaacagcatcctatcaactgaaagagcagccgccgccgcccccagccggagacccctttcgtttgagtcctgctgttggtgtcggagcacgaggggaggcacggtgcggagagcgtcgcatatgcgcgggaaatcaagaactatgatatttttctgtttaaacagctttttttaatttgctatggtgtttataacaaaaaagaaaatttgaaaaaaaaaatcccaggggagtagcaggagccctttgctgtgtgctctgtccagtgtcatgagacgggagccctttgctgtgtgctctgtccagtgtcatgagacgggagccctttgctgtgtgctctgtccagtgtcatgagacgggagccctttgctgtgtgctctgtccagtgtcatgaggcaggtgtttgcaaagccagctctcggttccgatggggtattgctgacctacttttctaggggaaatgctcttaaacactgtaattatgcatttctaatgaaataaaatgtatttatgacc

SEQ ID NO: 638 - DNA, 2438 bp, Homo sapiens
ctttctcagcctccttagtagctgggattacaggcatgtgccaccataccctgctaattttcgtatttttagtagagatggggttttgccacattggccaggctgacaggtgatccacccgccttggccttccaaagtgctgggatgacagatgtgaccaaaagccagccccactgtgagttgaactctttcgtgttgaccggccactctccgtgctctggatgatgtcggaacacgacctggccgatgtggttcagattgcagtggaagacctgagccctgaccacccagttgttttggagaatcatgtagtgacagatgaagacgaacctgctttgaaacgccagcgactagaaatcaattgccaggatccatctataaagacaatctgcttgcggttggatagcattgaagccaaattgcaagccctggaggctacttgtaaatccttagaagaaaagctggatctggtcacgaacaagcagcacagccccatccaggtccccatggtggccggctcccctctcggggcaacccagacgtgcaacaaagtgcgatgcgtcgtcccccagactacagtaatactcaacaatgatcggcagaacgccattgtagccaagatggaagaccccttgagcaacagggcaccggattccctggaaaatgtcattagcaacgctgtgcctgggcgtcggcagaacaccattgtggtgaaggtgccgggccaagaagacagccaccacgaggacggggagagcggctcggaggccagcgactctgtgtccagctgtgggcaggcgggcagtcagagcatcgggagcaacgtcacgctcatcaccctgaactcggaagaggactaccccaatggcacctggctgggcgacgagaacaaccccgagatgcgggtacgctgcgccatcatcccctccgacatgctgcacatcagcaccaactgccgcacggccgagaagatggcgctcacgctgctggactacctcttccaccgcgaggtgcaggctgtgtccaacctctcggggcagggcaagcacgggaagaagcagctggacccgctcaccatctacggcatccggtgtcaccttttctataaatttggcatcacagaatccgactggtaccgaatcaagcagagcatcgactccaagtgccgcacggcgtggcggcgcaagcagcggggccagagcctggcggtcaagagcttctcgcggagaacgcccaactcgtcctcctactgcccttcagagccgatgatgagcaccccacctcctgccagcgagctcccgcagccacagccgcagccgcaggccctgcactacgcgctggccaacgcacagcaggtgcagatccaccagatcggagaagacggacaggtgcaagtaggacacctccacatcgcccaggtgccgcagggggagcaagtccagatcacgcaggacagcgagggcaacctccagatccatcacgtggggcaggacggtcagcttctagaggccacccgcatcccctgcctcctggccccatccgtcttcaaagccagcagtggccaggtgctgcagggtgcacagctgatcgccgtggcctcctcggaccccgcggcggcgggcgtggatgggtcgccactccagggcagcgacatccaggttcagtacgtgcagctggcgccagtgagtgaccacacggccggggcacagacggccgaagccctgcagcccacgctacagccggagatgcagctcgagcacggggccatccagattcagtgagcggtgcccatggcaccaggagcccctcgccggctccgcctacggcccggcccccacgcgccctgctctcacggcctcggcacaggcagcggctgcacgtgttctgctgaagtgcgtctgaaggccgctgcctccgcggggaacagcatcctatcaactgaaagagcagccgccgccgcccccagccggagacccctttcgtttgagtcctgctgttggtgtcggagcacgaggggaggcacggtgcggagagcgtcgcatatgcgcgggaaatcaagaactatgatatttttctgtttaaacagctttttttaatttgctatggtgtttataacaaaaaagaaaatttgaaaaaaaaaatcccaggggagtagcaggagccctttgctgtgtgctctgtccagtgtcatgagacgggagccctttgctgtgtgctctgtccagtgtcatgagacgggagccctttgctgtgtgctctgtccagtgtcatgagacgggagccctttgctgtgtgctctgtccagtgtcatgaggcaggtgtttgcaaagccagctctcggttccgatggggtattgctgacctacttttctaggggaaatgctcttaaacactgtaattatgcatttctaatgaaataaaatgtatttatgaccaca

SEQ ID NO: 639 - DNA, 2283 bp, Homo sapiens
agagcggcggcttctctcgcgaggacggacgccattatcgcatctccccgacaaacaccacgagaattccgcagcccacacggtgaccaaaagccagccccactgtgagttgaactctttcgtgttgaccggccactctccgtgctctggatgatgtcggaacacgacctggccgatgtggttcagattgcagtggaagacctgagccctgaccacccagttgttttggagaatcatgtagtgacagatgaagacgaacctgctttgaaacgccagcgactagaaatcaattgccaggatccatctataaagtcattcctgtattccatcaaccagacaatctgcttgcggttggatagcattgaagccaaattgcaagccctggaggctacttgtaaatccttagaagaaaagctggatctggtcacgaacaagcagcacagccccatccaggtccccatggtggccggctcccctctcggggcaacccagacgtgcaacaaagtgcgatgcgctgtgcctgggcgtcggcagaacaccattgtggtgaaggtgccgggccaagaagacagccaccacgaggacggggagagcggctcggaggccagcgactctgtgtccagctgtgggcaggcgggcagtcagagcatcgggagcaacgtcacgctcatcaccctgaactcggaagaggactaccccaatggcacctggctgggcgacgagaacaaccccgagatgcgggtacgctgcgccatcatcccctccgacatgctgcacatcagcaccaactgccgcacggccgagaagatggcgctcacgctgctggactacctcttccaccgcgaggtgcaggctgtgtccaacctctcggggcagggcaagcacgggaagaagcagctggacccgctcaccatctacggcatccggtgtcaccttttctataaatttggcatcacagaatccgactggtaccgaatcaagcagagcatcgactccaagtgccgcacggcgtggcggcgcaagcagcggggccagagcctggcggtcaagagcttctcgcggagaacgcccaactcgtcctcctactgcccttcagagccgatgatgagcaccccacctcctgccagcgagctcccgcagccacagccgcagccgcaggccctgcactacgcgctggccaacgcacagcaggtgcagatccaccagatcggagaagacggacaggtgcaagtaatcccacagggacacctccacatcgcccaggtgccgcagggggagcaagtccagatcacgcaggacagcgagggcaacctccagatccatcacgtggggcaggacggtcagcttctagaggccacccgcatcccctgcctcctggccccatccgtcttcaaagccagcagtggccaggtgctgcagggtgcacagctgatcgccgtggcctcctcggaccccgcggcggcgggcgtggatgggtcgccactccagggcagcgacatccaggttcagtacgtgcagctggcgccagtgagtgaccacacggccggggcacagacggccgaagccctgcagcccacgctacagccggagatgcagctcgagcacggggccatccagattcagtgagcggtgcccatggcaccaggagcccctcgccggctccgcctacggcccggcccccacgcgccctgctctcacggcctcggcacaggcagcggctgcacgtgttctgctgaagtgcgtctgaaggccgctgcctccgcggggaacagcatcctatcaactgaaagagcagccgccgccgcccccagccggagacccctttcgtttgagtcctgctgttggtgtcggagcacgaggggaggcacggtgcggagagcgtcgcatatgcgcgggaaatcaagaactatgatatttttctgtttaaacagctttttttaatttgctatggtgtttataacaaaaaagaaaatttgaaaaaaaaaatcccaggggagtagcaggagccctttgctgtgtgctctgtccagtgtcatgagacgggagccctttgctgtgtgctctgtccagtgtcatgagacgggagccctttgctgtgtgctctgtccagtgtcatgagacgggagccctttgctgtgtgctctgtccagtgtcatgaggcaggtgtttgcaaagccagctctcggttccgatggggtattgctgacctacttttctaggggaaatgctcttaaacactgtaattatgcatttctaatgaaataaaatgtatttatgaccaca

SEQ ID NO: 640 - DNA, 586 bp, Homo sapiens
ttctctcgcgaggacggacgccattatcgcatctccccgacaaacaccacgagaattccgcagcccacacggatgcagaaagtagatgacattccatccacactgtgtgagcaaattggagagattgccttgatagaggactgatgtttttcactgatgagatggtgaccaaaagccagccccactgtgagttgaactctttcgtgttgaccggccactctccgtgctctggatgatgtcggaacacgacctggccgatgtggttcagattgcagtggaagacctgagccctgaccacccagttgttttggagaatcatgtagtgacagatgaagacgaacctgctttgaaacgccagcgactagaaatcaattgccaggatccatctataaagtcattcctgtattccatcaaccagacaatctgcttgcggttggatagcattgaagccaaattgcaagccctggaggctacttgtaaatccttagaagaaaagctggatctggtcacgaacaagcagcacagccccatccaggtccccatggtggccggctcccctctcggggcaacccagacgtgcaacaaa

SEQ ID NO: 641 - DNA, 644 bp, Homo sapiens
atcactttttttttttttgagacagagtctcgctctgtcgccaggctggagtgcagtggcgcgatctcggctcactgcaacctctgactcgcgggctcaagcgattctcctgcctcagcctcccgagtagttgggattacaaggcgcccgccaccacgcccggcataattttgtatttttagtagagacagggtttcgccatgttggccaggctggtcgcgaaccctttacctcaggtgttccgcccgccttggcctcccacagggctgagattacaggcgtgatccaccgtgcccggccgccatcacttatttatattatgtgttacctataggacttatctaagaccataatcactgccgcgtgtgctaagtcccgcgcgcgtgcactcaggcccctctggatagacactggggacccctgaccacttatgtcagggaaaacgccaccaagcgctccggaacctcagggcaggacccgccgcagcagcaggtgaccaaaagccagccccactgtgagttgaactctttcgtgttgaccggccactctccgtgctctggatgatgtcggaacacgacctggccgatgtggttcagattgcagtggaagacctgagccctgaccacccagttgttttggagaat

SEQ ID NO: 642 - DNA, 455 bp, Homo sapiens
catctgtaaagtgaggtaggccccttcaagacatgtaaggagtatctatggctgtggaatgcatctttttagactggccgctctgcatggatctgatcacgggtgaccaaaagccagccccactgtgagttgaactctttcgtgttgaccggccactctccgtgctctggatgatgtcggaacacgacctggccgatgtggttcagattgcagtggaagacctgagccctgaccacccagttgttttggagaatcatgtagtgacagatgaagacgaacctgctttgaaacgccagcgactagaaatcaattgccaggatccatctataaagtcattcctgtattccatcaaccagacaatctgcttgcggttggatagcattgaagccaaattgcaagccctggaggctacttgtaaatccttagaagaaaagctggatctggtcacgaacaag

SEQ ID NO: 643 - DNA, 560 bp, Homo sapiens
agtattcttggggagaaagataacagggaagtgaggagggttcagctgtggaagtgctgggatggctgatccgagtgaccatggcctagacggggtttaaaccctggactgaagaaagtgccggtgaccaaaagccagccccactgtgagttgaactctttcgtgttgaccggccactctccgtgctctggatgatgtcggaacacgacctggccgatgtggttcagattgcagtggaagacctgagccctgaccacccagttgttttggagaatcatgtagtgacagatgaagacgaacctgctttgaaacgccagcgactagaaatcaattgccaggatccatctataaagtcattcctgtattccatcaaccagacaatctgcttgcggttggatagcattgaagccaaattgcaagccctggaggctacttgtaaatccttagaagaaaagctggatctggtcacgaacaagcagcacagccccatccaggtccccatggtggccggctcccctctcggggcaacccagacgtgcaacaaagtgcgatgcgtcgtc

SEQ ID NO: 644 - DNA, 736 bp, Homo sapiens
gcagagcggcggcttctctcgcgaggacggacgccattatcgcatctccccgacaaacaccacgagaattccgcagcccacacggtgaccaaaagccagccccactgtgagttgaactctttcgtgttgaccggccactctccgtgctctggatgatgtcggaacacgacctggccgatgtggttcagattgcagtggaagacctgagccctgaccacccaggtacagagctgtgggacattgttttggagaatcatgtagtgacagatgaagacgaacctgctttgaaacgccagcgactagaaatcaattgccaggatccatctataaagtcattcctgtattccatcaaccagacaatctgcttgcggttggatagcattgaagccaaattgcaagccctggaggctacttgtaaatccttagaagaaaagctggatctggtcacgaacaagcagcacagccccatccaggtccccatggtggccggctcccctctcggggcaacccagacgtgcaacaaagtgcgatgcgctgtgcctgggcgtcggcagaacaccattgtggtgaaggtgccgggccaagaagacagccaccacgaggacggggagagcggctcggaggccagcgactctgtgtccagctgtgggcaggcgggcagtcagagcatcgggagcaacgtcacgctcatcaccctgaactcggaagaggactaccccaatggcacctggctggg

SEQ ID NO: 645 - DNA, 566 bp, Homo sapiens
atttccactggccccttaagagaggcaggagtttaacctggactctctggacccggggctgtttgtggaagggcctcggcatgtccttgggtttagtctggctgcacgtggtgggctccagaataccctgttttgaaccaggtgaccaaaagccagccccactgtgagttgaactctttcgtgttgaccggccactctccgtgctctggatgatgtcggaacacgacctggccgatgtggttcagattgcagtggaagacctgagccctgaccacccagttgttttggagaatcatgtagtgacagatgaagacgaacctgctttgaaacgccagcgactagaaatcaattgccaggatccatctataaagtcattcctgtattccatcaaccagacaatctgcttgcggttggatagcattgaagccaaattgcaagccctggaggctacttgtaaatccttagaagaaaagctggatctggtcacgaacaagcagcacagccccatccaggtccccatggtggccggctcccctctcggggcaacccagacgtgcaacaaagtg

SEQ ID NO: 646 - DNA, 1551 bp, Homo sapiens
agagcggcggcttctctcgcgaggacggacgccattatcgcatctccccgacaaacaccacgagaattccgcagcccacacggtgaccaaaagccagccccactgtgagttgaactctttcgtgttgaccggccactctccgtgctctggatgatgtcggaacacgacctggccgatgtggttcagattgcagtggaagacctgagccctgaccacccagttgttttggagaatcatgtagtgacagatgaagacgaacctgctttgaaacgccagcgactagaaatcaattgccaggatccatctataaagtcattcctgtattccatcaaccagacaatctgcttgcggttggatagcattgaagccaaattgcaagccctggaggctacttgtaaatccttagaagaaaagctggatctggtcacgaacaagcagcacagccccatccaggtccccatggtggccggctcccctctcggggcaacccagacgtgcaacaaagtgcgatgcgctgtgcctgggcgtcggcagaacaccattgtggtgaaggtgccgggccaagaagacagccaccacgaggacggggagagcggctcggaggccagcgactctgtgtccagctgtgggcaggcgggcagtcagagcatcgggagcaacgtcacgctcatcaccctgaactcggaagaggactaccccaatggcacctggctgggcgacgagaacaaccccgagatgcgggtacgctgcgccatcatcccctccgacatgctgcacatcagcaccaactgccgcacggccgagaagatggcgctcacgctgctggactacctcttccaccgcgaggtgcaggctgtgtccaacctctcggggcagggcaagcacgggaagaagcagctggacccgctcaccatctacggcatccggtgtcaccttttctataaatttggcatcacagaatccgactggtaccgaatcaagcagagcatcgactccaagtgccgcacggcgtggcggcgcaagcagcggggccagagcctggcggtcaagagcttctcgcggagaacgcccaactcgtcctcctactgcccttcagagccgatgatgagcaccccacctcctgccagcgagctcccgcagccacagccgcagccgcaggccctgcactacgcgctggccaacgcacagcaggtgcagatccaccagatcggagaagacggacaggtgcaagtaggacacctccacatcgcccaggtgccgcagggggagcaagtccagatcacgcaggacagcgagggcaacctccagatccatcacgtggggcaggacggtcaggtgctgcagggtgcacagctgatcgccgtggcctcctcggaccccgcggcggcgggcgtggatgggtcgccactccagggcagcgacatccaggttcagtacgtgcagctggcgccagtgagtgaccacacggccggggcacagacggccgaagccctgcagcccacgctacagccggagatgcagctcgagcacggggccatccagattcagtga

SEQ ID NO: 647 - DNA, 1648 bp, Homo sapiens
gggcaggtcccacggaggggatgctgcggccaggctccgtggggtggggcaccctgcgacgggctgctcctcttcccagggccaccggtgagactctcagtgcacagagtgcggttctgtgtggaggtgtgggatgcatctcctggccctcccgtagtggggtgcaaccccaagtgaagaccccgtggctcatgtcaagtgccctcagggctggggctgcccacccgcctgcctgggccgtcttgacaccggagctgcctgcctggatgttggagcgcccagtggattgagtgggaagtgggcctgggtgcttacaggcgatggggtcaccagagcccacccaggggcctcgcctgtcccccattctcattccatactctgggaggcggtacaaggtcgggagggccagcggggctctctgccaccaggactcacttccgcccatcttggaactgggcctcactttcctgcgagcttctgctgggttctcagtgcccaccagcagctcctttgctctccctgagcccttgaggtcactctgccttgggaatggggagggtttgggtctcagcctcacgctcacggtcctggcttggattttaggcctcagtggcactctgggagcgcttgtgctcttcatggttgccactgggattttccaggaggctctgtggcatttgctgttgctctctttttctgtggaagctctgccttgcttttttttttttcccttttttctgctctgtaggtgcttgagggcggagttgcagatccagcagagactcgatggcactctctcactggatctgatgcgacttgagagcgatggggagacaggatgtgccgcagagtcctcggtgctgcagggtgcacagctgatcgccgtggcctcctcggaccccgcggcggcgggcgtggatgggtcgccactccagggcagcgacatccaggttcagtacgtgcagctggcgccagtgagtgaccacacggccggggcacagacggccgaagccctgcagcccacgctacagccggagatgcagctcgagcacggggccatccagattcagtgagcggtgcccatggcaccaggagcccctcgccggctccgcctacggcccggcccccacgcgccctgctctcacggcctcggcacaggcagcggctgcacgtgttctgctgaagtgcgtctgaaggccgctgcctccgcggggaacagcatcctatcaactgaaagagcagccgccgccgcccccagccggagacccctttcgtttgagtcctgctgttggtgtcggagcacgaggggaggcacggtgcggagagcgtcgcatatgcgcgggaaatcaagaactatgatatttttctgtttaaacagctttttttaatttgctatggtgtttataacaaaaaagaaaatttgaaaaaaaaaatcccaggggagtagcaggagccctttgctgtgtgctctgtccagtgtcatgagacgggagccctttgctgtgtgctctgtccagtgtcatgagacgggagccctttgctgtgtgctctgtccagtgtcatgagacgggagccctttgctgtgtgctctgtccagtgtcatgagacgggagccctttggatggggccggtgtcagcaaaggaggca

SEQ ID NO: 648 - DNA, 2372 bp, Homo sapiens
agtattcttggggagaaagataacagggaagtgaggagggttcagctgtggaagtgctgggatggctgatccgagtgaccatggcctagacggggtttaaaccctggactgaagaaagtgccggtgaccaaaagccagccccactgtgagttgaactctttcgtgttgaccggccactctccgtgctctggatgatgtcggaacacgacctggccgatgtggttcagattgcagtggaagacctgagccctgaccacccagttgttttggagaatcatgtagtgacagatgaagacgaacctgctttgaaacgccagcgactagaaatcaattgccaggatccatctataaagtcattcctgtattccatcaaccagacaatctgcttgcggttggatagcattgaagccaaattgcaagccctggaggctacttgtaaatccttagaagaaaagctggatctggtcacgaacaagcagcacagccccatccaggtccccatggtggccggctcccctctcggggcaacccagacgtgcaacaaagtgcgatgcgtcgtcccccagactacagtaatactcaacaatgatcggcagaacgccattgtagccaagatggaagaccccttgagcaacagggcaccggattccctggaaaatgtcattagcaacgctgtgcctgggcgtcggcagaacaccattgtggtgaaggtgccgggccaagaagacagccaccacgaggacggggagagcggctcggaggccagcgactctgtgtccagctgtgggcaggcgggcagtcagagcatcgggagcaacgtcacgctcatcaccctgaactcggaagaggactaccccaatggcacctggctgggcgacgagaacaaccccgagatgcgggtacgctgcgccatcatcccctccgacatgctgcacatcagcaccaactgccgcacggccgagaagatggcgctcacgctgctggactacctcttccaccgcgaggtgcaggctgtgtccaacctctcggggcagggcaagcacgggaagaagcagctggacccgctcaccatctacggcatccggtgtcaccttttctataaatttggcatcacagaatccgactggtaccgaatcaagcagagcatcgactccaagtgccgcacggcgtggcggcgcaagcagcggggccagagcctggcggtcaagagcttctcgcggagaacgcccaactcgtcctcctactgcccttcagagccgatgatgagcaccccacctcctgccagcgagctcccgcagccacagccgcagccgcaggccctgcactacgcgctggccaacgcacagcaggtgcagatccaccagatcggagaagacggacaggtgcaagtaatcccacagggacacctccacatcgcccaggtgccgcagggggagcaagtccagatcacgcaggacagcgagggcaacctccagatccatcacgtggggcaggacggtcaggtgctgcagggtgcacagctgatcgccgtggcctcctcggaccccgcggcggcgggcgtggatgggtcgccactccagggcagcgacatccaggttcagtacgtgcagctggcgccagtgagtgaccacacggccggggcacagacggccgaagccctgcagcccacgctacagccggagatgcagctcgagcacggggccatccagattcagtgagcggtgcccatggcaccaggagcccctcgccggctccgcctacggcccggcccccacgcgccctgctctcacggcctcggcacaggcagcggctgcacgtgttctgctgaagtgcgtctgaaggccgctgcctccgcggggaacagcatcctatcaactgaaagagcagccgccgccgcccccagccggagacccctttcgtttgagtcctgctgttggtgtcggagcacgaggggaggcacggtgcggagagcgtcgcatatgcgcgggaaatcaagaactatgatatttttctgtttaaacagctttttttaatttgctatggtgtttataacaaaaaagaaaatttgaaaaaaaaaatcccaggggagtagcaggagccctttgctgtgtgctctgtccagtgtcatgagacgggagccctttgctgtgtgctctgtccagtgtcatgagacgggagccctttgctgtgtgctctgtccagtgtcatgagacgggagccctttgctgtgtgctctgtccagtgtcatgaggcaggtgtttgcaaagccagctctcggttccgatggggtattgctgacctacttttctaggggaaatgctcttaaacactgtaattatgcatttctaatgaaataaaatgtatttatgacc

SEQ ID NO: 649 - DNA, 2201 bp, Homo sapiens
agagcggcggcttctctcgcgaggacggacgccattatcgcatctccccgacaaacaccacgagaattccgcagcccacacggtgaccaaaagccagccccactgtgagttgaactctttcgtgttgaccggccactctccgtgctctggatgatgtcggaacacgacctggccgatgtggttcagattgcagtggaagacctgagccctgaccacccagttgttttggagaatcatgtagtgacagatgaagacgaacctgctttgaaacgccagcgactagaaatcaattgccaggatccatctataaagtcattcctgtattccatcaaccagacaatctgcttgcggttggatagcattgaagccaaattgcaagccctggaggctacttgtaaatccttagaagaaaagctggatctggtcacgaacaagcagcacagccccatccaggtccccatggtggccggctcccctctcggggcaacccagacgtgcaacaaagtgcgatgcgctgtgcctgggcgtcggcagaacaccattgtggtgaaggtgccgggccaagaagacagccaccacgaggacggggagagcggctcggaggccagcgactctgtgtccagctgtgggcaggcgggcagtcagagcatcgggagcaacgtcacgctcatcaccctgaactcggaagaggactaccccaatggcacctggctgggcgacgagaacaaccccgagatgcgggtacgctgcgccatcatcccctccgacatgctgcacatcagcaccaactgccgcacggccgagaagatggcgctcacgctgctggactacctcttccaccgcgaggtgcaggctgtgtccaacctctcggggcagggcaagcacgggaagaagcagctggacccgctcaccatctacggcatccggtgtcaccttttctataaatttggcatcacagaatccgactggtaccgaatcaagcagagcatcgactccaagtgccgcacggcgtggcggcgcaagcagcggggccagagcctggcggtcaagagcttctcgcggagaacgcccaactcgtcctcctactgcccttcagagccgatgatgagcaccccacctcctgccagcgagctcccgcagccacagccgcagccgcaggccctgcactacgcgctggccaacgcacagcaggtgcagatccaccagatcggagaagacggacaggtgcaagtaatcccacagggacacctccacatcgcccaggtgccgcagggggagcaagtccagatcacgcaggacagcgagggcaacctccagatccatcacgtggggcaggacggtcagcttctagaggccacccgcatcccctgcctcctggccccatccgtcttcaaagccagcagtggccaggtgctgcagggtgcacagctgatcgccgtggcctcctcggaccccgcggcggcgggcgtggatgggtcgccactccagggcagcgacatccaggttcagtacgtgcagctggcgccagtgagtgaccacacggccggggcacagacggccgaagccctgcagcccacgctacagccggagatgcagctcgagcacggggccatccagattcagtgagcggtgcccatggcaccaggagcccctcgccggctccgcctacggcccggcccccacgcgccctgctctcacggcctcggcacaggcagcggctgcacgtgttctgctgaagtgcgtctgaaggccgctgcctccgcggggaacagcatcctatcaactgaaagagcagccgccgccgcccccagccggagacccctttcgtttgagtcctgctgttggtgtcggagcacgaggggaggcacggtgcggagagcgtcgcatatgcgcgggaaatcaagaactatgatatttttctgtttaaacagctttttttaatttgctatggtgtttataacaaaaaagaaaatttgaaaaaaaaaatcccaggggagtagcaggagccctttgctgtgtgctctgtccagtgtcatgagacgggagccctttgctgtgtgctctgtccagtgtcatgagacgggagccctttgctgtgtgctctgtccagtgtcatgagacgggagccctttgctgtgtgctctgtccagtgtcatgagacgggagccctttggatggggccggtgtcagcaaaggaggca

SEQ ID NO: 650 - DNA, 3725 bp, Homo sapiens
gaccgcgcgggaccgttaaatttgaaacttggcggctaggggtgtgggcttgaggtggccggtttgttagggagtcgtgtacgtgccttggtcgcttctgtagctccgagggcaggttgcggaagaaagcccaggcggtctgtggcccagaggaaaggcctgcagcaggacgaggacctgagccaggaatgcaggatggcggcggtgaagaaggaagggggtgctctgagtgaagccatgtccctggagggagatgaatgggaactgagtaaagaaaatgtacaacctttaaggcaagggcggatcatgtccacgcttcagggagcactggcacaagaatctgcctgtaacaatactcttcagcagcagaaacgggcatttgaatatgaaattcgattttacactggaaatgaccctctggatgtttgggataggtatatcagctggacagagcagaactatcctcaaggtgggaaggagagtaatatgtcaacgttattagaaagagctgtagaagcactacaaggagaaaaacgatattatagtgatcctcgatttctcaatctctggcttaaattagggcgtttatgcaatgagcctttggatatgtacagttacttgcacaaccaagggattggtgtttcacttgctcagttctatatctcatgggcagaagaatatgaagctagagaaaactttaggaaagcagatgcgatatttcaggaagggattcaacagaaggctgaaccactagaaagactacagtcccagcaccgacaattccaagctcgagtgtctcggcaaactctgttggcacttgagaaagaagaagaggaggaagtttttgagtcttctgtaccacaacgaagcacactagctgaactaaagagcaaagggaaaaagacagcaagagctccaatcatccgtgtaggaggtgctctcaaggctccaagccagaacagaggactccaaaatccatttcctcaacagatgcaaaataatagtagaattactgtttttgatgaaaatgctgatgaggcttctacagcagagttgtctaagcctacagtccagccatggatagcaccccccatgcccagggccaaagagaatgagctgcaagcaggcccttggaacacaggcaggtccttggaacacaggcctcgtggcaatacagcttcactgatagctgtacccgctgtgcttcccagtttcactccatatgtggaagagactgcacgacagccagttatgacaccatgtaaaattgaacctagtataaaccacatcctaagcaccagaaagcctggaaaggaagaaggagatcctctacaaagggttcagagccatcagcaagcgtctgaggagaagaaagagaagatgatgtattgtaaggagaagatttatgcaggagtaggggaattctcctttgaagaaattcgggctgaagttttccggaagaaattaaaagagcaaagggaagccgagctattgaccagtgcagagaagagagcagaaatgcagaaacagattgaagagatggagaagaagctaaaagaaatccaaactactcagcaagaaagaacaggtgatcagcaagaagagacgatgcctacaaaggagacaactaaactgcaaattgcttccgagtctcagaaaataccaggaatgactctatccagttctgtttgtcaagtaaactgttgtgccagagaaacttcacttgcggagaacatttggcaggaacaacctcattctaaaggtcccagtgtacctttctccatttttgatgagtttcttctttcagaaaagaagaataaaagtcctcctgcagatcccccacgagttttagctcaacgaagaccccttgcagttctcaaaacctcagaaagcatcacctcaaatgaagatgtgtctccagatgtttgtgatgaatttacaggaattgaacccttgagcgaggatgccattatcacaggcttcagaaatgtaacaatttgtcctaacccagaagacacttgtgactttgccagagcagctcgttttgtatccactccttttcatgagataatgtccttgaaggatctcccttctgatcctgagagactgttaccggaagaagatctagatgtaaagacctctgaggaccagcagacagcttgtggcactatctacagtcagactctcagcatcaagaagctgagcccaattattgaagacagtcgtgaagccacacactcctctggcttctctggttcttctgcctcggttgcaagcacctcctccatcaaatgtcttcaaattcctgagaaactagaacttactaatgagacttcagaaaaccctactcagtcaccatggtgttcacagtatcgcagacagctactgaagtccctaccagagttaagtgcctctgcagagttgtgtatagaagacagaccaatgcctaagttggaaattgagaaggaaattgaattaggtaatgaggattactgcattaaacgagaatacctaatatgtgaagattacaagttattctgggtggcgccaagaaactctgcagaattaacagtaataaaggtatcttctcaacctgtcccatgggacttttatatcaacctcaagttaaaggaacgtttaaatgaagattttgatcatttttgcagctgttatcaatatcaagatggctgtattgtttggcaccaatatataaactgcttcacccttcaggatcttctccaacacagtgaatatattacccatgaaataacagtgttgattatttataaccttttgacaatagtggagatgctacacaaagcagaaatagtccatggtgacttgagtccaaggtgtctgattctcagaaacagaatccacgatccctatgattgtaacaagaacaatcaagctttgaagatagtggacttttcctacagtgttgaccttagggtgcagctggatgtttttaccctcagcggctttcggactgtacagatcctggaaggacaaaagatcctggctaactgttcttctccctaccaggtagacctgtttggtatagcagatttagcacatttactattgttcaaggaacacctacaggtcttctgggatgggtccttctggaaacttagccaaaatatttctgagctaaaagatggtgaattgtggaataaattctttgtgcggattctgaatgccaatgatgaggccacagtgtctgttcttggggagcttgcagcagaaatgaatggggtttttgacactacattccaaagtcacctgaacaaagccttatggaaggtagggaagttaactagtcctggggctttgctctttcagtgagctaggcaatcaagtctcacagattgctgcctcagagcaatggttgtattgtggaacactgaaactgtatgtgctgtaatttaatttaggacacatttagatgcactaccattgctgttctactttttggtacaggtatattttgacgtcactgatattttttatacagtgatatacttactcatggccttgtctaacttttgtgaagaactattttattctaaacagactcattacaaatggttaccttgttatttaacccatttgtctctacttttccctgtacttttcccatttgtaatttgtaaaatgttctcttatgatcaccatgtattttgtaaataataaaatagtatctgttaaatttgtgcttctaa

SEQ ID NO: 651 - DNA, 3628 bp, Homo sapiens
gtgtgggcttgaggtggccggtttgttagggagtcgtgtacgtgccttggtcgcttctgtagctccgagggcaggttgcggaagaaagcccaggcggtctgtggcccagaggaaaggcctgcagcaggacgaggacctgagccaggaatgcaggatggcggcggtgaagaaggaagggggtgctctgagtgaagccatgtccctggagggagatgaatgggaactgagtaaagaaaatgtacaacctttaaggcaagggcggatcatgtccacgcttcagggagcactggcacaagaatctgcctgtaacaatactcttcagcagcagaaacgggcatttgaatatgaaattcgattttacactggaaatgaccctctggatgtttgggataggtgggtctttttatttcacaaggacaatagaaacattaacaggtatatcagctggacagagcagaactatcctcaaggtgggaaggagagtaatatgtcaacgttattagaaagagctgtagaagcactacaaggagaaaaacgatattatagtgatcctcgatttctcaatctctggcttaaattagggcgtttatgcaatgagcctttggatatgtacagttacttgcacaaccaagggattggtgtttcacttgctcagttctatatctcatgggcagaagaatatgaagctagagaaaactttaggaaagcagatgcgatatttcaggaagggattcaacagaaggctgaaccactagaaagactacagtcccagcaccgacaattccaagctcgagtgtctcggcaaactctgttggcacttgagaaagaagaagaggaggaagtttttgagtcttctgtaccacaacgaagcacactagctgaactaaagagcaaagggaaaaagacagcaagagctccaatcatccgtgtaggaggtgctctcaaggctccaagccagaacagaggactccaaaatccatttcctcaacagatgcaaaataatagtagaattactgtttttgatgaaaatgctgatgaggcttctacagcagagttgtctaagcctacagtccagccatggatagcaccccccatgcccagggccaaagagaatgagctgcaagcaggcccttggaacacaggcaggtccttggaacacaggcctcgtggcaatacagcttcactgatagctgtacccgctgtgcttcccagtttcactccatatgtggaagagactgcacgacagccagttatgacaccatgtaaaattgaacctagtataaaccacatcctaagcaccagaaagcctggaaaggaagaaggagatcctctacaaagggttcagagccatcagcaagcgtctgaggagaagaaagagaagatgatgtattgtaaggagaagatttatgcaggagtaggggaattctcctttgaagaaattcgggctgaagttttccggaagaaattaaaagagcaaagggaagccgagctattgaccagtgcagagaagagagcagaaatgcagaaacagattgaagagatggagaagaagctaaaagaaatccaaactactcagcaagaaagaacaggtgatcagcaagaagagacgatgcctacaaaggagacaactaaactgcaaattgcttccgagtctcagaaaataccaggaatgactctatccagttctgtttgtcaagtaaactgttgtgccagagaaacttcacttgcggagaacatttggcaggaacaacctcattctaaaggtcccagtgtacctttctccatttttgatgagtttcttctttcagaaaagaagaataaaagtcctcctgcagatcccccacgagttttagctcaacgaagaccccttgcagttctcaaaacctcagaaagcatcacctcaaatgaagatgtgtctccagatgtttgtgatgaatttacaggaattgaacccttgagcgaggatgccattatcacaggcttcagaaatgtaacaatttgtcctaacccagaagacacttgtgactttgccagagcagctcgttttgtatccactccttttcatgagataatgtccttgaaggatctcccttctgatcctgagagactgttaccggaagaagatctagatgtaaagacctctgaggaccagcagacagcttgtggcactatctacagtcagactctcagcatcaagaagctgagcccaattattgaagacagtcgtgaagccacacactcctctggcttctctggttcttctgcctcggttgcaagcacctcctccatcaaatgtcttcaaattcctgagaaactagaacttactaatgagacttcagaaaaccctactcagtcaccatggtgttcacagtatcgcagacagctactgaagtccctaccagagttaagtgcctctgcagagttgtgtatagaagacagaccaatgcctaagttggaaattgagaaggaaattgaattaggtaatgaggattactgcattaaacgagaatacctaatatgtgaagattacaagttattctgggtggcgccaagaaactctgcagaattaacagtaataaaggtatcttctcaacctgtcccatgggacttttatatcaacctcaagttaaaggaacgtttaaatgaagattttgatcatttttgcagctgttatcaatatcaagatggctgtattgtttggcaccaatatataaactgcttcacccttcaggatcttctccaacacagtgaatatattacccatgaaataacagtgttgattatttataaccttttgacaatagtggagatgctacacaaagcagaaatagtccatggtgacttgagtccaaggtgtctgattctcagaaacagaatccacgatccctatgattgtaacaagaacaatcaagctttgaagatagtggacttttcctacagtgttgaccttagggtgcagctggatgtttttaccctcagcggctttcggactgtacagatcctggaaggacaaaagatcctggctaactgttcttctccctaccaggtagacctgtttggtatagcagatttagcacatttactattgttcaaggaacacctacaggtcttctgggatgggtccttctggaaacttagccaaaatatttctgagctaaaagatggtgaattgtggaataaattctttgtgcggattctgaatgccaatgatgaggccacagtgtctgttcttggggagcttgcagcagaaatgaatggggtttttgacactacattccaaagtcacctgaacaaagccttatggaaggtagggaagttaactagtcctggggctttgctctttcagtgagctaggcaatcaagtctcacagattgctgcctcagagcaatggttgtattgtggaacactgaaactgtatgtgctgtaatttaatttaggacacatttagatgcactaccattgctgttctactttttggtacaggtatattttgacgtcactgatattttttatacagtgatatacttactcatggccttgtctaacttttgtgaagaactattttattctaaacagactcattacaaatggttaccttgttatttaacccatttgtctctacttttc

SEQ ID NO: 652 - DNA, 3347 bp, Homo sapiens
accgttaaatttgaaacttggcggctaggggtgtgggcttgaggtggccggtttgttagggagtcgtgtacgtgccttggtcgcttctgtagctccgagggcaggttgcggaagaaagcccaggcggtctgtggcccagaggaaaggcctgcagcaggacgaggacctgagccaggaatgcaggatggcggcggtgaagaaggaagggggtgctctgagtgaagccatgtccctggagggagatgaatgggaactgagtaaagaaaatgtacaacctttaaggcaagggcggatcatgtccacgcttcagggagcactggcacaagaatctgcctgtaacaatactcttcagcagcagaaacgggcatttgaatatgaaattcgattttacactggaaatgaccctctggatgtttgggataggtatatcagctggacagagcagaactatcctcaaggtgggaaggagagtaatatgtcaacgttattagaaagagctgtagaagcactacaaggagaaaacttctggaaagcagatgcgatatttcaggaagggattcaacagaaggctgaaccactagaaagactacagtcccagcaccgacaattccaagctcgagtgtctcggcaaactctgttggcacttgagaaagaagaagaggaggaagtttttgagtcttctgtaccacaacgaagcacactagctgaactaaagagcaaagggaaaaagacagcaagagctccaatcatccgtgtaggaggtgctctcaaggctccaagccagaacagaggactccaaaatccatttcctcaacagatgcaaaataatagtagaattactgtttttgatgaaaatgctgatgaggcttctacagcagagttgtctaagcctacagtccagccatggatagcaccccccatgcccagggccaaagagaatgagctgcaagcaggcccttggaacacaggcaggtccttggaacacaggcctcgtggcaatacagcttcactgatagctgtacccgctgtgcttcccagtttcactccatatgtggaagagactgcacgacagccagttatgacaccatgtaaaattgaacctagtataaaccacatcctaagcaccagaaagcctggaaaggaagaaggagatcctctacaaagggttcagagccatcagcaagcgtctgaggagaagaaagagaagatgatgtattgtaaggagaagatttatgcaggagtaggggaattctcctttgaagaaattcgggctgaagttttccggaagaaattaaaagagcaaagggaagccgagctattgaccagtgcagagaagagagcagaaatgcagaaacagattgaagagatggagaagaagctaaaagaaatccaaactactcagcaagaaagaacaggtgatcagcaagaagagacgatgcctacaaaggagacaactaaactgcaaattgcttccgagtctcagaaaataccaggaatgactctatccagttctgtttgtcaagtaaactgttgtgccagagaaacttcacttgcggagaacatttggcaggaacaacctcattctaaagtctctctttctctaggtcccagtgtacctttctccatttttgatgagtttcttctttcagaaaagaagaataaaagtcctcctgcagatcccccacgagttttagctcaacgaagaccccttgcagttctcaaaacctcagaaagcatcacctcaaatgaagatgtgtctccagatgtttgtgatgaatttacaggaattgaacccttgagcgaggatgccattatcacaggcttcagaaatgtaacaatttgtcctaacccagaagacactcgtgaagccacacactcctctggcttctctggttcttctgcctcggttgcaagcacctcctccatcaaatgtcttcaaattcctgagaaactagaacttactaatgagacttcagaaaaccctactcagtcaccatggtgttcacagtatcgcagacagctactgaagtccctaccagagttaagtgcctctgcagagttgtgtatagaagacagaccaatgcctaagttggaaattgagaaggaaattgaattaggtaatgaggattactgcattaaacgagaatacctaatatgtgaagattacaagttattctgggtggcgccaagaaactctgcagaattaacagtaataaaggtatcttctcaacctgtcccatgggacttttatatcaacctcaagttaaaggaacgtttaaatgaagattttgatcatttttgcagctgttatcaatatcaagatggctgtattgtttggcaccaatatataaactgcttcacccttcaggatcttctccaacacagtgaatatattacccatgaaataacagtgttgattatttataaccttttgacaatagtggagatgctacacaaagcagaaatagtccatggtgacttgagtccaaggtgtctgattctcagaaacagaatccacgatccctatgattgtaacaagaacaatcaagctttgaagatagtggacttttcctacagtgttgaccttagggtgcagctggatgtttttaccctcagcggctttcggactgtacagatcctggaaggacaaaagatcctggctaactgttcttctccctaccaggtagacctgtttggtatagcagatttagcacatttactattgttcaaggaacacctacaggtcttctgggatgggtccttctggaaacttagccaaaatatttctgagctaaaagatggtgaattgtggaataaattctttgtgcggattctgaatgccaatgatgaggccacagtgtctgttcttggggagcttgcagcagaaatgaatggggtttttgacactacattccaaagtcacctgaacaaagccttatggaaggtagggaagttaactagtcctggggctttgctctttcagtgagctaggcaatcaagtctcacagattgctgcctcagagcaatggttgtattgtggaacactgaaactgtatgtgctgtaatttaatttaggacacatttagatgcactaccattgctgttctactttttggtacaggtatattttgacgtcactgatattttttatacagtgatatacttactcatggccttgtctaacttttgtgaagaactattttattctaaacagactcattacaaatggttaccttgttatttaacccatttgtctctacttttccctgtacttttcccatttgtaatttgtaaaatgttctcttatgatcaccatgtattttgtaaataataaaatagtatctgtt

SEQ ID NO: 653 - DNA, 5766 bp, Homo sapiens
ggccttccccctgcgaggatcgccattggcccgggttggctttggaaagcggcggtggctttgggccgggctcggcctcgggaacgccaggggcccctgggtgcggacgggcgcggccaggagggggttaaggcgcaggcggcggcggggcgggggcgggcctggcgggcgccctctccgggccctttgttaacaggcgcgtcccggccaggcggagacgcggccgcggccatgggcgggcgcgggcgcgcggggcggcggtgagggcggctggcggggccgggggcgccgggggggcgcgcgggccgagccgggcctgagccgggcccgcggaccgagctgggagaggggttccggcccccgacgtgctggcgcgggaaaatgttggagatctgcctgaagctggtgggctgcaaatccaagaaggggctgtcctcgtcctccagctgttatctggaagaagcccttcagcggccagtagcatctgactttgagcctcagggtctgagtgaagccgctcgttggaactccaaggaaaaccttctcgctggacccagtgaaaatgaccccaaccttttcgttgcactgtatgattttgtggccagtggagataacactctaagcataactaaaggtgaaaagctccgggtcttaggctataatcacaatggggaatggtgtgaagcccaaaccaaaaatggccaaggctgggtcccaagcaactacatcacgccagtcaacagtctggagaaacactcctggtaccatgggcctgtgtcccgcaatgccgctgagtatctgctgagcagcgggatcaatggcagcttcttggtgcgtgagagtgagagcagtcctggccagaggtccatctcgctgagatacgaagggagggtgtaccattacaggatcaacactgcttctgatggcaagctctacgtctcctccgagagccgcttcaacaccctggccgagttggttcatcatcattcaacggtggccgacgggctcatcaccacgctccattatccagccccaaagcgcaacaagcccactgtctatggtgtgtcccccaactacgacaagtgggagatggaacgcacggacatcaccatgaagcacaagctgggcgggggccagtacggggaggtgtacgagggcgtgtggaagaaatacagcctgacggtggccgtgaagaccttgaaggaggacaccatggaggtggaagagttcttgaaagaagctgcagtcatgaaagagatcaaacaccctaacctggtgcagctccttggggtctgcacccgggagcccccgttctatatcatcactgagttcatgacctacgggaacctcctggactacctgagggagtgcaaccggcaggaggtgaacgccgtggtgctgctgtacatggccactcagatctcgtcagccatggagtacctggagaagaaaaacttcatccacagagatcttgctgcccgaaactgcctggtaggggagaaccacttggtgaaggtagctgattttggcctgagcaggttgatgacaggggacacctacacagcccatgctggagccaagttccccatcaaatggactgcacccgagagcctggcctacaacaagttctccatcaagtccgacgtctgggcatttggagtattgctttgggaaattgctacctatggcatgtccccttacccgggaattgacctgtcccaggtgtatgagctgctagagaaggactaccgcatggagcgcccagaaggctgcccagagaaggtctatgaactcatgcgagcatgttggcagtggaatccctctgaccggccctcctttgctgaaatccaccaagcctttgaaacaatgttccaggaatccagtatctcagacgaagtggaaaaggagctggggaaacaaggcgtccgtggggctgtgagtaccttgctgcaggccccagagctgcccaccaagacgaggacctccaggagagctgcagagcacagagacaccactgacgtgcctgagatgcctcactccaagggccagggagagagcgatcctctggaccatgagcctgccgtgtctccattgctccctcgaaaagagcgaggtcccccggagggcggcctgaatgaagatgagcgccttctccccaaagacaaaaagaccaacttgttcagcgccttgatcaagaagaagaagaagacagccccaacccctcccaaacgcagcagctccttccgggagatggacggccagccggagcgcagaggggccggcgaggaagagggccgagacatcagcaacggggcactggctttcacccccttggacacagctgacccagccaagtccccaaagcccagcaatggggctggggtccccaatggagccctccgggagtccgggggctcaggcttccggtctccccacctgtggaagaagtccagcacgctgaccagcagccgcctagccaccggcgaggaggagggcggtggcagctccagcaagcgcttcctgcgctcttgctccgcctcctgcgttccccatggggccaaggacacggagtggaggtcagtcacgctgcctcgggacttgcagtccacgggaagacagtttgactcgtccacatttggagggcacaaaagtgagaagccggctctgcctcggaagagggcaggggagaacaggtctgaccaggtgacccgaggcacagtaacgcctccccccaggctggtgaaaaagaatgaggaagctgctgatgaggtcttcaaagacatcatggagtccagcccgggctccagcccgcccaacctgactccaaaacccctccggcggcaggtcaccgtggcccctgcctcgggcctcccccacaaggaagaagctggaaagggcagtgccttagggacccctgctgcagctgagccagtgacccccaccagcaaagcaggctcaggtgcaccagggggcaccagcaagggccccgccgaggagtccagagtgaggaggcacaagcactcctctgagtcgccagggagggacaaggggaaattgtccaggctcaaacctgccccgccgcccccaccagcagcctctgcagggaaggctggaggaaagccctcgcagagcccgagccaggaggcggccggggaggcagtcctgggcgcaaagacaaaagccacgagtctggttgatgctgtgaacagtgacgctgccaagcccagccagccgggagagggcctcaaaaagcccgtgctcccggccactccaaagccacagtccgccaagccgtcggggacccccatcagcccagcccccgttccctccacgttgccatcagcatcctcggccctggcaggggaccagccgtcttccaccgccttcatccctctcatatcaacccgagtgtctcttcggaaaacccgccagcctccagagcggatcgccagcggcgccatcaccaagggcgtggtcctggacagcaccgaggcgctgtgcctcgccatctctaggaactccgagcagatggccagccacagcgcagtgctggaggccggcaaaaacctctacacgttctgcgtgagctatgtggattccatccagcaaatgaggaacaagtttgccttccgagaggccatcaacaaactggagaataatctccgggagcttcagatctgcccggcgacagcaggcagtggtccagcggccactcaggacttcagcaagctcctcagttcggtgaaggaaatcagtgacatagtgcagaggtagcagcagtcaggggtcaggtgtcaggcccgtcggagctgcctgcagcacatgcgggctcgcccatacccgtgacagtggctgacaagggactagtgagtcagcaccttggcccaggagctctgcgccaggcagagctgagggccctgtggagtccagctctactacctacgtttgcaccgcctgccctcccgcaccttcctcctccccgctccgtctctgtcctcgaattttatctgtggagttcctgctccgtggactgcagtcggcatgccaggacccgccagccccgctcccacctagtgccccagactgagctctccaggccaggtgggaacggctgatgtggactgtctttttcatttttttctctctggagcccctcctcccccggctgggcctccttcttccacttctccaagaatggaagcctgaactgaggccttgtgtgtcaggccctctgcctgcactccctggccttgcccgtcgtgtgctgaagacatgtttcaagaaccgcatttcgggaagggcatgcacgggcatgcacacggctggtcactctgccctctgctgctgcccggggtggggtgcactcgccatttcctcacgtgcaggacagctcttgatttgggtggaaaacagggtgctaaagccaaccagcctttgggtcctgggcaggtgggagctgaaaaggatcgaggcatggggcatgtcctttccatctgtccacatccccagagcccagctcttgctctcttgtgacgtgcactgtgaatcctggcaagaaagcttgagtctcaagggtggcaggtcactgtcactgccgacatccctcccccagcagaatggaggcaggggacaagggaggcagtggctagtggggtgaacagctggtgccaaatagccccagactgggcccaggcaggtctgcaagggcccagagtgaaccgtcctttcacacatctgggtgccctgaaagggcccttcccctcccccactcctctaagacaaagtagattcttacaaggccctttcctttggaacaagacagccttcacttttctgagttcttgaagcatttcaaagccctgcctctgtgtagccgccctgagagagaatagagctgccactgggcacctgcgcacaggtgggaggaaagggcctggccagtcctggtcctggctgcactcttgaactgggcgaatgtcttatttaattaccgtgagtgacatagcctcatgttctgtgggggtcatcagggagggttaggaaaaccacaaacggagcccctgaaagcctcacgtatttcacagagcacgcctgccatcttctccccgaggctgccccaggccggagcccagatacgggggctgtgactctgggcagggacccggggtctcctggaccttgacagagcagctaactccgagagcagtgggcaggtggccgcccctgaggcttcacgccgggagaagccaccttcccaccccttcataccgcctcgtgccagcagcctcgcacaggccctagctttacgctcatcacctaaacttgtactttatttttctgatagaaatggtttcctctggatcgttttatgcggttcttacagcacatcacctctttgcccccgacggctgtgacgcagccggagggaggcactagtcaccgacagcggccttgaagacagagcaaagcgcccacccaggtcccccgactgcctgtctccatgaggtactggtcccttccttttgttaacgtgatgtgccactatattttacacgtatctcttggtatgcatcttttatagacgctcttttctaagtggcgtgtgcatagcgtcctgccctgccccctcgggggcctgtggtggctccccctctgcttctcggggtccagtgcattttgtttctgtatatgattctctgtggttttttttgaatccaaatctgtcctctgtagtattttttaaataaatcagtgtttacattagaa

SEQ ID NO: 654 - DNA, 3824 bp, Homo sapiens
tgtgagaattgaaatgactagcattattgacccttttcagcatcccctgtgaatatttctgtttaggtttttcttcttgaaaagaaattgttattcagcccgtttaaaacaaatcaagaaacttttgggtaacattgcaattacatgaaattgataaccgcgaaaataattggaactcctgcttgcaagtgtcaacctaaaaaaagtgcttccttttgttatggaagatgtctttctgtgattgacttcaattgctgacttgtggagatgcagcgaatgtgaaatcccacgtatatgccatttccctctacgctcgctgaccgttctggaagatcttgaaccctcttctggaaaggggtacctattattactttatggggcagcagcctggaaaagtacttggggaccaaagaaggccaagcttgcctgccctgcattttatcaaaggagcagggaagaaggaatcatcgaggcatgggggtccacactgcaatgtttttgtggaacatgaagcccttcagcggccagtagcatctgactttgagcctcagggtctgagtgaagccgctcgttggaactccaaggaaaaccttctcgctggacccagtgaaaatgaccccaaccttttcgttgcactgtatgattttgtggccagtggagataacactctaagcataactaaaggtgaaaagctccgggtcttaggctataatcacaatggggaatggtgtgaagcccaaaccaaaaatggccaaggctgggtcccaagcaactacatcacgccagtcaacagtctggagaaacactcctggtaccatgggcctgtgtcccgcaatgccgctgagtatctgctgagcagcgggatcaatggcagcttcttggtgcgtgagagtgagagcagtcctggccagaggtccatctcgctgagatacgaagggagggtgtaccattacaggatcaacactgcttctgatggcaagctctacgtctcctccgagagccgcttcaacaccctggccgagttggttcatcatcattcaacggtggccgacgggctcatcaccacgctccattatccagccccaaagcgcaacaagcccactgtctatggtgtgtcccccaactacgacaagtgggagatggaacgcacggacatcaccatgaagcacaagctgggcgggggccagtacggggaggtgtacgagggcgtgtggaagaaatacagcctgacggtggccgtgaagaccttgaaggaggacaccatggaggtggaagagttcttgaaagaagctgcagtcatgaaagagatcaaacaccctaacctggtgcagctccttggggtctgcacccgggagcccccgttctatatcatcactgagttcatgacctacgggaacctcctggactacctgagggagtgcaaccggcaggaggtgaacgccgtggtgctgctgtacatggccactcagatctcgtcagccatggagtacctggagaagaaaaacttcatccacagagatcttgctgcccgaaactgcctggtaggggagaaccacttggtgaaggtagctgattttggcctgagcaggttgatgacaggggacacctacacagcccatgctggagccaagttccccatcaaatggactgcacccgagagcctggcctacaacaagttctccatcaagtccgacgtctgggcatttggagtattgctttgggaaattgctacctatggcatgtccccttacccgggaattgacctgtcccaggtgtatgagctgctagagaaggactaccgcatggagcgcccagaaggctgcccagagaaggtctatgaactcatgcgagcatgttggcagtggaatccctctgaccggccctcctttgctgaaatccaccaagcctttgaaacaatgttccaggaatccagtatctcagacgaagtggaaaaggagctggggaaacaaggcgtccgtggggctgtgagtaccttgctgcaggccccagagctgcccaccaagacgaggacctccaggagagctgcagagcacagagacaccactgacgtgcctgagatgcctcactccaagggccagggagagagcgatcctctggaccatgagcctgccgtgtctccattgctccctcgaaaagagcgaggtcccccggagggcggcctgaatgaagatgagcgccttctccccaaagacaaaaagaccaacttgttcagcgccttgatcaagaagaagaagaagacagccccaacccctcccaaacgcagcagctccttccgggagatggacggccagccggagcgcagaggggccggcgaggaagagggccgagacatcagcaacggggcactggctttcacccccttggacacagctgacccagccaagtccccaaagcccagcaatggggctggggtccccaatggagccctccgggagtccgggggctcaggcttccggtctccccacctgtggaagaagtccagcacgctgaccagcagccgcctagccaccggcgaggaggagggcggtggcagctccagcaagcgcttcctgcgctcttgctccgcctcctgcgttccccatggggccaaggacacggagtggaggtcagtcacgctgcctcgggacttgcagtccacgggaagacagtttgactcgtccacatttggagggcacaaaagtgagaagccggctctgcctcggaagagggcaggggagaacaggtctgaccaggtgacccgaggcacagtaacgcctccccccaggctggtgaaaaagaatgaggaagctgctgatgaggtcttcaaagacatcatggagtccagcccgggctccagcccgcccaacctgactccaaaacccctccggcggcaggtcaccgtggcccctgcctcgggcctcccccacaaggaagaagctggaaagggcagtgccttagggacccctgctgcagctgagccagtgacccccaccagcaaagcaggctcaggtgcaccagggggcaccagcaagggccccgccgaggagtccagagtgaggaggcacaagcactcctctgagtcgccagggagggacaaggggaaattgtccaggctcaaacctgccccgccgcccccaccagcagcctctgcagggaaggctggaggaaagccctcgcagagcccgagccaggaggcggccggggaggcagtcctgggcgcaaagacaaaagccacgagtctggttgatgctgtgaacagtgacgctgccaagcccagccagccgggagagggcctcaaaaagcccgtgctcccggccactccaaagccacagtccgccaagccgtcggggacccccatcagcccagcccccgttccctccacgttgccatcagcatcctcggccctggcaggggaccagccgtcttccaccgccttcatccctctcatatcaacccgagtgtctcttcggaaaacccgccagcctccagagcggatcgccagcggcgccatcaccaagggcgtggtcctggacagcaccgaggcgctgtgcctcgccatctctaggaactccgagcagatggccagccacagcgcagtgctggaggccggcaaaaacctctacacgttctgcgtgagctatgtggattccatccagcaaatgaggaacaagtttgccttccgagaggccatcaacaaactggagaataatctccgggagcttcagatctgcccggcgacagcaggcagtggtccagcggccactcaggacttcagcaagctcctcagttcggtgaaggaaatcagtgacatagtgcagaggtag

SEQ ID NO: 655 - DNA, 532 bp, Homo sapiens
tttcagcatcccctgtgaatatttctgtttaggtttttcttcttgaaaagaaattgttattcagcccgtttaaaacaaatcaagaaacttttgggtaacattgcaattacatgaaattgataaccgcgaaaataattggaactcctgcttgcaagtgtcaacctaaaaaaagtgcttccttttgttatggaagatgtctttctgtgattgacttcaattgctgacttgtggagatgcagcgaatgtgaaatcccacgtatatgccatttccctctacgctcgctgaccgttctggaagatcttgaaccctcttctggaaaggggtacctattattactttatggggcagcagcctggaaaagtacttggggaccaaagaaggccaagcttgcctgccctgcattttatcaaaggagcagggaagaaggaatcatcgaggcatgggggtccacactgcaatgtttttgtggaacaagcccttcagcggccagtagcatctgactttgagcctcagggtctgagtgaagccgct

SEQ ID NO: 656 - DNA, 3559 bp, Homo sapiens
ggcagacctgggcgttctcgggcgcggggcggcggtgagggcggctggcggggcggggggcgcgcgggccgagccgggcctgagccgggcccgcgagctgggagaggggttccggcccccgactgctggcgcgggaaaatgttggagatctgcctgaagctggtgggctgcaaatccaagaaggggctgtcctcgtcctccagctgttatctggaagaagcccttcagcggccagtagcatctgactttgagcctcagggtctgagtgaagccgctcgttggaactccaaggaaaaccttctcgctggacccagtgaaaatgaccccaaccttttcgttgcactgtatgattttgtggccagtggagataacactctaagcataactaaaggtgaaaagctccgggtcttaggctataatcacaatggggaatggtgtgaagcccaaaccaaaaatggccaaggctgggtcccaagcaactacatcacgccagtcaacagtctggagaaacactcctggtaccatgggcctgtgtcccgcaatgccgctgagtatctgctgagcagcgggatcaatggcagcttcttggtgcgtgagagtgagagcagtcctggccagaggtccatctcgctgagatacgaagggagggtgtaccattacaggatcaacactgcttctgatggcaagctctacgtctcctccgagagccgcttcaacaccctggccgagttggttcatcatcattcaacggtggccgacgggctcatcaccacgctccattatccagccccaaagcgcaacaagcccactgtctatggtgtgtcccccaactacgacaagtgggagatggaacgcacggacatcaccatgaagcacaagctgggcgggggccagtacggggaggtgtacgagggcgtgtggaagaaatacagcctgacggtggccgtgaagaccttgaaggaggacaccatggaggtggaagagttcttgaaagaagctgcagtcatgaaagagatcaaacaccctaacctggtgcagctccttggggtctgcacccgggagcccccgttctatatcatcactgagttcatgacctacgggaacctcctggactacctgagggagtgcaaccggcaggaggtgaacgccgtggtgctgctgtacatggccactcagatctcgtcagccatggagtacctggagaagaaaaacttcatccacagagatcttgctgcccgaaactgcctggtaggggagaaccacttggtgaaggtagctgattttggcctgagcaggttgatgacaggggacacctacacagcccatgctggagccaagttccccatcaaatggactgcacccgagagcctggcctacaacaagttctccatcaagtccgacgtctgggcatttggagtattgctttgggaaattgctacctatggcatgtccccttacccgggaattgacctgtcccaggtgtatgagctgctagagaaggactaccgcatggagcgcccagaaggctgcccagagaaggtctatgaactcatgcgagcatgttggcagtggaatccctctgaccggccctcctttgctgaaatccaccaagcctttgaaacaatgttccaggaatccagtatctcagacgaagtggaaaaggagctggggaaacaaggcgtccgtggggctgtgagtaccttgctgcaggccccagagctgcccaccaagacgaggacctccaggagagctgcagagcacagagacaccactgacgtgcctgagatgcctcactccaagggccagggagagagcgatcctctggaccatgagcctgccgtgtctccattgctccctcgaaaagagcgaggtcccccggagggcggcctgaatgaagatgagcgccttctccccaaagacaaaaagaccaacttgttcagcgccttgatcaagaagaagaagaagacagccccaacccctcccaaacgcagcagctccttccgggagatggacggccagccggagcgcagaggggccggcgaggaagagggccgagacatcagcaacggggcactggctttcacccccttggacacagctgacccagccaagtccccaaagcccagcaatggggctggggtccccaatggagccctccgggagtccgggggctcaggcttccggtctccccacctgtggaagaagtccagcacgctgaccagcagccgcctagccaccggcgaggaggagggcggtggcagctccagcaagcgcttcctgcgctcttgctccgcctcctgcgttccccatggggccaaggacacggagtggaggtcagtcacgctgcctcgggacttgcagtccacgggaagacagtttgactcgtccacatttggagggcacaaaagtgagaagccggctctgcctcggaagagggcaggggagaacaggtctgaccaggtgacccgaggcacagtaacgcctccccccaggctggtgaaaaagaatgaggaagctgctgatgaggtcttcaaagacatcatggagtccagcccgggctccagcccgcccaacctgactccaaaacccctccggcggcaggtcaccgtggcccctgcctcgggcctcccccacaaggaagaagctggaaagggcagtgccttagggacccctgctgcagctgagccagtgacccccaccagcaaagcaggctcaggtgcaccagggggcaccagcaagggccccgccgaggagtccagagtgaggaggcacaagcactcctctgagtcgccagggagggacaaggggaaattgtccaggctcaaacctgccccgccgcccccaccagcagcctctgcagggaaggctggaggaaagccctcgcagagcccgagccaggaggcggccggggaggcagtcctgggcgcaaagacaaaagccacgagtctggttgatgctgtgaacagtgacgctgccaagcccagccagccgggagagggcctcaaaaagcccgtgctcccggccactccaaagccacagtccgccaagccgtcggggacccccatcagcccagcccccgttccctccacgttgccatcagcatcctcggccctggcaggggaccagccgtcttccaccgccttcatccctctcatatcaacccgagtgtctcttcggaaaacccgccagcctccagagcggatcgccagcggcgccatcaccaagggcgtggtcctggacagcaccgaggcgctgtgcctcgccatctctaggaactccgagcagatggccagccacagcgcagtgctggaggccggcaaaaacctctacacgttctgcgtgagctatgtggattccatccagcaaatgaggaacaagtttgccttccgagaggccatcaacaaactggagaataatctccgggagcttcagatctgcccggcgacagcaggcagtggtccagcggccactcaggacttcagcaagctcctcagttcggtgaaggaaatcagtgacatagtgcagaggtagcagcagtcaggggtcaggtgtcaggccc

SEQ ID NO: 657 - DNA, 5877 bp, Homo sapiens
ggttggtgacttccacaggaaaagttctggaggagtagccaaagaccatcagcgtttcctttatgtgtgagaattgaaatgactagcattattgacccttttcagcatcccctgtgaatatttctgtttaggtttttcttcttgaaaagaaattgttattcagcccgtttaaaacaaatcaagaaacttttgggtaacattgcaattacatgaaattgataaccgcgaaaataattggaactcctgcttgcaagtgtcaacctaaaaaaagtgcttccttttgttatggaagatgtctttctgtgattgacttcaattgctgacttgtggagatgcagcgaatgtgaaatcccacgtatatgccatttccctctacgctcgctgaccgttctggaagatcttgaaccctcttctggaaaggggtacctattattactttatggggcagcagcctggaaaagtacttggggaccaaagaaggccaagcttgcctgccctgcattttatcaaaggagcagggaagaaggaatcatcgaggcatgggggtccacactgcaatgtttttgtggaacatgaagcccttcagcggccagtagcatctgactttgagcctcagggtctgagtgaagccgctcgttggaactccaaggaaaaccttctcgctggacccagtgaaaatgaccccaaccttttcgttgcactgtatgattttgtggccagtggagataacactctaagcataactaaaggtgaaaagctccgggtcttaggctataatcacaatggggaatggtgtgaagcccaaaccaaaaatggccaaggctgggtcccaagcaactacatcacgccagtcaacagtctggagaaacactcctggtaccatgggcctgtgtcccgcaatgccgctgagtatctgctgagcagcgggatcaatggcagcttcttggtgcgtgagagtgagagcagtcctggccagaggtccatctcgctgagatacgaagggagggtgtaccattacaggatcaacactgcttctgatggcaagctctacgtctcctccgagagccgcttcaacaccctggccgagttggttcatcatcattcaacggtggccgacgggctcatcaccacgctccattatccagccccaaagcgcaacaagcccactgtctatggtgtgtcccccaactacgacaagtgggagatggaacgcacggacatcaccatgaagcacaaggcgggggccagtacggggaggtgtacgagggcgtgtggaagaaatacagcctgacggtggccgtgaagaccttgaaggaggacaccatggaggtggaagagttcttgaaagaagctgcagtcatgaaagagatcaaacaccctaacctggtgcagctccttggggtctgcacccgggagcccccgttctatatcatcactgagttcatgacctacgggaacctcctggactacctgagggagtgcaaccggcaggaggtgaacgccgtggtgctgctgtacatggccactcagatctcgtcagccatggagtacctggagaagaaaaacttcatccacagagatcttgctgcccgaaactgcctggtaggggagaaccacttggtgaaggtagctgattttggcctgagcaggttgatgacaggggacacctacacagcccatgctggagccaagttccccatcaaatggactgcacccgagagcctggcctacaacaagttctccatcaagtccgacgtctgggcatttggagtattgctttgggaaattgctacctatggcatgtccccttacccgggaattgacctgtcccaggtgtatgagctgctagagaaggactaccgcatggagcgcccagaaggctgcccagagaaggtctatgaactcatgcgagcatgttggcagtggaatccctctgaccggccctcctttgctgaaatccaccaagcctttgaaacaatgttccaggaatccagtatctcagacgaagtggaaaaggagctggggaaacaaggcgtccgtggggctgtgagtaccttgctgcaggccccagagctgcccaccaagacgaggacctccaggagagctgcagagcacagagacaccactgacgtgcctgagatgcctcactccaagggccagggagagagcgatcctctggaccatgagcctgccgtgtctccattgctccctcgaaaagagcgaggtcccccggagggcggcctgaatgaagatgagcgccttctccccaaagacaaaaagaccaacttgttcagcgccttgatcaagaagaagaagaagacagccccaacccctcccaaacgcagcagctccttccgggagatggacggccagccggagcgcagaggggccggcgaggaagagggccgagacatcagcaacggggcactggctttcacccccttggacacagctgacccagccaagtccccaaagcccagcaatggggctggggtccccaatggagccctccgggagtccgggggctcaggcttccggtctccccacctgtggaagaagtccagcacgctgaccagcagccgcctagccaccggcgaggaggagggcggtggcagctccagcaagcgcttcctgcgctcttgctccgcctcctgcgttccccatggggccaaggacacggagtggaggtcagtcacgctgcctcgggacttgcagtccacgggaagacagtttgactcgtccacatttggagggcacaaaagtgagaagccggctctgcctcggaagagggcaggggagaacaggtctgaccaggtgacccgaggcacagtaacgcctccccccaggctggtgaaaaagaatgaggaagctgctgatgaggtcttcaaagacatcatggagtccagcccgggctccagcccgcccaacctgactccaaaacccctccggcggcaggtcaccgtggcccctgcctcgggcctcccccacaaggaagaagctggaaagggcagtgccttagggacccctgctgcagctgagccagtgacccccaccagcaaagcaggctcaggtgcaccagggggcaccagcaagggccccgccgaggagtccagagtgaggaggcacaagcactcctctgagtcgccagggagggacaaggggaaattgtccaggctcaaacctgccccgccgcccccaccagcagcctctgcagggaaggctggaggaaagccctcgcagagcccgagccaggaggcggccggggaggcagtcctgggcgcaaagacaaaagccacgagtctggttgatgctgtgaacagtgacgctgccaagcccagccagccgggagagggcctcaaaaagcccgtgctcccggccactccaaagccacagtccgccaagccgtcggggacccccatcagcccagcccccgttccctccacgttgccatcagcatcctcggccctggcaggggaccagccgtcttccaccgccttcatccctctcatatcaacccgagtgtctcttcggaaaacccgccagcctccagagcggatcgccagcggcgccatcaccaagggcgtggtcctggacagcaccgaggcgctgtgcctcgccatctctaggaactccgagcagatggccagccacagcgcagtgctggaggccggcaaaaacctctacacgttctgcgtgagctatgtggattccatccagcaaatgaggaacaagtttgccttccgagaggccatcaacaaactggagaataatctccgggagcttcagatctgcccggcgacagcaggcagtggtccagcggccactcaggacttcagcaagctcctcagttcggtgaaggaaatcagtgacatagtgcagaggtagcagcagtcaggggtcaggtgtcaggcccgtcggagctgcctgcagcacatgcgggctcgcccatacccgtgacagtggctgacaagggactagtgagtcagcaccttggcccaggagctctgcgccaggcagagctgagggccctgtggagtccagctctactacctacgtttgcaccgcctgccctcccgcaccttcctcctccccgctccgtctctgtcctcgaattttatctgtggagttcctgctccgtggactgcagtcggcatgccaggacccgccagccccgctcccacctagtgccccagactgagctctccaggccaggtgggaacggctgatgtggactgtctttttcatttttttctctctggagcccctcctcccccggctgggcctccttcttccacttctccaagaatggaagcctgaactgaggccttgtgtgtcaggccctctgcctgcactccctggccttgcccgtcgtgtgctgaagacatgtttcaagaaccgcatttcgggaagggcatgcacgggcatgcacacggctggtcactctgccctctgctgctgcccggggtggggtgcactcgccatttcctcacgtgcaggacagctcttgatttgggtggaaaacagggtgctaaagccaaccagcctttgggtcctgggcaggtgggagctgaaaaggatcgaggcatggggcatgtcctttccatctgtccacatccccagagcccagctcttgctctcttgtgacgtgcactgtgaatcctggcaagaaagcttgagtctcaagggtggcaggtcactgtcactgccgacatccctcccccagcagaatggaggcaggggacaagggaggcagtggctagtggggtgaacagctggtgccaaatagccccagactgggcccaggcaggtctgcaagggcccagagtgaaccgtcctttcacacatctgggtgccctgaaagggcccttcccctcccccactcctctaagacaaagtagattcttacaaggccctttcctttggaacaagacagccttcacttttctgagttcttgaagcatttcaaagccctgcctctgtgtagccgccctgagagagaatagagctgccactgggcacctgcgcacaggtgggaggaaagggcctggccagtcctggtcctggctgcactcttgaactgggcgaatgtcttatttaattaccgtgagtgacatagcctcatgttctgtgggggtcatcagggagggttaggaaaaccacaaacggagcccctgaaagcctcacgtatttcacagagcacgcctgccatcttctccccgaggctgccccaggccggagcccagatacgggggctgtgactctgggcagggacccggggtctcctggaccttgacagagcagctaactccgagagcagtgggcaggtggccgcccctgaggcttcacgccgggagaagccaccttcccaccccttcataccgcctcgtgccagcagcctcgcacaggccctagctttacgctcatcacctaaacttgtactttatttttctgatagaaatggtttcctctggatcgttttatgcggttcttacagcacatcacctctttgcccccgacggctgtgacgcagccggagggaggcactagtcaccgacagcggccttgaagacagagcaaagcgcccacccaggtcccccgactgcctgtctccatgaggtactggtcccttccttttgttaacgtgatgtgccactatattttacacgtatctcttggtatgcatcttttatagacgctcttttctaagtggcgtgtgcatagcgtcctgccctgccccctcgggggcctgtggtggctccccctctgcttctcggggtccagtgcattttgtttctgtatatgattctctgtggttttttttgaatccaaatctgtcctctgtagtattttttaaataaatcagtgtttacattagaa

SEQ ID NO: 658 - DNA, 4875 bp, Homo sapiens
agccaatcagcggtacggggggcggtgcctccggggctcacctggctgcagccacgcaccccctctcagtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgtacaagggtcaggtgcctgagaacgaggctaacgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttgaaaacagcaaagggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacatatcggatttggagagacactgccaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaacccaagaatctatcattttgaagccaaagatggccttagaggtgggtgactacaaaatcaatctcaagctcatggataaccagaataaagaccaagtgaccaccttagaggtcagcgtgtgtgactgtgaaggggccgctggcgtctgtaggaaggcacagcctgtcgaagcaggattgcaaattcctgccattctggggattcttggaggaattcttgctttgctaattctgattctgctgctcttgctgtttcttcggaggagagcggtggtcaaagagcccttactgcccccagaggatgacacccgggacaacgtttattactatgatgaagaaggaggcggagaagaggaccaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaaaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgactaggggactcgagagaggcgggccccagacccatgtgctgggaaatgcagaaatcacgttgctggtggtttttcagctcccttcccttgagatgagtttctggggaaaaaaaagagactggttagtgatgcagttagtatagctttatactctctccactttatagctctaataagtttgtgttagaaaagtttcgacttatttcttaaagcttttttttttttcccatcactctttacatggtggtgatgtccaaaagatacccaaattttaatattccagaagaacaactttagcatcagaaggttcacccagcaccttgcagattttcttaaggaattttgtctcacttttaaaaagaaggggagaagtcagctactctagttctgttgttttgtgtatataattttttaaaaaaaatttgtgtgcttctgctcattactacactggtgtgtccctctgccttttttttttttttaagacagggtctcattctatcggccaggctggagtgcagtggtgcaatcacagctcactgcagccttgtcctcccaggctcaagctatccttgcacctcagcctcccaagtagctgggaccacaggcatgcaccactacgcatgactaattttttaaatatttgagacggggtctccctgtgttacccaggctggtctcaaactcctgggctcaagtgatcctcccatcttggcctcccagagtattgggattacagacatgagccactgcacctgcccagctccccaactccctgccattttttaagagacagtttcgctccatcgcccaggcctgggatgcagtgatgtgatcatagctcactgtaacctcaaactctggggctcaagcagttctcccaccagcctcctttttatttttttgtacagatggggtcttgctatgttgcccaagctggtcttaaactcctggcctcaagcaatccttctgccttggccccccaaagtgctgggattgtgggcatgagctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaagtgcctgcttttgatgatgtctacagaaaatgctggctgagctgaacacatttgcccaattccaggtgtgcacagaaaaccgagaatattcaaaattccaaatttttttcttaggagcaagaagaaaatgtggccctaaagggggttagttgaggggtagggggtagtgaggatcttgatttggatctctttttatttaaatgtgaatttcaacttttgacaatcaaagaaaagacttttgttgaaatagctttactgtttctcaagtgttttggagaaaaaaatcaaccctgcaatcactttttggaattgtcttgatttttcggcagttcaagctatatcgaatatagttctgtgtagagaatgtcactgtagttttgagtgtatacatgtgtgggtgctgataattgtgtattttctttgggggtggaaaaggaaaacaattcaagctgagaaaagtattctcaaagatgcatttttataaattttattaaacaattttgtt

SEQ ID NO: 659 - DNA, 3304 bp, Homo sapiens
aaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgtacaagggtcaggtgcctgagaacgaggctaacgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttgaaaacagcaaagggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacatatcggatttggagagacactgccaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaacttggcctcccagagtattgggattacagacatgagccactgcacctgcccagctccccaactccctgccattttttaagagacagtttcgctccatcgcccaggcctgggatgcagtgatgtgatcatagctcactgtaacctcaaactctggggctcaagcagttctcccaccagcctcctttttatttttttgtacagatggggtcttgctatgttgcccaagctggtcttaaactcctggcctcaagcaatccttctgccttggccccccaaagtgctgggattgtgggcatgagctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaagtgcctgcttttgatgatgtctacagaaaatgctggctgagctgaacacatttgcccaattccaggtgtgcacagaaaaccgagaatattcaaaattccaaatttttttcttaggagcaagaagaaaatgtggccctaaagggggttagttgaggggtagggggtagtgaggatcttgatttggatctctttttatttaaatgtgaatttcaacttttgacaatcaaagaaaagacttttgttgaaatagctttactgtttctcaagtgttttggagaaaaaaatcaaccctgcaatcactttttggaattgtcttgatttttcggcagttcaagctatatcgaatatagttctgtgtagagaatgtcactgtagttttgagtgtatacatgtgtgggtgctgataattgtgtattttctttgggggtggaaaaggaaaacaattcaagctgagaaaagtattctcaaagatgcatttttataaattttattaaacaattttgtt

SEQ ID NO: 660 - DNA, 4869 bp, Homo sapiens
agtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgtacaagggtcaggtgcctgagaacgaggctaacgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttgaaaacagcaaagctggcaagatgcagaaactggcatcctcacagctgttcatacccttgtcccctgggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacatatcggatttggagagacactgccaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaacccaagaatctatcattttgaagccaaagatggccttagaggtgggtgactacaaaatcaatctcaagctcatggataaccagaataaagaccaagtgaccaccttagaggtcagcgtgtgtgactgtgaaggggccgctggcgtctgtaggaaggcacagcctgtcgaagcaggattgcaaattcctgccattctggggattcttggaggaattcttgctttgctaattctgattctgctgctcttgctgtttcttcggaggagagcggtggtcaaagagcccttactgcccccagaggatgacacccgggacaacgtttattactatgatgaagaaggaggcggagaagaggaccaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaaaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgactaggggactcgagagaggcgggccccagacccatgtgctgggaaatgcagaaatcacgttgctggtggtttttcagctcccttcccttgagatgagtttctggggaaaaaaaagagactggttagtgatgcagttagtatagctttatactctctccactttatagctctaataagtttgtgttagaaaagtttcgacttatttcttaaagcttttttttttttcccatcactctttacatggtggtgatgtccaaaagatacccaaattttaatattccagaagaacaactttagcatcagaaggttcacccagcaccttgcagattttcttaaggaattttgtctcacttttaaaaagaaggggagaagtcagctactctagttctgttgttttgtgtatataattttttaaaaaaaatttgtgtgcttctgctcattactacactggtgtgtccctctgccttttttttttttttaagacagggtctcattctatcggccaggctggagtgcagtggtgcaatcacagctcactgcagccttgtcctcccaggctcaagctatccttgcacctcagcctcccaagtagctgggaccacaggcatgcaccactacgcatgactaattttttaaatatttgagacggggtctccctgtgttacccaggctggtctcaaactcctgggctcaagtgatcctcccatcttggcctcccagagtattgggattacagacatgagccactgcacctgcccagctccccaactccctgccattttttaagagacagtttcgctccatcgcccaggcctgggatgcagtgatgtgatcatagctcactgtaacctcaaactctggggctcaagcagttctcccaccagcctcctttttatttttttgtacagatggggtcttgctatgttgcccaagctggtcttaaactcctggcctcaagcaatccttctgccttggccccccaaagtgctgggattgtgggcatgagctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaagtgcctgcttttgatgatgtctacagaaaatgctggctgagctgaacacatttgcccaattccaggtgtgcacagaaaaccgagaatattcaaaattccaaatttttttcttaggagcaagaagaaaatgtggccctaaagggggttagttgaggggtagggggtagtgaggatcttgatttggatctctttttatttaaatgtgaatttcaacttttgacaatcaaagaaaagacttttgttgaaatagctttactgtttctcaagtgttttggagaaaaaaatcaaccctgcaatcactttttggaattgtcttgatttttcggcagttcaagctatatcgaatatagttctgtgtagagaatgtcactgtagttttgagtgtatacatgtgtgggtgctgataattgtgtattttctttgggggtggaaaaggaaaacaattcaagctgagaaaagtattctcaaagatgcatttttataaattttattaaacaattttgttaaaccat

SEQ ID NO: 661 - DNA, 2567 bp, Homo sapiens
gctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacatatcggatttggagagacactgccaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaacccaagaatctatcattttgaagccaaagatggccttagaggtgggtgactacaaaatcaatctcaagctcatggataaccagaataaagaccaagtgaccaccttagaggtcagcgtgtgtgactgtgaaggggccgctggcgtctgtaggaaggcacagcctgtcgaagcaggattgcaaattcctgccattctggggattcttggaggaattcttgctttgctaattctgattctgctgctcttgctgtttcttcggaggagagcggtggtcaaagagcccttactgcccccagaggatgacacccgggacaacgtttattactatgatgaagaaggaggcggagaagaggaccaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaaaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgactaggggactcgagagaggcgggccccagacccatgtgctg

SEQ ID NO: 662 - DNA, 6857 bp, Homo sapiens
ttctctcagcccccgccctttccttccctcacagcggcagcctccctcctcccgccccccccgccccgcacccgcctgcccgcccgccacctccccccggtttctcattcctgccactagcgcgctcggcggctcattccgcggccgccgccagctgaggggagcgtcgcgggccgaggagcagatgccgcgggggccgctcgcagccgccgctgacttgtgaatgggaccgggactggggccgggactgacaccgcagcgcttgccctgcgccagggactggcggctcggaggttgcgtccaccctcaagggccccagaaatcactgtgttttcagctcagcggccctgtgacattccttcgtgttgtcatttgttgagtgaccaatcagatgggtggagtgtgttacagaaattggcagcaagtatccaatgggtgaagaagaagctaactggggacgtgggcagccctgacgtgatgagctcaaccagcagagacattccatcccaagagaggtctgcgtgacgcgtccgggaggccaccctcagcaagaccaccgtacagttggtggaaggggtgacagctgcattctcctgtgcctaccacgtaaccaaaaatgaaggagaactactgtttacaagccgccctggtgtgcctgggcatgctgtgccacagccatgcctttgccccagagcggcgggggcacctgcggccctccttccatgggcaccatgagaagggcaaggaggggcaggtgctacagcgctccaagcgtggctgggtctggaaccagttcttcgtgatagaggagtacaccgggcctgaccccgtgcttgtgggcaggcttcattcagatattgactctggtgatgggaacattaaatacattctctcaggggaaggagctggaaccatttttgtgattgatgacaaatcagggaacattcatgccaccaagacgttggatcgagaagagagagcccagtacacgttgatggctcaggcggtggacagggacaccaatcggccactggagccaccgtcggaattcattgtcaaggtccaggacattaatgacaaccctccggagttcctgcacgagacctatcatgccaacgtgcctgagaggtccaatgtgggaacgtcagtaatccaggtgacagcttcagatgcagatgaccccacttatggaaatagcgccaagttagtgtacagtatcctcgaaggacaaccctatttttcggtggaagcacagacaggtatcatcagaacagccctacccaacatggacagggaggccaaggaggagtaccacgtggtgatccaggccaaggacatgggtggacatatgggcggactctcagggacaaccaaagtgacgatcacactgaccgatgtcaatgacaacccaccaaagtttccgcagagcgtataccagatgtctgtgtcagaagcagccgtccctggggaggaagtaggaagagtgaaagctaaagatccagacattggagaaaatggcttagtcacatacaatattgttgatggagatggtatggaatcgtttgaaatcacaacggactatgaaacacaggagggggtgataaagctgaaaaagcctgtagattttgaaaccaaaagagcctatagcttgaaggtagaggcagccaacgtgcacatcgacccgaagtttatcagcaatggccctttcaaggacactgtgaccgtcaagatctcagtagaagatgctgatgagccccctatgttcttggccccaagttacatccacgaagtccaagaaaatgcagctgctggcaccgtggttgggagagtgcatgccaaagaccctgatgctgccaacagcccgataaggtattccatcgatcgtcacactgacctcgacagatttttcactattaatccagaggatggttttattaaaactacaaaacctctggatagagaggaaacagcctggctcaacatcactgtctttgcagcagaaatccacaatcggcatcaggaagccaaagtcccagtggccattagggtccttgatgtcaacgataatgctcccaagtttgctgccccttatgaaggtttcatctgtgagagtgatcagaccaagccactttccaaccagccaattgttacaattagtgcagatgacaaggatgacacggccaatggaccaagatttatcttcagcctaccccctgaaatcattcacaatccaaatttcacagtcagagacaaccgagataacacagcaggcgtgtacgcccggcgtggagggttcagtcggcagaagcaggacttgtaccttctgcccatagtgatcagcgatggcggcatcccgcccatgagtagcaccaacaccctcaccatcaaagtctgcgggtgcgacgtgaacggggcactgctctcctgcaacgcagaggcctacattctgaacgccggcctgagcacaggcgccctgatcgccatcctcgcctgcatcgtcattctcctggtcattgtagtattgtttgtgaccctgagaaggcaaaagaaagaaccactcattgtctttgaggaagaagatgtccgtgagaacatcattacttatgatgatgaagggggtggggaagaagacacagaagcctttgatattgccaccctccagaatcctgatggtatcaatggatttatcccccgcaaagacatcaaacctgagtatcagtacatgcctagacctgggctccggccagcgcccaacagcgtggatgtcgatgacttcatcaacacgagaatacaggaggcagacaatgaccccacggctcctccttatgactccattcaaatctacggttatgaaggcaggggctcagtggccgggtccctgagctccctagagtcggccaccacagattcagacttggactatgattatctacagaactggggacctcgttttaagaaactagcagatttgtatggttccaaagacacttttgatgacgattcttaacaataacgatacaaatttggccttaagaactgtgtctggcgttctcaagaatctagaagatgtgtaaacaggtatttttttaaatcaaggaaaggctcatttaaaacaggcaaagttttacagagaggatacatttaataaaactgcgaggacatcaaagtggtaaatactgtgaaataccttttctcacaaaaaggcaaatattgaagttgtttatcaacttcgctagaaaaaaaaaacacttggcatacaaaatatttaagtgaaggagaagtctaacgctgaactgacaatgaagggaaattgtttatgtgttatgaacatccaagtctttcttcttttttaagttgtcaaagaagcttccacaaaattagaaaggacaacagttctgagctgtaatttcgccttaaactctggacactctatatgtagtgcatttttaaacttgaaatatataatattcagccagcttaaacccatacaatgtatgtacaatacaatgtacaattatgtctcttgagcatcaatcttgttactgctgattcttgtaaatctttttgcttctactttcatcttaaactaatacgtgccagatataactgtcttgtttcagtgagagacgccctatttctatgtcatttttaatgtatctatttgtacaattttaaagttcttattttagtatacgtataaatatcagtattctgacatgtaagaaaatgttacggcatcacacttatattttatgaacattgtactgttgctttaatatgagcttcaatataagaagcaatctttgaaataaaaaaagatttttttttaattctgggtttgattcttaacattgaaacaaacgttaagtatttctaatgatccatttatatttctaatttaattgtgatcttttaataaccctatttatgatctgttgttgtctgtctgctgcttttattgtttatttaaaatcaaatatgttttacaaatgttttttcagacaagattctgtaacatcatgtaaagcttttttgtacattcttggtgttaacctcctggcttctcttcacacacatcttctaaaaaagaaggatgtgaaagaactaggtcagtctatgactttgcaatatgtgttatatagtatgcatttatcttgtatatcagtaatttgatggttatgagagatgaatccatgagggaatggagctatcagaactctaatgttccaggtatacattctatgccccacactgagcactggggaactgggggactagagtcaaaaatataaatttgcccagactctaatgttattctattttttcttctgttgaacttaccaggctattgtaagactcttgatagttgaaactgcttatttttcctcctgtaattttaactaattgtaaaatgatgtggcattttatgttttaatgagaatgggcgattcatttaaaaaagctttgtttagaatatgcttggggccgtaagctcagaatgagggcagggaccattttggattctgagagtcgatgccatttggtccaggagtgtgtctacagtcccctgcattccagctagtttcttggggattgaaacttatgtgaagggcatttcacctgttcagttgggccaaaggtcaaaacgtagcaatacttggggaaagaccacataaagtcacactgcaagtgctttccctctttccccctacacacagggcacgtgctttttcttggattgcagacaatttttacagtttttttctgactttattgtgaaagtttgtttcaagcatttcttgatatcatgttatgtactatttttatgatttagtcaacatgcatacaaagaaatgttttttatgaagtgctcacttccattttactttgcattgaaatcaaattgggctgaacacttcaatggaatacattttgtggacaatgtcactttagaatctttcatctcagtgaaggattacacattctcaatacttccataattgcaggttgtgttcatttttttatatagtttttgtaatccaaagaatattttgctagatttgcacagatctccaattgaatttgcaatgaagaaataactcaaaaggaatatgaatagcatttaaataagtatacagctgtaagtaaccctgtcaccatggatgatccttttctctaggaatgtatttggattagagatgacaactacattttcgcatttttatgttgaagtcttttttaaaaaggctgtttacttttcagtagttaagaatacttgtttttctttttcttttttttttttttttttaccttttattttttcgttaagcctctattgtttgtagaacactcttagaaacttggaaataaaatgtctttcccaactagtggagtcctttttcatttggagcacattgccttaaaagaagtcttaatttaaacggtccttccttattctaaagtaatcactgttttataccatctatgcagctaaaagaaggaacatgcttctgttcttttcctcaagtaatggttattgtttctagtcatcattcattcattgattcattcattaattcatcaaaatcttattttataaaccctgttccacttactggaggattcagaatgaatcttactaccttttctgacatcttttgataattcagccctgtaccaaagtatccaccttgttgtcttataatcacctatttacctatttgccctcctagaaaatgcaagaagatattttctctccttccaaattgaaggaagaacataaaagatataacaggaaggagatggtgagatatagagtgtgagcggaaattaggccagctgtggcaattctggacagatcttgggtttagctaagttatttcttttaggcctgggtttctgggggtgacagggaagataaaagagtagtttatttgcacctcttggagaattgcttaaaaatatagagatcatggctctgtatgtcaggtggaaccaggtcaggagtatttgaaactgctcctgggtcattgtgacatatccttcacatctttttgagaaactttataagacaatgggggtgaatgggggctgggcagttggagtctctgagcagaagaggggcaaaatttatttggcaggcagtgtggaggacagattaggagcatataaacccagaggtgtgccccaggagggcttttgcaaaggtcaatatgagatagaatgagggcctgaaataattcagtaatttggagatggagaagaggaaagacttctctgctcttgcactgccatcagcctggtctgggccatggtcatctctgacccggaagactgaccccacctcttggctcaccctctgcctcccaacctcctcttcacaaagaagccagagggatacttttaacacacaacccagatcacatgacttcgtaacttaaacctcttcactggcttcccaaagacttaaaatgaattctgatgcctttattttattgctttacatgaacagggccctgcgaacctctccagtgtcattccactccatcctcctttcagtgcacgatgctccagccacactggccatctttcggttcctgatacaaaaaaaaacacgttccttttccatggaaagcaggtcacccttgttattttgtatcgatgacaactctttaaacttattttgctttttggctttatgtatgtgtgtgggtgggtgggactgactgccccactagaatgtaagctccatgagggcagggaatcttgctttcttgtttaccattgtatactcagttctttacacagtgcctgaaacataacaggtacacaataaatatctattgaatgaaagcaaa

SEQ ID NO: 663 - DNA, 6874 bp, Homo sapiens
agcgtcgcgggccgaggagcagatgccgcgggggccgctcgcagccgccgctgacttgtgaatgggaccgggactggggccgggactgacaccgcagcgcttgccctgcgccagggactggcggctcggaggttgcgtccaccctcaagggccccagaaatcactgtgttttcagctcagcggccctgtgacattccttcgtgttgtcatttgttgagtgaccaatcagatgggtggagtgtgttacagaaattggcagcaagtatccaatgggtgaagaagaagctaactggggacgtgggcagccctgacgtgatgagctcaaccagcagagacattccatcccaagagaggtctgcgtgacgcgtccgggaggccaccctcagcaagaccaccgtacagttggtggaaggggtgacagctgcattctcctgtgcctaccacgtaaccaaaaatgaaggagaactactgtttacaagccgccctggtgtgcctgggcatgctgtgccacagccatgcctttgccccagagcggcgggggcacctgcggccctccttccatgggcaccatgagaagggcaaggaggggcaggtgctacagcgctccaagcgtggctgggtctggaaccagttcttcgtgatagaggagtacaccgggcctgaccccgtgcttgtgggcaggcttcattcagatattgactctggtgatgggaacattaaatacattctctcaggggaaggagctggaaccatttttgtgattgatgacaaatcagggaacattcatgccaccaagacgttggatcgagaagagagagcccagtacacgttgatggctcaggcggtggacagggacaccaatcggccactggagccaccgtcggaattcattgtcaaggtccaggacattaatgacaaccctccggagttcctgcacgagacctatcatgccaacgtgcctgagaggtccaatgtgggaacgtcagtaatccaggtgacagcttcagatgcagatgaccccacttatggaaatagcgccaagttagtgtacagtatcctcgaaggacaaccctatttttcggtggaagcacagacaggtatcatcagaacagccctacccaacatggacagggaggccaaggaggagtaccacgtggtgatccaggccaaggacatgggtggacatatgggcggactctcagggacaaccaaagtgacgatcacactgaccgatgtcaatgacaacccaccaaagtttccgcagagcgtataccagatgtctgtgtcagaagcagccgtccctggggaggaagtaggaagagtgaaagctaaagatccagacattggagaaaatggcttagtcacatacaatattgttgatggagatggtatggaatcgtttgaaatcacaacggactatgaaacacaggagggggtgataaagctgaaaaagcctgtagattttgaaaccaaaagagcctatagcttgaaggtagaggcagccaacgtgcacatcgacccgaagtttatcagcaatggccctttcaaggacactgtgaccgtcaagatctcagtagaagatgctgatgagccccctatgttcttggccccaagttacatccacgaagtccaagaaaatgcagctgctggcaccgtggttgggagagtgcatgccaaagaccctgatgctgccaacagcccgataaggtattccatcgatcgtcacactgacctcgacagatttttcactattaatccagaggatggttttattaaaactacaaaacctctggatagagaggaaacagcctggctcaacatcactgtctttgcagcagaaatccacaatcggcatcaggaagccaaagtcccagtggccattagggtccttgatgtcaacgataatgctcccaagtttgctgccccttatgaaggtttcatctgtgagagtgatcagaccaagccactttccaaccagccaattgttacaattagtgcagatgacaaggatgacacggccaatggaccaagatttatcttcagcctaccccctgaaatcattcacaatccaaatttcacagtcagagacaaccgagataacacagcaggcgtgtacgcccggcgtggagggttcagtcggcagaagcaggacttgtaccttctgcccatagtgatcagcgatggcggcatcccgcccatgagtagcaccaacaccctcaccatcaaagtctgcgggtgcgacgtgaacggggcactgctctcctgcaacgcagaggcctacattctgaacgccggcctgagcacaggcgccctgatcgccatcctcgcctgcatcgtcattctcctgggttgcccaagcttaatggaacccccctctcccagggaagacatgagattgctttatctgggcttccagctgatgctattttcctatgttaaagtaaacagaagattttgtcttctgggggtctttataaaacttcctttcctctatgtggtggctacagagagtccaaccacacttacgtcattgtagtattgtttgtgaccctgagaaggcaaaagaaagaaccactcattgtctttgaggaagaagatgtccgtgagaacatcattacttatgatgatgaagggggtggggaagaagacacagaagcctttgatattgccaccctccagaatcctgatggtatcaatggatttatcccccgcaaagacatcaaacctgagtatcagtacatgcctagacctgggctccggccagcgcccaacagcgtggatgtcgatgacttcatcaacacgagaatacaggaggcagacaatgaccccacggctcctccttatgactccattcaaatctacggttatgaaggcaggggctcagtggccgggtccctgagctccctagagtcggccaccacagattcagacttggactatgattatctacagaactggggacctcgttttaagaaactagcagatttgtatggttccaaagacacttttgatgacgattcttaacaataacgatacaaatttggccttaagaactgtgtctggcgttctcaagaatctagaagatgtgtaaacaggtatttttttaaatcaaggaaaggctcatttaaaacaggcaaagttttacagagaggatacatttaataaaactgcgaggacatcaaagtggtaaatactgtgaaataccttttctcacaaaaaggcaaatattgaagttgtttatcaacttcgctagaaaaaaaaaacacttggcatacaaaatatttaagtgaaggagaagtctaacgctgaactgacaatgaagggaaattgtttatgtgttatgaacatccaagtctttcttcttttttaagttgtcaaagaagcttccacaaaattagaaaggacaacagttctgagctgtaatttcgccttaaactctggacactctatatgtagtgcatttttaaacttgaaatatataatattcagccagcttaaacccatacaatgtatgtacaatacaatgtacaattatgtctcttgagcatcaatcttgttactgctgattcttgtaaatctttttgcttctactttcatcttaaactaatacgtgccagatataactgtcttgtttcagtgagagacgccctatttctatgtcatttttaatgtatctatttgtacaattttaaagttcttattttagtatacgtataaatatcagtattctgacatgtaagaaaatgttacggcatcacacttatattttatgaacattgtactgttgctttaatatgagcttcaatataagaagcaatctttgaaataaaaaaagatttttttttaattctgggtttgattcttaacattgaaacaaacgttaagtatttctaatgatccatttatatttctaatttaattgtgatcttttaataaccctatttatgatctgttgttgtctgtctgctgcttttattgtttatttaaaatcaaatatgttttacaaatgttttttcagacaagattctgtaacatcatgtaaagcttttttgtacattcttggtgttaacctcctggcttctcttcacacacatcttctaaaaaagaaggatgtgaaagaactaggtcagtctatgactttgcaatatgtgttatatagtatgcatttatcttgtatatcagtaatttgatggttatgagagatgaatccatgagggaatggagctatcagaactctaatgttccaggtatacattctatgccccacactgagcactggggaactgggggactagagtcaaaaatataaatttgcccagactctaatgttattctattttttcttctgttgaacttaccaggctattgtaagactcttgatagttgaaactgcttatttttcctcctgtaattttaactaattgtaaaatgatgtggcattttatgttttaatgagaatgggcgattcatttaaaaaagctttgtttagaatatgcttggggccgtaagctcagaatgagggcagggaccattttggattctgagagtcgatgccatttggtccaggagtgtgtctacagtcccctgcattccagctagtttcttggggattgaaacttatgtgaagggcatttcacctgttcagttgggccaaaggtcaaaacgtagcaatacttggggaaagaccacataaagtcacactgcaagtgctttccctctttccccctacacacagggcacgtgctttttcttggattgcagacaatttttacagtttttttctgactttattgtgaaagtttgtttcaagcatttcttgatatcatgttatgtactatttttatgatttagtcaacatgcatacaaagaaatgttttttatgaagtgctcacttccattttactttgcattgaaatcaaattgggctgaacacttcaatggaatacattttgtggacaatgtcactttagaatctttcatctcagtgaaggattacacattctcaatacttccataattgcaggttgtgttcatttttttatatagtttttgtaatccaaagaatattttgctagatttgcacagatctccaattgaatttgcaatgaagaaataactcaaaaggaatatgaatagcatttaaataagtatacagctgtaagtaaccctgtcaccatggatgatccttttctctaggaatgtatttggattagagatgacaactacattttcgcatttttatgttgaagtcttttttaaaaaggctgtttacttttcagtagttaagaatacttgtttttctttttcttttttttttttttttttaccttttattttttcgttaagcctctattgtttgtagaacactcttagaaacttggaaataaaatgtctttcccaactagtggagtcctttttcatttggagcacattgccttaaaagaagtcttaatttaaacggtccttccttattctaaagtaatcactgttttataccatctatgcagctaaaagaaggaacatgcttctgttcttttcctcaagtaatggttattgtttctagtcatcattcattcattgattcattcattaattcatcaaaatcttattttataaaccctgttccacttactggaggattcagaatgaatcttactaccttttctgacatcttttgataattcagccctgtaccaaagtatccaccttgttgtcttataatcacctatttacctatttgccctcctagaaaatgcaagaagatattttctctccttccaaattgaaggaagaacataaaagatataacaggaaggagatggtgagatatagagtgtgagcggaaattaggccagctgtggcaattctggacagatcttgggtttagctaagttatttcttttaggcctgggtttctgggggtgacagggaagataaaagagtagtttatttgcacctcttggagaattgcttaaaaatatagagatcatggctctgtatgtcaggtggaaccaggtcaggagtatttgaaactgctcctgggtcattgtgacatatccttcacatctttttgagaaactttataagacaatgggggtgaatgggggctgggcagttggagtctctgagcagaagaggggcaaaatttatttggcaggcagtgtggaggacagattaggagcatataaacccagaggtgtgccccaggagggcttttgcaaaggtcaatatgagatagaatgagggcctgaaataattcagtaatttggagatggagaagaggaaagacttctctgctcttgcactgccatcagcctggtctgggccatggtcatctctgacccggaagactgaccccacctcttggctcaccctctgcctcccaacctcctcttcacaaagaagccagagggatacttttaacacacaacccagatcacatgacttcgtaacttaaacctcttcactggcttcccaaagacttaaaatgaattctgatgcctttattttattgctttacatgaacagggccctgcgaacctctccagtgtcattccactccatcctcctttcagtgcacgatgctccagccacactggccatctttcggttcctgatacaaaaaaaaacacgttccttttccatggaaagcaggtcacccttgttattttgtatcgatgacaactctttaaacttattttgctttttggctttatgtatgtgtgtgggtgggtgggactgactgccccactagaatgtaagctccatgagggcagggaatcttgctttcttgtttaccattgtatactcagttctttacacagtgcctgaaacataacaggtacacaataaatatctattgaatgaaagcaaa

SEQ ID NO: 664 - DNA, 955 bp, Homo sapiens
cgaggagcagatgccgcgggggccgctcgcagccgccgctgacttgtgaatgggaccgggactggggccgggactgacaccgcagcgcttgccctgcgccagggactggcggctcggaggttgcgtccaccctcaagggccccagaaatcactgtgttttcagctcagcggccctgtgacattccttcgtgttgtcatttgttgagtgaccaatcagatgggtggagtgtgttacagaaattggcagcaagtatccaatgggtgaagaagaagctaactggggacgtgggcagccctgacgtgatgagctcaaccagcagagacattccatcccaagagaggtctgcgtgacgcgtccgggaggccaccctcagcaagaccaccgtacagttggtggaaggggtgacagctgcattctcctgtgcctaccacgtaaccaaaaatgaaggagaactactgtttacaagccgccctggtgtgcctgggcatgctgtgccacagccatgcctttgccccagagcggcgggggcacctgcggccctccttccatgggcaccatgagaagggcaaggaggggcaggtgctacagcgctccaagcgtggctgggtctggaaccagttcttcgtgatagaggagtacaccgggcctgaccccgtgcttgtgggcaggcttcattcagatattgactctggtgatgggaacattaaatacattctctcaggggaaggagctggaaccatttttgtgattgatgacaaatcagggaacattcatgccaccaagacgttggatcgagaagagagagcccagtacacgttgatggctcaggcggtggacagggacaccaatcggaattcattgtcaaggtccaggacattaatgacaaccctccggagttcctgcacgagacctatcatgccaacgtgcctgagaggtccaatgtgggtgcgtacg

SEQ ID NO: 665 - DNA, 2513 bp, Homo sapiens
attcctgccactagcgcgctcggcggctcattccgcggccgccgccagctgaggggagcgtcgcgggccgaggagcagatgccgcgggggccgctcgcagccgccgctgacttgtgaatgggaccgggactggcggctcggaggttgcgtccaccctcaagggccccagaaatcactgtgttttcagctcagcggccctgtgacattccttcgtgttgtcatttgttgagtgaccaatcagatgggtggagtgtgttacagaaattggcagcaagtatccaatgggtgaagaagcttcattcagatattgactctggtgatgggaacattaaatacattctctcaggggaaggagctggaaccatttttgtgattgatgacaaatcagggaacattcatgccaccaagacgttggatcgagaagagagagcccagtacacgttgatggctcaggcggtggacagggacaccaatcggccactggagccaccgtcggaattcattgtcaaggtccaggacattaatgacaaccctccggagttcctgcacgagacctatcatgccaacgtgcctgagaggtccaatgtgggaacgtcagtaatccaggtgacagcttcagatgcagatgaccccacttatggaaatagcgccaagttagtgtacagtatcctcgaaggacaaccctatttttcggtggaagcacagacaggtatcatcagaacagccctacccaacatggacagggaggccaaggaggagtaccacgtggtgatccaggccaaggacatgggtggacatatgggcggactctcagggacaaccaaagtgacgatcacactgaccgatgtcaatgacaacccaccaaagtttccgcagagcgtataccagatgtctgtgtcagaagcagccgtccctggggaggaagtaggaagagtgaaagctaaagatccagacattggagaaaatggcttagtcacatacaatattgttgatggagatggtatggaatcgtttgaaatcacaacggactatgaaacacaggagggggtgataaagctgaaaaagcctgtagattttgaaaccaaaagagcctatagcttgaaggtagaggcagccaacgtgcacatcgacccgaagtttatcagcaatggccctttcaaggacactgtgaccgtcaagatctcagtagaagatgctgatgagccccctatgttcttggccccaagttacatccacgaagtccaagaaaatgcagctgctggcaccgtggttgggagagtgcatgccaaagaccctgatgctgccaacagcccgataaggtattccatcgatcgtcacactgacctcgacagatttttcactattaatccagaggatggttttattaaaactacaaaacctctggatagagaggaaacagcctggctcaacatcactgtctttgcagcagaaatccacaatcggcatcaggaagccaaagtcccagtggccattagggtccttgatgtcaacgataatgctcccaagtttgctgccccttatgaaggtttcatctgtgagagtgatcagaccaagccactttccaaccagccaattgttacaattagtgcagatgacaaggatgacacggccaatggaccaagatttatcttcagcctaccccctgaaatcattcacaatccaaatttcacagtcagagacaaccgagataacacagcaggcgtgtacgcccggcgtggagggttcagtcggcagaagcaggacttgtaccttctgcccatagtgatcagcgatggcggcatcccgcccatgagtagcaccaacaccctcaccatcaaagtctgcgggtgcgacgtgaacggggcactgctctcctgcaacgcagaggcctacattctgaacgccggcctgagcacaggcgccctgatcgccatcctcgcctgcatcgtcattctcctggtcattgtagtattgtttgtgaccctgagaaggcaaaagaaagaaccactcattgtctttgaggaagaagatgtccgtgagaacatcattacttatgatgatgaagggggtggggaagaagacacagaagcctttgatattgccaccctccagaatcctgatggtatcaatggatttatcccccgcaaagacatcaaacctgagtatcagtacatgcctagacctgggctccggccagcgcccaacagcgtggatgtcgatgacttcatcaacacgagaatacaggaggcagacaatgaccccacggctcctccttatgactccattcaaatctacggttatgaaggcaggggctcagtggccgggtccctgagctccctagagtcggccaccacagattcagacttggactatgattatctacagaactggggacctcgttttaagaaactagcagatttgtatggttccaaagacacttttgatgacgattcttaacaataacgatacaaatttggccttaagaactgtgtctggcgttctcaagaatctag

SEQ ID NO: 666 - DNA, 810 bp, Homo sapiens
tttgggaagttggctggctggcgaggcagagcctctcctcaaagcctggctcccacggaaaatatgctcagtgcagccgcgtgcatgaatgaaaacgccgccgggcgcttctagtcggacaaaatgcagccgagaactccgctcgttctgtgcgttctcctgtcccaggtgctgctgctaacatctgcagaagatttggactgcactcctggatttcagcagaaagtgttccatatcaatcagccagctgaattcattgaggaccagtcaattctaaacttgaccttcagtgactgtaagggaaacgacaagctacgctatgaggtctcgagcccatacttcaaggtgaacagcgatggcggcttagttgctctgagaaacataactgcagtgggcaaaactctgttcgtccatgcacggaccccccatgcggaagatatggcagaactcgtgattgtcggggggaaagacatccagggctccttgcaggatatatttaaatttgcaagaacttctcctgtcccaagacaaaagaggtccattgtggtatctcccattttaattccagagaatcagagacagcctttcccaagagatgttggcaagatgaagatttggcaagttctgtgcctagcacgatggctgacatgagataaaacccacaatcctattaacagcgaacttctcttgaatgaaggcattacagcagatttaaatccatgcattacaattttagcaatttaatgaacatcctatttggcgacattattgctttaaaggaataaatcacaaacattttacttcccacta

SEQ ID NO: 667 - DNA, 4001 bp, Homo sapiens
aagaagcaaatgggatgccacctccgcggggctcgctcctcgcgaggtgctcaccccgtatctgccatgcaaaacgagggagcgttaggaaggaatccgtcttgtaaagccattggtcctggtcatcagcctctacccaatgctttcgtgatgctgctgctgatctatttgggaagttggctggctggcgaggcagagcctctcctcaaagcctggctcccacggaaaatatgctcagtgcagccgcgtgcatgaatgaaaacgccgccgggcgcttctagtcggacaaaatgcagccgagaactccgctcgttctgtgcgttctcctgtcccaggtgctgctgctaacatctgcagaagatttggactgcactcctggatttcagcagaaagtgttccatatcaatcagccagctgaattcattgaggaccagtcaattctaaacttgaccttcagtgactgtaagggaaacgacaagctacgctatgaggtctcgagcccatacttcaaggtgaacagcgatggcggcttagttgctctgagaaacataactgcagtgggcaaaactctgttcgtccatgcacggaccccccatgcggaagatatggcagaactcgtgattgtcggggggaaagacatccagggctccttgcaggatatatttaaatttgcaagaacttctcctgtcccaagacaaaagaggtccattgtggtatctcccattttaattccagagaatcagagacagcctttcccaagagatgttggcaaggtagtcgatagtgacaggccagaaaggtccaagttccggctcactggaaagggagtggatcaagagcctaaaggaattttcagaatcaatgagaacacagggagcgtctccgtgacacggaccttggacagagaagtaatcgctgtttatcaactatttgtggagaccactgatgtcaatggcaaaactctcgaggggccggtgcctctggaagtcattgtgattgatcagaatgacaaccgaccgatctttcgggaaggcccctacatcggccacgtcatggaagggtcacccacaggcaccacagtgatgcggatgacagcctttgatgcagatgacccagccaccgataatgccctcctgcggtataatatccgtcagcagacgcctgacaagccatctcccaacatgttctacatcgatcctgagaaaggagacattgtcactgttgtgtcacctgcgctgctggaccgagagactctggaaaatcccaagtatgaactgatcatcgaggctcaagatatggctggactggatgttggattaacaggcacggccacagccacgatcatgatcgatgacaaaaatgatcactcaccaaaattcaccaagaaagagtttcaagccacagtcgaggaaggagctgtgggagttattgtcaatttgacagttgaagataaggatgaccccaccacaggtgcatggagggctgcctacaccatcatcaacggaaaccccgggcagagctttgaaatccacaccaaccctcaaaccaacgaagggatgctttctgttgtcaaaccattggactatgaaatttctgccttccacaccctgctgatcaaagtggaaaatgaagacccactcgtacccgacgtctcctacggccccagctccacagccaccgtccacatcactgtcctggatgtcaacgagggcccagtcttctacccagaccccatgatggtgaccaggcaggaggacctctctgtgggcagcgtgctgctgacagtgaatgccacggaccccgactccctgcagcatcaaaccatcaggtattctgtttacaaggacccagcaggttggctgaatattaaccccatcaatgggactgttgacaccacagctgtgctggaccgtgagtccccatttgtcgacaacagcgtgtacactgctctcttcctggcaattgacagtggcaaccctcccgctacgggcactgggactttgctgataaccctggaggacgtgaatgacaatgccccgttcatttaccccacagtagctgaagtctgtgatgatgccaaaaacctcagtgtagtcattttgggagcatcagataaggatcttcacccgaatacagatcctttcaaatttgaaatccacaaacaagctgttcctgataaagtctggaagatctccaagatcaacaatacacacgccctggtaagccttcttcaaaatctgaacaaagcaaactacaacctgcccatcatggtgacagattcagggaaaccacccatgacgaatatcacagatctcagggtacaagtgtgctcctgcaggaattccaaagtggactgcaacgcggcaggggccctgcgcttcagcctgccctcagtcctgctcctcagcctcttcagcttagcttgtctgtgagaactcctgacgtctgaagcttgactcccaagtttccatagcaacaggaaaaaaaaaaatctatccaaatctgaagattgcggtttacagctatcgaacttcacaactaggcctcaattgttccggttttttattttctttacaatttcacttagtctgtacttcatcattttgacagcatcttcctccctcctttaattaatggaatcttctgaattttccctgaatgtttaaagatcatgacatatgacttgatcttctgggagcaggaacaatgactactttttctggtgtgttaacatgtcgctagccagtgctccaggcacccagctttgtctgtgggttagtattggtgtatgtatgagtatctgtatgtatatatacacggtatttatagagagagactatcctggagaagcctcgttttgatgccattcttccttgcaaggttaagcaaggtgggtggaaactaagacacctgaaccctccagggcctcccgcatcaaggtcagcatgaggacagaccacagagctgtcacttttgctccgaagctacttctccactgtcccgttcagtctgaatgctgccacaaccagccaggcaggtccacagagagggagagcagagaaagaagtcctttctctttattgagttcgaggactacaaccaatttacactgccatctgatgccgtgatcctgagccaaggaggtgaggagcagagcaggcaatttcaccaccaaatgccaagaaaagggctgacattttctttcatgggcaccaacctgcatttgtatgtgtcccgaatccacagtcgtactgattctaatggggacacagatcatggtagagaatctctccctcctcagtaaatgtacaactgcacctgtcatcatggaggtcatacatgcatacaaagaggtgtacaggtaccatcttgtatacacatatatacccacatgtacagacatacatttatgcacattcacgctgtttgtttcatatatacaggcataaaatagagtaaatacaggtagttttaaaagtacccttttgtgtgaattgactaccgttgtttgcaaacccgaaaataaaagacgttcattatgtatgaaaagtaactgatttgtattctgtgagcatgtaaaagcggaaagttagtgcttgttctaagattaccttcttgttgataaaccataaatgaatcatcaaagctcacaccaaatttttctatcaaataaaactagtgacagcttgtggctttttattagagctcgccacgaactagggtaaggtgagtgtcttagcatattttaatgcagttgcttactaaaggttttaaccgcacatgcacacacacacgctttcttatgcaatctatgtttgcacttgtgctttcagttagccttctgtaggaagtagaagtcatatgttgtctttgttgtagtgaaattatacagatagagttccatatattgtatttgtttcaatggtaaatccttttggaacatatagaatgcagagatttttttttccattaaaataaatgggtattggtggttaaaactg

SEQ ID NO: 668 - DNA, 2280 bp, Homo sapiens
atgaaaacgccgccgggcgcttctagtcggacaaaatgcagccgagaactccgctcgttctgtgcgttctcctgtcccagggccaaacaacccacctgcactgcatggttcccccagcaagaacatcccagtgagaatggcccacagatgcctgggcgtgacccacctgcagcttcaaccatgcaggtgctgctgctaacatctgcagaagatttggactgcactcctggatttcagcagaaagtgttccatatcaatcagccagctgaattcattgaggaccagtcaattctaaacttgaccttcagtgactgtaagggaaacgacaagctacgctatgaggtctcgagcccatacttcaaggtgaacagcgatggcggcttagttgctctgagaaacataactgcagtgggcaaaactctgttcgtccatgcacggaccccccatgcggaagatatggcagaactcgtgattgtcggggggaaagacatccagggctccttgcaggatatatttaaatttgcaagaacttctcctgtcccaagacaaaagaggtccattgtggtatctcccattttaattccagagaatcagagacagcctttcccaagagatgttggcaaggtagtcgatagtgacaggccagaaaggtccaagttccggctcactggaaagggagtggatcaagagcctaaaggaattttcagaatcaatgagaacacagggagcgtctccgtgacacggaccttggacagagaagtaatcgctgtttatcaactatttgtggagaccactgatgtcaatggcaaaactctcgaggggccggtgcctctggaagtcattgtgattgatcagaatgacaaccgaccgatctttcgggaaggcccctacatcggccacgtcatggaagggtcacccacaggcaccacagtgatgcggatgacagcctttgatgcagatgacccagccaccgataatgccctcctgcggtataatatccgtcagcagacgcctgacaagccatctcccaacatgttctacatcgatcctgagaaaggagacattgtcactgttgtgtcacctgcgctgctggaccgagagactctggaaaatcccaagtatgaactgatcatcgaggctcaagatatggctggactggatgttggattaacaggcacggccacagccacgatcatgatcgatgacaaaaatgatcactcaccaaaattcaccaagaaagagtttcaagccacagtcgaggaaggagctgtgggagttattgtcaatttgacagttgaagataaggatgaccccaccacaggtgcatggagggctgcctacaccatcatcaacggaaaccccgggcagagctttgaaatccacaccaaccctcaaaccaacgaagggatgctttctgttgtcaaaccattggactatgaaatttctgccttccacaccctgctgatcaaagtggaaaatgaagacccactcgtacccgacgtctcctacggccccagctccacagccaccgtccacatcactgtcctggatgtcaacgagggcccagtcttctacccagaccccatgatggtgaccaggcaggaggacctctctgtgggcagcgtgctgctgacagtgaatgccacggaccccgactccctgcagcatcaaaccatcaggtattctgtttacaaggacccagcaggttggctgaatattaaccccatcaatgggactgttgacaccacagctgtgctggaccgtgagtccccatttgtcgacaacagcgtgtacactgctctcttcctggcaattgacagtggcaaccctcccgctacgggcactgggactttgctgataaccctggaggacgtgaatgacaatgccccgttcatttaccccacagtagctgaagtctgtgatgatgccaaaaacctcagtgtagtcattttgggagcatcagataaggatcttcacccgaatacagatcctttcaaatttgaaatccacaaacaagctgttcctgataaagtctggaagatctccaagatcaacaatacacacgccctggtaagccttcttcaaaatctgaacaaagcaaactacaacctgcccatcatggtgacagattcagggaaaccacccatgacgaatatcacagatctcagggtacaagtgtgctcctgcaggaattccaaagtggactgcaacgcggcaggggccctgcgcttcagcctgccctcagtcctgctcctcagcctcttcagcttagcttgtaag

SEQ ID NO: 669 - DNA, 2139 bp, Homo sapiens
atgcagccgagaactccgctcgttctgtgcgttctcctgtcccaggtgctgctgctaacatctgcagaagatttggactgcactcctggatttcagcagaaagtgttccatatcaatcagccagctgaattcattgaggaccagtcaattctaaacttgaccttcagtgactgtaagggaaacgacaagctacgctatgaggtctcgagcccatacttcaaggtgaacagcgatggcggcttagttgctctgagaaacataactgcagtgggcaaaactctgttcgtccatgcacggaccccccatgcggaagatatggcagaactcgtgattgtcggggggaaagacatccagggctccttgcaggatatatttaaatttgcaagaacttctcctgtcccaagacaaaagaggtccattgtggtatctcccattttaattccagagaatcagagacagcctttcccaagagatgttggcaaggtagtcgatagtgacaggccagaaaggtccaagttccggctcactggaaagggagtggatcaagagcctaaaggaattttcagaatcaatgagaacacagggagcgtctccgtgacacggaccttggacagagaagtaatcgctgtttatcaactatttgtggagaccactgatgtcaatggcaaaactctcgaggggccggtgcctctggaagtcattgtgattgatcagaatgacaaccgaccgatctttcgggaaggcccctacatcggccacgtcatggaagggtcacccacaggcaccacagtgatgcggatgacagcctttgatgcagatgacccagccaccgataatgccctcctgcggtataatatccgtcagcagacgcctgacaagccatctcccaacatgttctacatcgatcctgagaaaggagacattgtcactgttgtgtcacctgcgctgctggaccgagagactctggaaaatcccaagtatgaactgatcatcgaggctcaagatatggctggactggatgttggattaacaggcacggccacagccacgatcatgatcgatgacaaaaatgatcactcaccaaaattcaccaagaaagagtttcaagccacagtcgaggaaggagctgtgggagttattgtcaatttgacagttgaagataaggatgaccccaccacaggtgcatggagggctgcctacaccatcatcaacggaaaccccgggcagagctttgaaatccacaccaaccctcaaaccaacgaagggatgctttctgttgtcaaaccattggactatgaaatttctgccttccacaccctgctgatcaaagtggaaaatgaagacccactcgtacccgacgtctcctacggccccagctccacagccaccgtccacatcactgtcctggatgtcaacgagggcccagtcttctacccagaccccatgatggtgaccaggcaggaggacctctctgtgggcagcgtgctgctgacagtgaatgccacggaccccgactccctgcagcatcaaaccatcaggtattctgtttacaaggacccagcaggttggctgaatattaaccccatcaatgggactgttgacaccacagctgtgctggaccgtgagtccccatttgtcgacaacagcgtgtacactgctctcttcctggcaattgacagtggcaaccctcccgctacgggcactgggactttgctgataaccctggaggacgtgaatgacaatgccccgttcatttaccccacagtagctgaagtctgtgatgatgccaaaaacctcagtgtagtcattttgggagcatcagataaggatcttcacccgaatacagatcctttcaaatttgaaatccacaaacaagctgttcctgataaagtctggaagatctccaagatcaacaatacacacgccctggtaagccttcttcaaaatctgaacaaagcaaactacaacctgcccatcatggtgacagattcagggaaaccacccatgacgaatatcacagatctcagggtacaagtgtgctcctgcaggaattccaaagtggactgcaacgcggcaggggccctgcgcttcagcctgccctcagtcctgctcctcagcctcttcagcttagcttgtaag

SEQ ID NO: 670 - DNA, 573 bp, Homo sapiens
atgcagccgagaactccgctcgttctgtgcgttctcctgtcccaggtgctgctgctaacatctgcagaagatttggactgcactcctggatttcagcagaaagtgttccatatcaatcagccagctgaattcattgaggaccagtcaattctaaacttgaccttcagtgactgtaagggaaacgacaagctacgctatgaggtctcgagcccatacttcaaggtgaacagcgatggcggcttagttgctctgagaaacataactgcagtgggcaaaactctgttcgtccatgcacggaccccccatgcggaagatatggcagaactcgtgattgtcggggggaaagacatccagggctccttgcaggatatatttaaatttgcaagaacttctcctgtcccaagacaaaagaggtccattgtggtatctcccattttaattccagagaatcagagacagcctttcccaagagatgttggcaagagaacccacaatcctattaacagcgaacttctcttgaatgaaggcattacagcagatttaaatccatgcattacaattttagcaatttaa

SEQ ID NO: 671 - DNA, 528 bp, Homo sapiens
atgcagccgagaactccgctcgttctgtgcgttctcctgtcccaggtgctgctgctaacatctgcagaagatttggactgcactcctggatttcagcagaaagtgttccatatcaatcagccagctgaattcattgaggaccagtcaattctaaacttgaccttcagtgactgtaagggaaacgacaagctacgctatgaggtctcgagcccatacttcaaggtgaacagcgatggcggcttagttgctctgagaaacataactgcagtgggcaaaactctgttcgtccatgcacggaccccccatgcggaagatatggcagaactcgtgattgtcggggggaaagacatccagggctccttgcaggatatatttaaatttgcaagaacttctcctgtcccaagacaaaagaggtccattgtggtatctcccattttaattccagagaatcagagacagcctttcccaagagatgttggcaagatgaagatttggcaagttctgtgcctagcacgatggctgacatga

SEQ ID NO: 672 - DNA, 2022 bp, Homo sapiens
atgcagccgagaactccgctcgttctgtgcgttctcctgtcccaggtgctgctgctaacatctgcagaagatttggactgcactcctggatttcagcagaaagtgttccatatcaatcagccagctgaattcattgaggaccagtcaattctaaacttgaccttcagtgactgtaagggaaacgacaagctacgctatgaggtctcgagcccatacttcaaggtgaacagcgatggcggcttagttgctctgagaaacataactgcagtgggcaaaactctgttcgtccatgcacggaccccccatgcggaagatatggcagaactcgtgattgtcggggggaaagacatccagggctccttgcaggtagtcgatagtgacaggccagaaaggtccaagttccggctcactggaaagggagtggatcaagagcctaaaggaattttcagaatcaatgagaacacagggagcgtctccgtgacacggaccttggacagagaagtaatcgctgtttatcaactatttgtggagaccactgatgtcaatggcaaaactctcgaggggccggtgcctctggaagtcattgtgattgatcagaatgacaaccgaccgatctttcgggaaggcccctacatcggccacgtcatggaagggtcacccacaggcaccacagtgatgcggatgacagcctttgatgcagatgacccagccaccgataatgccctcctgcggtataatatccgtcagcagacgcctgacaagccatctcccaacatgttctacatcgatcctgagaaaggagacattgtcactgttgtgtcacctgcgctgctggaccgagagactctggaaaatcccaagtatgaactgatcatcgaggctcaagatatggctggactggatgttggattaacaggcacggccacagccacgatcatgatcgatgacaaaaatgatcactcaccaaaattcaccaagaaagagtttcaagccacagtcgaggaaggagctgtgggagttattgtcaatttgacagttgaagataaggatgaccccaccacaggtgcatggagggctgcctacaccatcatcaacggaaaccccgggcagagctttgaaatccacaccaaccctcaaaccaacgaagggatgctttctgttgtcaaaccattggactatgaaatttctgccttccacaccctgctgatcaaagtggaaaatgaagacccactcgtacccgacgtctcctacggccccagctccacagccaccgtccacatcactgtcctggatgtcaacgagggcccagtcttctacccagaccccatgatggtgaccaggcaggaggacctctctgtgggcagcgtgctgctgacagtgaatgccacggaccccgactccctgcagcatcaaaccatcaggtattctgtttacaaggacccagcaggttggctgaatattaaccccatcaatgggactgttgacaccacagctgtgctggaccgtgagtccccatttgtcgacaacagcgtgtacactgctctcttcctggcaattgacagtggcaaccctcccgctacgggcactgggactttgctgataaccctggaggacgtgaatgacaatgccccgttcatttaccccacagtagctgaagtctgtgatgatgccaaaaacctcagtgtagtcattttgggagcatcagataaggatcttcacccgaatacagatcctttcaaatttgaaatccacaaacaagctgttcctgataaagtctggaagatctccaagatcaacaatacacacgccctggtaagccttcttcaaaatctgaacaaagcaaactacaacctgcccatcatggtgacagattcagggaaaccacccatgacgaatatcacagatctcagggtacaagtgtgctcctgcaggaattccaaagtggactgcaacgcggcaggggccctgcgcttcagcctgccctcagtcctgctcctcagcctcttcagcttagcttgtaag

SEQ ID NO: 673 - DNA, 1245 bp, Homo sapiens
atgcagccgagaactccgctcgttctgtgcgttctcctgtcccaggtagcgctgctggaccgagagactctggaaaatcccaagtatgaactgatcatcgaggctcaagatatggctggactggatgttggattaacaggcacggccacagccacgatcatgatcgatgacaaaaatgatcactcaccaaaattcaccaagaaagagtttcaagccacagtcgaggaaggagctgtgggagttattgtcaatttgacagttgaagataaggatgaccccaccacaggtgcatggagggctgcctacaccatcatcaacggaaaccccgggcagagctttgaaatccacaccaaccctcaaaccaacgaagggatgctttctgttgtcaaaccattggactatgaaatttctgccttccacaccctgctgatcaaagtggaaaatgaagacccactcgtacccgacgtctcctacggccccagctccacagccaccgtccacatcactgtcctggatgtcaacgagggcccagtcttctacccagaccccatgatggtgaccaggcaggaggacctctctgtgggcagcgtgctgctgacagtgaatgccacggaccccgactccctgcagcatcaaaccatcaggtattctgtttacaaggacccagcaggttggctgaatattaaccccatcaatgggactgttgacaccacagctgtgctggaccgtgagtccccatttgtcgacaacagcgtgtacactgctctcttcctggcaattgacagtggcaaccctcccgctacgggcactgggactttgctgataaccctggaggacgtgaatgacaatgccccgttcatttaccccacagtagctgaagtctgtgatgatgccaaaaacctcagtgtagtcattttgggagcatcagataaggatcttcacccgaatacagatcctttcaaatttgaaatccacaaacaagctgttcctgataaagtctggaagatctccaagatcaacaatacacacgccctggtaagccttcttcaaaatctgaacaaagcaaactacaacctgcccatcatggtgacagattcagggaaaccacccatgacgaatatcacagatctcagggtacaagtgtgctcctgcaggaattccaaagtggactgcaacgcggcaggggccctgcgcttcagcctgccctcagtcctgctcctcagcctcttcagcttagcttgtaag

SEQ ID NO: 674 - DNA, 816 bp, Homo sapiens
atgcagccgagaactccgctcgttctgtgcgttctcctgtcccaggtgctgctgctaacatctgcagaagatttggactgcactcctggatttcagcagaaagtgttccatatcaatcagccagctgaattcattgaggaggacctctctgtgggcagcgtgctgctgacagtgaatgccacggaccccgactccctgcagcatcaaaccatcaggtattctgtttacaaggacccagcaggttggctgaatattaaccccatcaatgggactgttgacaccacagctgtgctggaccgtgagtccccatttgtcgacaacagcgtgtacactgctctcttcctggcaattgacagtggcaaccctcccgctacgggcactgggactttgctgataaccctggaggacgtgaatgacaatgccccgttcatttaccccacagtagctgaagtctgtgatgatgccaaaaacctcagtgtagtcattttgggagcatcagataaggatcttcacccgaatacagatcctttcaaatttgaaatccacaaacaagctgttcctgataaagtctggaagatctccaagatcaacaatacacacgccctggtaagccttcttcaaaatctgaacaaagcaaactacaacctgcccatcatggtgacagattcagggaaaccacccatgacgaatatcacagatctcagggtacaagtgtgctcctgcaggaattccaaagtggactgcaacgcggcaggggccctgcgcttcagcctgccctcagtcctgctcctcagcctcttcagcttagcttgtaag

SEQ ID NO: 675 - DNA, 1751 bp, Homo sapiens
gttgtgtcacctgcgctgctggaccgagagactctggaaaatcccaagtatgaactgatcatcgaggctcaagatatggctggactggatgttggattaacaggcacggccacagccacgatcatgatcgatgacaaaaatgatcactcaccaaaattcaccaagaaagagtttcaagccacagtcgaggaaggagctgtgggagttattgtcaatttgacagttgaagataaggatgaccccaccacaggtgcatggagggctgcctacaccatcatcaacggaaaccccgggcagagctttgaaatccacaccaaccctcaaaccaacgaagggatgctttctgttgtcaaaccattggactatgaaatttctgccttccacaccctgctgatcaaagtggaaaatgaagacccactcgtacccgacgtctcctacggccccagctccacagccaccgtccacatcactgtcctggatgtcaacgagggcccagtcttctacccagaccccatgatggtgaccaggcaggaggacctctctgtgggcagcgtgctgctgacagtgaatgccacggaccccgactccctgcagcatcaaaccatcaggtattctgtttacaaggacccagcaggttggctgaatattaaccccatcaatgggactgttgacaccacagctgtgctggaccgtgagtccccatttgtcgacaacagcgtgtacactgctctcttcctggcaattgacagtggcaaccctcccgctacgggcactgggactttgctgataaccctggaggacgtgaatgacaatgccccgttcatttaccccacagtagctgaagtctgtgatgatgccaaaaacctcagtgtagtcattttgggagcatcagataaggatcttcacccgaatacagatcctttcaaatttgaaatccacaaacaagctgttcctgataaagtctggaagatctccaagatcaacaatacacacgccctggtaagccttcttcaaaatctgaacaaagcaaactacaacctgcccatcatggtgacagattcagggaaaccacccatgacgaatatcacagatctcagggtacaagtgtgctcctgcaggaattccaaagtggactgcaacgcggcaggggccctgcgcttcagcctgccctcagtcctgctcctcagcctcttcagcttagcttgtctgtgagaactcctgacgtctgaagcttgactcccaagtttccatagcaacaggaaaaaaaaaaatctatccaaatctgaagattgcggtttacagctatcgaacttcacaactaggcctcaattgttccggttttttattttctttacaatttcacttagtctgtacttcatcattttgacagcatcttcctccctcctttaattaatggaatcttctgaattttccctgaatgtttaaagatcatgacatatgacttgatcttctgggagcaggaacaatgactactttttctggtgtgttaacatgtcgctagccagtgctccaggcacccagctttgtctgtgggttagtattggtgtatgtatgagtatctgtatgtatatatacacggtatttatagagagagactatcctggagaagcctcgttttgatgccattcttccttgcaaggttaagcaaggtgggtggaaactaagacacctgaaccctccagggcctcccgcatcaaggtcagcatgaggacagaccacagagctgtcac

SEQ ID NO: 676 - DNA, 4332 bp, Homo sapiens
cctccaccggccaaggtccccgccgctgcatccctcgcggcttccgctgcgctccgggccggagccgagccgcctgcgctgccacagcagccgcctccacacactcgcagacgctcacacgctctccctccctgttcccccgccccctccccagctccttgatctctgggtctgttttattactcctggtgcgagtcccgcggactccgcggcccgctatttgtcatcagctcgctctccattggcggggagcggagagcagcgaagaagggggtggggaggggaggggaagggaagggggtggaaactgcctggagccgtttctccgcgccgctgttggtgctgccgctgcctcctcctcctccgccgccgccgccgccgccgccgcctcctccggctcttcgctcggcccctctccgcctccatgtgccggatagcgggagcgctgcggaccctgctgccgctgctggcggccctgcttcaggcgtctgtagaggcttctggtgaaatcgcattatgcaagactggatttcctgaagatgtttacagtgcagtcttatcgaaggatgtgcatgaaggacagcctcttctcaatgtgaagtttagcaactgcaatggaaaaagaaaagtacaatatgagagcagtgagcctgcagattttaaggtggatgaagatggcatggtgtatgccgtgagaagctttccactctcttctgagcatgccaagttcctgatatatgcccaagacaaagagacccaggaaaagtggcaagtggcagtaaaattgagcctgaagccaaccttaactgaggagtcagtgaaggagtcagcagaagttgaagaaatagtgttcccaagacaattcagtaagcacagtggccacctacaaaggcagaagagagactgggtcatccctccaatcaacttgccagaaaactccaggggaccttttcctcaagagcttgtcaggatcaggtctgatagagataaaaacctttcactgcggtacagtgtaactgggccaggagctgaccagcctccaactggtatcttcattatcaaccccatctcgggtcagctgtcggtgacaaagcccctggatcgcgagcagatagcccggtttcatttgagggcacatgcagtagatattaatggaaatcaagtggagaaccccattgacattgtcatcaatgttattgacatgaatgacaacagacctgagttcttacaccaggtttggaatgggacagttcctgagggatcaaagcctggaacatatgtgatgaccgtaacagcaattgatgctgacgatcccaatgccctcaatgggatgttgaggtacagaatcgtgtctcaggctccaagcaccccttcacccaacatgtttacaatcaacaatgagactggtgacatcatcacagtggcagctggacttgatcgagaaaaagtgcaacagtatacgttaataattcaagctacagacatggaaggcaatcccacatatggcctttcaaacacagccacggccgtcatcacagtgacagatgtcaatgacaatcctccagagtttactgccatgacgttttatggtgaagttcctgagaacagggtagacatcatagtagctaatctaactgtgaccgataaggatcaaccccatacaccagcctggaacgcagtgtacagaatcagtggcggagatcctactggacggttcgccatccagaccgacccaaacagcaacgacgggttagtcaccgtggtcaaaccaatcgactttgaaacaaataggatgtttgtccttactgttgctgcagaaaatcaagtgccattagccaagggaattcagcacccccctcagtcaactgcaaccgtgtctgttacagttattgacgtaaatgaaaacccttattttgcccccaatcctaagatcattcgccaagaagaagggcttcatgccggtaccatgttgacaacattcactgctcaggacccagatcgatatatgcagcaaaatattagatacactaaattatctgatcctgccaattggctaaaaatagatcctgtgaatggacaaataactacaattgctgttttggaccgagaatcaccaaatgtgaaaaacaatatatataatgctactttccttgcttctgacaatggaattcctcctatgagtggaacaggaacgctgcagatctatttacttgatattaatgacaatgcccctcaagtgttacctcaagaggcagagacttgcgaaactccagaccccaattcaattaatattacagcacttgattatgacattgatccaaatgctggaccatttgcttttgatcttcctttatctccagtgactattaagagaaattggaccatcactcggcttaatggtgattttgctcagcttaatttaaagataaaatttcttgaagctggtatctatgaagttcccatcataatcacagattcgggtaatcctcccaaatcaaatatttccatcctgcgtgtgaaggtttgccagtgtgactccaacggggactgcacagatgtggacaggattgtgggtgcggggcttggcaccggtgccatcattgccatcctgctctgcatcatcatcctgcttatccttgtgctgatgtttgtggtatggatgaaacgccgggataaagaacgccaggccaaacaacttttaattgatccagaagatgatgtaagagataatattttaaaatatgatgaagaaggtggaggagaagaagaccaggactatgacttgagccagctgcagcagcctgacactgtggagcctgatgccatcaagcctgtgggaatccgacgaatggatgaaagacccatccacgccgagccccagtatccggtccgatctgcagccccacaccctggagacattggggacttcattaatgagggccttaaagcggctgacaatgaccccacagctccaccatatgactccctgttagtgtttgactatgaaggcagtggctccactgctgggtccttgagctcccttaattcctcaagtagtggtggtgagcaggactatgattacctgaacgactgggggccacggttcaagaaacttgctgacatgtatggtggaggtgatgactgaacttcagggtgaacttggtttttggacaagtacaaacaatttcaactgatattcccaaaaagcattcagaagctaggctttaactttgtagtctactagcacagtgcttgctggaggctttggcataggctgcaaaccaatttgggctcagagggaatatcagtgatccatactgtttggaaaaacactgagctcagttacacttgaattttacagtacagaagcactgggattttatgtgcctttttgtacctttttcagattggaattagttttctgtttaaggctttaatggtactgatttctgaaacgataagtaaaagacaaaatattttgtggtgggagcagtaagttaaaccatgatatgcttcaacacgcttttgttacattgcatttgcttttattaaaatacaaaattaaacaaacaaaaaaactcatggagcgattttattatcttgggggatgagaccatgagattggaaaatgtacattacttctagttttagactttagtttgtttttttttttttcactaaaatcttaaaacttactcagctggttgcaaataaagggagttttcatatcaccaatttgtagcaaaattgaattttttcataaactagaatgttagacacattttggtcttaatccatgtacacttttttatttctgtatttttccacttcactgtaaaaatagtatgtgtacataatgttttattggcatagtctatggagaagtgcagaaacttcagaacatgtgtatgtattatttggactatggattcaggttttttgcatgtttatatctttcgttatggataaagtatttacaaaacagtgacatttgattcaattgttgagctgtagttagaatactcaatttttaatttttttaatttttttattttttattttctttttggtttggggagggagaaaagttcttagcacaaatgttttacataatttgtaccaaaaaaaaaaaaaaaggaaaggaaagaaaggggtggcctgacactggtggcactactaagtgtgtgtttttttaaaaaaaaaatggaaaaaaaaaagcttttaaactggagagacttctgacaacagctttgcctctgtattgtgtaccagaatataaatgatacacctctgaccccagcgttctgaataaaatgctaattttggatctgg

SEQ ID NO: 677 - DNA, 3737 bp, Homo sapiens
aagcagaaggaattatgggaaatggaaacttgatggcatgtttttattaaggcgttatgtgtgtatcttcactgagaaattaaagaaccaagcagaattgtatgttttcctttcagtgaagtttagcaactgcaatggaaaaagaaaagtacaatatgagagcagtgagcctgcagattttaaggtggatgaagatggcatggtgtatgccgtgagaagctttccactctcttctgagcatgccaagttcctgatatatgcccaagacaaagagacccaggaaaagtggcaagtggcagtaaaattgagcctgaagccaaccttaactgaggagtcagtgaaggagtcagcagaagttgaagaaatagtgttcccaagacaattcagtaagcacagtggccacctacaaaggcagaagagagactgggtcatccctccaatcaacttgccagaaaactccaggggaccttttcctcaagagcttgtcaggatcaggtctgatagagataaaaacctttcactgcggtacagtgtaactgggccaggagctgaccagcctccaactggtatcttcattatcaaccccatctcgggtcagctgtcggtgacaaagcccctggatcgcgagcagatagcccggtttcatttgagggcacatgcagtagatattaatggaaatcaagtggagaaccccattgacattgtcatcaatgttattgacatgaatgacaacagacctgagttcttacaccaggtttggaatgggacagttcctgagggatcaaagcctggaacatatgtgatgaccgtaacagcaattgatgctgacgatcccaatgccctcaatgggatgttgaggtacagaatcgtgtctcaggctccaagcaccccttcacccaacatgtttacaatcaacaatgagactggtgacatcatcacagtggcagctggacttgatcgagaaaaagtgcaacagtatacgttaataattcaagctacagacatggaaggcaatcccacatatggcctttcaaacacagccacggccgtcatcacagtgacagatgtcaatgacaatcctccagagtttactgccatgacgttttatggtgaagttcctgagaacagggtagacatcatagtagctaatctaactgtgaccgataaggatcaaccccatacaccagcctggaacgcagtgtacagaatcagtggcggagatcctactggacggttcgccatccagaccgacccaaacagcaacgacgggttagtcaccgtggtcaaaccaatcgactttgaaacaaataggatgtttgtccttactgttgctgcagaaaatcaagtgccattagccaagggaattcagcacccccctcagtcaactgcaaccgtgtctgttacagttattgacgtaaatgaaaacccttattttgcccccaatcctaagatcattcgccaagaagaagggcttcatgccggtaccatgttgacaacattcactgctcaggacccagatcgatatatgcagcaaaatattagatacactaaattatctgatcctgccaattggctaaaaatagatcctgtgaatggacaaataactacaattgctgttttggaccgagaatcaccaaatgtgaaaaacaatatatataatgctactttccttgcttctgacaatggaattcctcctatgagtggaacaggaacgctgcagatctatttacttgatattaatgacaatgcccctcaagtgttacctcaagaggcagagacttgcgaaactccagaccccaattcaattaatattacagcacttgattatgacattgatccaaatgctggaccatttgcttttgatcttcctttatctccagtgactattaagagaaattggaccatcactcggcttaatggtgattttgctcagcttaatttaaagataaaatttcttgaagctggtatctatgaagttcccatcataatcacagattcgggtaatcctcccaaatcaaatatttccatcctgcgtgtgaaggtttgccagtgtgactccaacggggactgcacagatgtggacaggattgtgggtgcggggcttggcaccggtgccatcattgccatcctgctctgcatcatcatcctgcttatccttgtgctgatgtttgtggtatggatgaaacgccgggataaagaacgccaggccaaacaacttttaattgatccagaagatgatgtaagagataatattttaaaatatgatgaagaaggtggaggagaagaagaccaggactatgacttgagccagctgcagcagcctgacactgtggagcctgatgccatcaagcctgtgggaatccgacgaatggatgaaagacccatccacgccgagccccagtatccggtccgatctgcagccccacaccctggagacattggggacttcattaatgagggccttaaagcggctgacaatgaccccacagctccaccatatgactccctgttagtgtttgactatgaaggcagtggctccactgctgggtccttgagctcccttaattcctcaagtagtggtggtgagcaggactatgattacctgaacgactgggggccacggttcaagaaacttgctgacatgtatggtggaggtgatgactgaacttcagggtgaacttggtttttggacaagtacaaacaatttcaactgatattcccaaaaagcattcagaagctaggctttaactttgtagtctactagcacagtgcttgctggaggctttggcataggctgcaaaccaatttgggctcagagggaatatcagtgatccatactgtttggaaaaacactgagctcagttacacttgaattttacagtacagaagcactgggattttatgtgcctttttgtacctttttcagattggaattagttttctgtttaaggctttaatggtactgatttctgaaacgataagtaaaagacaaaatattttgtggtgggagcagtaagttaaaccatgatatgcttcaacacgcttttgttacattgcatttgcttttattaaaatacaaaattaaacaaacaaaaaaactcatggagcgattttattatcttgggggatgagaccatgagattggaaaatgtacattacttctagttttagactttagtttgtttttttttttttcactaaaatcttaaaacttactcagctggttgcaaataaagggagttttcatatcaccaatttgtagcaaaattgaattttttcataaactagaatgttagacacattttggtcttaatccatgtacacttttttatttctgtatttttccacttcactgtaaaaatagtatgtgtacataatgttttattggcatagtctatggagaagtgcagaaacttcagaacatgtgtatgtattatttggactatggattcaggttttttgcatgtttatatctttcgttatggataaagtatttacaaaacagtgacatttgattcaattgttgagctgtagttagaatactcaatttttaatttttttaatttttttattttttattttctttttggtttggggagggagaaaagttcttagcacaaatgttttacataatttgtaccaaaaaaaaaaaaaaaggaaaggaaagaaaggggtggcctgacactggtggcactactaagtgtgtgtttttttaaaaaaaaaatggaaaaaaaaaa

SEQ ID NO: 678 - DNA, 4117 bp, Homo sapiens
ctcgccagcggggtgtggctcccctccaaagacggtcggctgacaggctccacagagctccactcacgctcagccctggacggacaggcagtccaacggaacagaaacatccctcagcccacaggcacgatctgttcctcctgggaagatgcagaggctcatgatgctcctcgccacatcgggcgcctgcctgggcctgctggcagtggcagcagtggcagcagcaggtgctaaccctgcccaacgggacacccacagcctgctgcccacccaccggcgccaaaagagagattggatttggaaccagatgcacattgatgaagagaaaaacacctcacttccccatcatgtaggcaagatcaagtcaagcgtgagtcgcaagaatgccaagtacctgctcaaaggagaatatgtgggcaaggtcttccgggtcgatgcagagacaggagacgtgttcgccattgagaggctggaccgggagaatatctcagagtaccacctcactgctgtcattgtggacaaggacactggcgaaaacctggagactccttccagcttcaccatcaaagttcatgacgtgaacgacaactggcctgtgttcacgcatcggttgttcaatgcgtccgtgcctgagtcgtcggctgtggggacctcagtcatctctgtgacagcagtggatgcagacgaccccactgtgggagaccacgcctctgtcatgtaccaaatcctgaaggggaaagagtattttgccatcgataattctggacgtattatcacaataacgaaaagcttggaccgagagaagcaggccaggtatgagatcgtggtggaagcgcgagatgcccagggcctccggggggactcgggcacggccaccgtgctggtcactctgcaagacatcaatgacaacttccccttcttcacccagaccaagtacacatttgtcgtgcctgaagacacccgtgtgggcacctctgtgggctctctgtttgttgaggacccagatgagccccagaaccggatgaccaagtacagcatcttgcggggcgactaccaggacgctttcaccattgagacaaaccccgcccacaacgagggcatcatcaagcccatgaagcctctggattatgaatacatccagcaatacagcttcatcgtcgaggccacagaccccaccatcgacctccgatacatgagccctcccgcgggaaacagagcccaggtcattatcaacatcacagatgtggacgagccccccattttccagcagcctttctaccacttccagctgaaggaaaaccagaagaagcctctgattggcacagtgctggccatggaccctgatgcggctaggcatagcattggatactccatccgcaggaccagtgacaagggccagttcttccgagtcacaaaaaagggggacatttacaatgagaaagaactggacagagaagtctacccctggtataacctgactgtggaggccaaagaactggattccactggaacccccacaggaaaagaatccattgtgcaagtccacattgaagttttggatgagaatgacaatgccccggagtttgccaagccctaccagcccaaagtgtgtgagaacgctgtccatggccagctggtcctgcagatctccgcaatagacaaggacataacaccacgaaacgtgaagttcaaattcatcttgaatactgagaacaactttaccctcacggataatcacgataacacggccaacatcacagtcaagtatgggcagtttgaccgggagcataccaaggtccacttcctacccgtggtcatctcagacaatgggatgccaagtcgcacgggcaccagcacgctgaccgtggccgtgtgcaagtgcaacgagcagggcgagttcaccttctgcgaggatatggccgcccaggtgggcgtgagcatccaggcagtggtagccatcttactctgcatcctcaccatcacagtgatcaccctgctcatcttcctgcggcggcggctccggaagcaggcccgcgcgcacggcaagagcgtgccggagatccacgagcagctggtcacctacgacgaggagggcggcggcgagatggacaccaccagctacgatgtgtcggtgctcaactcggtgcgccgcggcggggccaagcccccgcggcccgcgctggacgcccggccttccctctatgcgcaggtgcagaagccaccgaggcacgcgcctggggcacacggagggcccggggagatggcagccatgatcgaggtgaagaaggacgaggcggaccacgacggcgacggccccccctacgacacgctgcacatctacggctacgagggctccgagtccatagccgagtccctcagctccctgggcaccgactcatccgactctgacgtggattacgacttccttaacgactggggacccaggtttaagatgctggctgagctgtacggctcggacccccgggaggagctgctgtattaggcggccgaggtcactctgggcctggggacccaaaccccctgcagcccaggccagtcagacgccaggcaccacagcctccaaaaatggcagtgactccccagcccagcaccccttcctcgtgggtcccagagacctcatcagccttgggatagcaaactccaggttcctgaaatatccaggaatatatgtcagtgatgactattctcaaatgctggcaaatccaggctggtgttctgtctgggctcagacatccacataaccctgtcacccacagaccgccgtctaactcaaagacttcctctggctccccaaggctgcaaagcaaaacagactgtgtttaactgctgcagggtctttttctagggtccctgaacgccctggtaaggctggtgaggtcctggtgcctatctgcctggaggcaaaggcctggacagcttgacttgtggggcaggattctctgcagcccattcccaagggagactgaccatcatgccctctctcgggagccctagccctgctccaactccatactccactccaagtgccccaccactccccaacccctctccaggcctgtcaagagggaggaaggggccccatggcagctcctgaccttgggtcctgaagtgacctcactggcctgccatgccagtaactgtgctgtactgagcactgaaccacattcagggaaatggcttattaaactttgaagcaactgtgaattcattctggaggggcagtggagatcaggagtgacagatcacagggtgagggccacctccacacccaccccctctggagaaggcctggaagagctgagaccttgctttgagactcctcagcacccctccagttttgcctgagaaggggcagatgttcccggagcagaagacgtctccccttctctgcctcacctggtcgccaatccatgctctctttcttttctctgtctactccttatcccttggtttagaggaacccaagatgtggcctttagcaaaactggacaatgtccaaacccactcatgactgcatgacggagccgagccatgtgtctttacacctcgctgttgtcacatctcagggaactgaccctcaggcacaccttgcagaaggcaaggccctgccctgcccaacctctgtggtcacccatgcatcttccactggaacgtttcactgcaaacacaccttggagaagtggcatcagtcaacagagaggggcagggaaggagacaccaagctcacccttcgtcatggaccgaggttcccactctgggcaaagcccctcacactgcaagggattgtagataacactgacttgtttgttttaaccaataactagcttcttataatgatttttttactaatgatacttacaagtttctagctctcacagacatatagaataagggtttttgcataataagcaggttgttatttaggttaacaatattaattcaggttttttagttggaaaaacaattcctgtaaccttctattttctataattgtagtaattgctctacagataatgtctatatattggccaaactggtgcatgacaagtactgtatttttttatacctaaataaagaaaaatctttagcctgggca

SEQ ID NO: 679 - DNA, 2464 bp, Homo sapiens
gcagtccaacggaacagaaacatccctcagcccacaggcacgatctgttcctcctgggaagatgcagaggctcatgatgctcctcgccacatcgggcgcctgcctgggcctgctggcagtggcagcagtggcagcagcaggtgctaaccctgcccaacgggacacccacagcctgctgcccacccaccggcgccaaaagagagattggatttggaaccagatgcacattgatgaagagaaaaacacctcacttccccatcatgtaggcaagatcaagtcaagcgtgagtcgcaagaatgccaagtacctgctcaaaggagaatatgtgggcaaggtcttccgggtcgatgcagagacaggagacgtgttcgccattgagaggctggaccgggagaatatctcagagtaccacctcactgctgtcattgtggacaaggacactggcgaaaacctggagactccttccagcttcaccatcaaagttcatgacgtgaacgacaactggcctgtgttcacgcatcggttgttcaatgcgtccgtgcctgagtcgtcggctgtggggacctcagtcatctctgtgacagcagtggatgcagacgaccccactgtgggagaccacgcctctgtcatgtaccaaatcctgaaggggaaagagtattttgccatcgataattctggacgtattatcacaataacgaaaagcttggaccgagagaagcaggccaggtatgagatcgtggtggaagcgcgagatgcccagggcctccggggggactcgggcacggccaccgtgctggtcactctgcaagacatcaatgacaacttccccttcttcacccagaccaagtacacatttgtcgtgcctgaagacacccgtgtgggcacctctgtgggctctctgtttgttgaggacccagatgagccccagaaccggatgaccaagtacagcatcttgcggggcgactaccaggacgctttcaccattgagacaaaccccgcccacaacgagggcatcatcaagcccatgaagcctctggattatgaatacatccagcaatacagcttcatcgtcgaggccacagaccccaccatcgacctccgatacatgagccctcccgcgggaaacagagcccaggtcattatcaacatcacagatgtggacgagccccccattttccagcagcctttctaccacttccagctggtcctgcagatctccgcaatagacaaggacataacaccacgaaacgtgaagttcaaattcatcttgaatactgagaacaactttaccctcacggataatcacgataacacggccaacatcacagtcaagtatgggcagtttgaccgggagcataccaaggtccacttcctacccgtggtcatctcagacaatgggatgccaagtcgcacgggcaccagcacgctgaccgtggccgtgtgcaagtgcaacgagcagggcgagttcaccttctgcgaggatatggccgcccaggtgggcgtgagcatccaggcagtggtagccatcttactctgcatcctcaccatcacagtgatcaccctgctcatcttcctgcggcggcggctccggaagcaggcccgcgcgcacggcaagagcgtgccggagatccacgagcagctggtcacctacgacgaggagggcggcggcgagatggacaccaccagctacgatgtgtcggtgctcaactcggtgcgccgcggcggggccaagcccccgcggcccgcgctggacgcccggccttccctctatgcgcaggtgcagaagccaccgaggcacgcgcctggggcacacggagggcccggggagatggcagccatgatcgaggtgaagaaggacgaggcggaccacgacggcgacggccccccctacgacacgctgcacatctacggctacgagggctccgagtccatagccgagtccctcagctccctgggcaccgactcatccgactctgacgtggattacgacttccttaacgactggggacccaggtttaagatgctggctgagctgtacggctcggacccccgggaggagctgctgtattaggcggccgaggtcactctgggcctggggacccaaaccccctgcagcccaggccagtcagacgccaggcaccacagcctccaaaaatggcagtgactccccagcccagcaccccttcctcgtgggtcccagagacctcatcagccttgggatagcaaactccaggttcctgaaatatccaggaatatatgtcagtgatgactattctcaaatgctggcaaatccaggctggtgttctgtctgggctcagacatccacataaccctgtcacccacagaccgccgtctaactcaaagacttcctctggctccccaaggctgcaaagcaaaacagactgtgtttaactgctgcagggtctttttctagggtccctgaacgccctggtaaggctggtga

SEQ ID NO: 680 - DNA, 1672 bp, Homo sapiens
ataatgtgtagactcaagcctttcttcagatcaggaaacttttcttttctttttttttttttttttttttgttatttcttctgttctgtttgttctgggattttcctcattaatagcaactattattcctatatacacaaaacatatatatttatctttccatagatttttcctgatttctgaaagaactttttaagttttttatttcacaaagttaatttctttgtaattacttcttatctcttccagctctttttgtattccttcctggctcttgcccaatgatcttttcattaatcactaaaacaagtcccagctatggtgtgatgtcacctgttcagctctgaaagtgcatctgatggtctcagatactccatccgcaggaccagtgacaagggccagttcttccgagtcacaaaaaagggggacatttacaatgagaaagaactggacagagaagtctacccctggtataacctgactgtggaggccaaagaactggattccactggaacccccacaggaaaagaatccattgtgcaagtccacattgaagttttggatgagaatgacaatgccccggagtttgccaagccctaccagcccaaagtgtgtgagaacgctgtccatggccagctggtcctgcagatctccgcaatagacaaggacataacaccacgaaacgtgaagttcaaattcatcttgaatactgagaacaactttaccctcacggataatcacgataacacggccaacatcacagtcaagtatgggcagtttgaccgggagcataccaaggtccacttcctacccgtggtcatctcagacaatgggatgccaagtcgcacgggcaccagcacgctgaccgtggccgtgtgcaagtgcaacgagcagggcgagttcaccttctgcgaggatatggccgcccaggtgggcgtgagcatccaggcagtggtagccatcttactctgcatcctcaccatcacagtgatcaccctgctcatcttcctgcggcggcggctccggaagcaggcccgcgcgcacggcaagagcgtgccggagatccacgagcagctggtcacctacgacgaggagggcggcggcgagatggacaccaccagctacgatgtgtcggtgctcaactcggtgcgccgcggcggggccaagcccccgcggcccgcgctggacgcccggccttccctctatgcgcaggtgcagaagccaccgaggcacgcgcctggggcacacggagggcccggggagatggcagccatgatcgaggtgaagaaggacgaggcggaccacgacggcgacggccccccctacgacacgctgcacatctacggctacgagggctccgagtccatagccgagtccctcagctccctgggcaccgactcatccgactctgacgtggattacgacttccttaacgactggggacccaggtttaagatgctggctgagctgtacggctcggacccccgggaggagctgctgtattaggcggccgaggtcactctgggcctggggacccaaaccccctgcagcccaggccagtcagacgccaggcaccacagcctccaaaaatggcagtgactccccagcccagcaccccttcctcgtgggtcccagagacctcatcagccttgggatagcaaactccaggttc

SEQ ID NO: 681 - DNA, 3191 bp, Homo sapiens
atgccaagtacctgctcaaaggagaatatgtgggcaaggtcttccgggtcgatgcagagacaggagacgtgttcgccattgagagcccagaaccggatgaccaagtacagcatcttgcggggcgactaccaggacgctttcaccattgagacaaaccccgcccacaacgagggcatcatcaagcccatgaagcctctggattatgaatacatccagcaatacagcttcatcgtcgaggccacagaccccaccatcgacctccgatacatgagccctcccgcgggaaacagagcccaggtcattatcaacatcacagatgtggacgagccccccattttccagcagcctttctaccacttccagctgaaggaaaaccagaagaagcctctgattggcacagtgctggccatggaccctgatgcggctaggcatagcattggatactccatccgcaggaccagtgacaagggccagttcttccgagtcacaaaaaagggggacatttacaatgagaaagaactggacagagaagtctacccctggtataacctgactgtggaggccaaagaactggattccactggaacccccacaggaaaagaatccattgtgcaagtccacattgaagttttggatgagaatgacaatgccccggagtttgccaagccctaccagcccaaagtgtgtgagaacgctgtccatggccagctggtcctgcagatctccgcaatagacaaggacataacaccacgaaacgtgaagttcaaattcatcttgaatactgagaacaactttaccctcacggataatcacgataacacggccaacatcacagtcaagtatgggcagtttgaccgggagcataccaaggtccacttcctacccgtggtcatctcagacaatgggatgccaagtcgcacgggcaccagcacgctgaccgtggccgtgtgcaagtgcaacgagcagggcgagttcaccttctgcgaggatatggccgcccaggtgggcgtgagcatccaggcagtggtagccatcttactctgcatcctcaccatcacagtgatcaccctgctcatcttcctgcggcggcggctccggaagcaggcccgcgcgcacggcaagagcgtgccggagatccacgagcagctggtcacctacgacgaggagggcggcggcgagatggacaccaccagctacgatgtgtcggtgctcaactcggtgcgccgcggcggggccaagcccccgcggcccgcgctggacgcccggccttccctctatgcgcaggtgcagaagccaccgaggcacgcgcctggggcacacggagggcccggggagatggcagccatgatcgaggtgaagaaggacgaggcggaccacgacggcgacggccccccctacgacacgctgcacatctacggctacgagggctccgagtccatagccgagtccctcagctccctgggcaccgactcatccgactctgacgtggattacgacttccttaacgactggggacccaggtttaagatgctggctgagctgtacggctcggacccccgggaggagctgctgtattaggcggccgaggtcactctgggcctggggacccaaaccccctgcagcccaggccagtcagacgccaggcaccacagcctccaaaaatggcagtgactccccagcccagcaccccttcctcgtgggtcccagagacctcatcagccttgggatagcaaactccaggttcctgaaatatccaggaatatatgtcagtgatgactattctcaaatgctggcaaatccaggctggtgttctgtctgggctcagacatccacataaccctgtcacccacagaccgccgtctaactcaaagacttcctctggctccccaaggctgcaaagcaaaacagactgtgtttaactgctgcagggtctttttctagggtccctgaacgccctggtaaggctggtgaggtcctggtgcctatctgcctggaggcaaaggcctggacagcttgacttgtggggcaggattctctgcagcccattcccaagggagactgaccatcatgccctctctcgggagccctagccctgctccaactccatactccactccaagtgccccaccactccccaacccctctccaggcctgtcaagagggaggaaggggccccatggcagctcctgaccttgggtcctgaagtgacctcactggcctgccatgccagtaactgtgctgtactgagcactgaaccacattcagggaaatggcttattaaactttgaagcaactgtgaattcattctggaggggcagtggagatcaggagtgacagatcacagggtgagggccacctccacacccaccccctctggagaaggcctggaagagctgagaccttgctttgagactcctcagcacccctccagttttgcctgagaaggggcagatgttcccggagcagaagacgtctccccttctctgcctcacctggtcgccaatccatgctctctttcttttctctgtctactccttatcccttggtttagaggaacccaagatgtggcctttagcaaaactggacaatgtccaaacccactcatgactgcatgacggagccgagccatgtgtctttacacctcgctgttgtcacatctcagggaactgaccctcaggcacaccttgcagaaggcaaggccctgccctgcccaacctctgtggtcacccatgcatcttccactggaacgtttcactgcaaacacaccttggagaagtggcatcagtcaacagagaggggcagggaaggagacaccaagctcacccttcgtcatggaccgaggttcccactctgggcaaagcccctcacactgcaagggattgtagataacactgacttgtttgttttaaccaataactagcttcttataatgatttttttactaatgatacttacaagtttctagctctcacagacatatagaataagggtttttgcataataagcaggttgttatttaggttaacaatattaattcaggttttttagttggaaaaacaattcctgtaaccttctattttctataattgtagtaattgctctacagataatgtctatatattggccaaactggtgcatgacaagtactgtatttttttatacctaaataaagaaaaatctttagcctgggc

SEQ ID NO: 682 - DNA, 8476 bp, Homo sapiens
ttcgcatcccaagagctgcagtttcagccgcgacagcaagaacggcagagccggcgaccgcggcggcggcggcggcggaggcaggagcagcctgggcgggtcgcagggtctccgcgggcgcaggaaggcgagcagagatatcctctgagagccaagcaaagaacattaaggaaggaaggaggaatgaggctggatacggtgcagtgaaaaaggcacttccaagagtggggcactcactacgcacagactcgacggtgccatcagcatgagaacttaccgctacttcttgctgctcttttgggtgggccagccctacccaactctctcaactccactatcaaagaggactagtggtttcccagcaaagaaaagggccctggagctctctggaaacagcaaaaatgagctgaaccgttcaaaaaggagctggatgtggaatcagttctttctcctggaggaatacacaggatccgattatcagtatgtgggcaagttacattcagaccaggatagaggagatggatcacttaaatatatcctttcaggagatggagcaggagatctcttcattattaatgaaaacacaggcgacatacaggccaccaagaggctggacagggaagaaaaacccgtttacatccttcgagctcaagctataaacagaaggacagggagacccgtggagcccgagtctgaattcatcatcaagatccatgacatcaatgacaatgaaccaatattcaccaaggaggtttacacagccactgtccctgaaatgtctgatgtcggtacatttgttgtccaagtcactgcgacggatgcagatgatccaacatatgggaacagtgctaaagttgtctacagtattctacagggacagccctatttttcagttgaatcagaaacaggtattatcaagacagctttgctcaacatggatcgagaaaacagggagcagtaccaagtggtgattcaagccaaggatatgggcggccagatgggaggattatctgggaccaccaccgtgaacatcacactgactgatgtcaacgacaaccctccccgattcccccagagtacataccagtttaaaactcctgaatcttctccaccggggacaccaattggcagaatcaaagccagcgacgctgatgtgggagaaaatgctgaaattgagtacagcatcacagacggtgaggggctggatatgtttgatgtcatcaccgaccaggaaacccaggaagggattataactgtcaaaaagctcttggactttgaaaagaagaaagtgtatacccttaaagtggaagcctccaatccttatgttgagccacgatttctctacttggggcctttcaaagattcagccacggttagaattgtggtggaggatgtagatgagccacctgtcttcagcaaactggcctacatcttacaaataagagaagatgctcagataaacaccacaataggctccgtcacagcccaagatccagatgctgccaggaatcctgtcaagtactctgtagatcgacacacagatatggacagaatattcaacattgattctggaaatggttcgatttttacatcgaaacttcttgaccgagaaacactgctatggcacaacattacagtgatagcaacagagatcaataatccaaagcaaagtagtcgagtacctctatatattaaagttctagatgtcaatgacaacgccccagaatttgctgagttctatgaaacttttgtctgtgaaaaagcaaaggcagatcagttgattcagaccctgcatgctgttgacaaggatgacccttatagtggacaccaattttcgttttccttggcccctgaagcagccagtggctcaaactttaccattcaagacaacaaagacaacacggcgggaatcttaactcggaaaaatggctataatagacacgagatgagcacctatctcttgcctgtggtcatttcagacaacgactacccagttcaaagcagcactgggacagtgactgtccgggtctgtgcatgtgaccaccacgggaacatgcaatcctgccatgcggaggcgctcatccaccccacgggactgagcacgggggctctggttgccatccttctgtgcatcgtgatcctactagtgacagtggtgctgtttgcagctctgaggcggcagcgaaaaaaagagcctttgatcatttccaaagaggacatcagagataacattgtcagttacaacgacgaaggtggtggagaggaggacacccaggcttttgatatcggcaccctgaggaatcctgaagccatagaggacaacaaattacgaagggacattgtgcccgaagcccttttcctaccccgacggactccaacagctcgcgacaacaccgatgtcagagatttcattaaccaaaggttaaaggaaaatgacacggaccccactgccccgccatacgactccttggccacttacgcctatgaaggcactggctccgtggcggattccctgagctcgctggagtcagtgaccacggatgcagatcaagactatgattaccttagtgactggggacctcgattcaaaaagcttgcagatatgtatggaggagtggacagtgacaaagactcctaatctgttgcctttttcattttccaatacgacactgaaatatgtgaagtggctatttctttatatttatccactactccgtgaaggcttctctgttctacccgttccaaaagccaatggctgcagtccgtgtggatccaatgttagagacttttttctagtacacttttatgagcttccaaggggcaaatttttattttttagtgcatccagttaaccaagtcagcccaacaggcaggtgccggaggggaggacagggaacagtatttccacttgttctcagggcagcgtgcccgcttccgctgtcctggtgttttactacactccatgtcaggtcagccaactgccctaactgtacatttcacaggctaatgggataaaggactgtgctttaaagataaaaatatcatcatagtaaaagaaatgagggcatatcggctcacaaagagataaactacataggggtgtttatttgtgtcacaaagaatttaaaataacacttgcccatgctatttgttcttcaagaactttctctgccatcaactactattcaaaacctcaaatccacccatatgttaaaattctcattactcttaaggaatagaagcaaattaaacggtaacatccaaaagcaaccacaaacctagtacgacttcattccttccactaactcatagtttgttatatcctagactagacatgcgaaagtttgcctttgtaccatataaagggggagggaaatagctaataatgttaaccaaggaaatatattttaccatacatttaaagttttggccaccacatgtatcacgggtcacttgaaattctttcagctatcagtaggctaatgtcaaaattgtttaaaaattcttgaaagaattttcctgagacaaattttaacttcttgtctatagttgtcagtattattctactatactgtacatgaaagtagcagtgtgaagtacaataattcatattcttcatatccttcttacacgactaagttgaattagtaaagttagattaaataaaacttaaatctcactctaggagttcagtggagaggttagagccagccacacttgaacctaataccctgcccttgacatctggaaacctctacatatttatataacgtgatacatttggataaacaacattgagattatgatgaaaacctacatattccatgtttggaagacccttggaagaggaaaattggattcccttaaacaaaagtgtttaagattgtaattaaaatgatagttgattttcaaaagcattaattttttttcattgtttttaactttgctttcatgaccatcctgccatccttgactttgaactaatgataaagtaatgatctcaaactatgacagaaaagtaatgtaaaatccatccaatctattatttctctaattatgcaattagcctcatagttattatccagaggacccaactgaactgaactaatccttctggcagattcaaatcgtttatttcacacgctgttctaatggcacttatcattagaatcttaccttgtgcagtcatcagaaattccagcgtactataatgaaaacatccttgttttgaaaacctaaaagacaggctctgtatatatatatacttaagaatatgctgacttcacttattagtcttagggatttattttcaattaatattaattttctacaaataattttagtgtcatttccatttggggatattgtcatatcagcacatattttctgtttggaaacacactgttgtttagttaagttttaaataggtgtattacccaagaagtaaagatggaaacgttaaaagaagagaaatgtagtattttgggttacctgattagagtgaaaattttttacaatcatattattccttgtgtcttctgaatggtttccgattttataatggactgccctatatagtaacaagtatttcatgcttgagctatttcctgctttcagggtttcttttttctagttcttcatacacacacatacacacacacacacacacacacacacacacacacgaatgcaaacaaaaggctatatgaggtcttcactctaatgaattgatatgtatcatagtcacaggtaagtgttgaaaaaagcttagtaaagttagaagctacttactcatagcaatagaacagcaccttaatcacacgatttactgtaaaattaaagaggtctctatctgtatgtttcatgtcacgtaacaaattgaatcaaggaagatagtcctgtaaaaagaaaggtatcatctgaagttgaggattgacactagcagtttccaatgtttaaaggtaagatctgagttctcctaataagtaaaagtaagtagttctatagcagaatatctgagatgtaattggcaaggtattttatccctccctgcagatgacacagcataccaagaacaggttaatatgattacttatggaaataactttaatctcttatcataaaagctgatgatgaagtaaatttataggaaattggataatttgagactggggctaaatatttagtaccagggtactgtaagtatcaagttggagtgacgttttcctataattcagactctttgacatcgtggaaccaataagagtcatagttccatcattctccagcttcgtctcacttccttcccaccccacctgagtatcaggtcaaacatcattgcatgcgcaggttttttttttaattgctaggtcccaggcaacatgaaagattattggagaaaaaaataattttcagcccagttttttcattgtctgtttcctaattttagatgttggtgatgggaaagatggaaggagagtgggaagaagtaaaattttaatatttgtttcaatcactttgaaactaaaattcattaagcataaccagattgcttttgtgggttgtttcaaggacattgagagctttctgatgatatgtttttgccctctattcaaaagcaagagttcctttaaactactaagatattccctagaataagctgaatttaaaaaaacattaagccattgtttaaagccccttcacttcctggccacttacttctgaaaggcctaaaaaacatttgtgcccaaataagtaaataaaccaaatgggaaagaagcaaagattattccatagaaccacaagagagggaatgtgggcacagtaaatagatgtttctttcagaactttcctgcctttacagtttgtgtccataaagggatgttcagcaatgaaattactcccttttcagatggaacaaaacctgcccatttaattttaacgcagtataaaaaacgtgtggtttagtttttattttcagctcccaaagagttgtgcagaaaatcttaaaattttttttttttttttttttttttttttgagacagaatctcgctctgtcgcccaggctggaatgcagtggcgcgatctctgctcactacaagctccgcctcccgggttcacgccattctcctgcctcagcgcccccagtagctgggactacaggcacacaccaccacgcccggctaatttttgttgtattttttagtggagacagggtttcaccatgttagccaggatgatctccatctcctgacctcgtggtccgcccgcctcggcctcccaaagtgctgggattacaggcgtgagccaccgcgcccggccttaaaaattgaatctgtagcttaggccatccaaattttataaatccaaattaactttagaatgtttctattactttcacttttacatatataaattttaagtgtcctgattggctgaacaatatctcacatcaaatgctttgcctggaaatagatatcccactggggatagtggtgtgtaaactatgacttggacaattctatatactcaagcaccataaaaagtatgcagttgaaaagaaaatcaaagttgattcctgggtgccaactaaatattcaaatcaggtactcatccttatcagctaaattcattttcaccaggaacagaccaccaaataaattattttatcctaataactagttttgaagcagtgtaattactctggaagaaggctctaaaaagtcatgattcccccactattttgaaatgtatcctctaacaaggatcattatagtgtaatcttaatttttatgttttatcaagatgaaatcttgtttgaattgtgatattataaaaggggactcaaaaatccaagcagtctactgtgtttaaattaacaccacaaccttccttatcagattataagagtagaaaaattaacacttggtgtgtgaatcttcaggaaaatgagctatttcataagctcaaacaagcagcttccttttccagagaatatagaattatattatggtctccttaaatgtttagtagctcttatggtcacagcatttttaatctccctatggcatctttatggaataattttctaaagggtaattctctactaaaaatatcagaccccgaccatatttaatgtggagagcaataccctcttagaaagaaaatacattgactcatacacttgttaaaagttaataaagaaatagctcatttttaaagccggaagtttatggtctctgcatcgtcaatttaatttaagcattgctgagacaatctttaatctactcccctttttgtaataccttatttatggtgcattttcatttttatttgggggaaacgttagcccaacagagccggcagatgaaagtgttgaaaagaggtcaaatggaaacaaaggctcttacccgctgtatttcagacaggactgaggcacttagccgaggagccactgggttattagattaatttcaaaagagcttttacaagttgcttaattcctttttttttttttttttttttcaaaaacccatgaaccacaaactcaaatttctcctcaaatggggttaatctgacaaacgaggcatggacccagccttgtggaaaaagcattccacgctaatgagatcttggtctttcttgtgaggctacgttatttatgtaaatatgtctggaggcaccttctctaagcttttagttttctatgatctattagtttagtgtttattaaagaatcaaatgtatagaattaccaggcattcgtggggaatgctgtgtagcaaatgtaaaactgacctgctcggaagaaacgtaggaacgcttcaaacccactgtaatgtttggtttgagattattttcattgctttgagagtgaactgcctaagagtaggccttataataaatgctatgtgcgtcttcagtagttccaagctaaagcaatttggcattctcccactgtgatttgtgacttttaaacccacaaaataaaagctttttggtattgattgtttttaattaaaaatacttccaagtataaattgaaacggatgccacccttgaagatttactggcgggaatgctcactcttgtcgttttcctcagtatcgttcatgtctttggcaacaagaacacctgatgaaagcaagcaatgctcagttcccatcaacatttctagttagggggattctcataaccccacagtttacctgagaaagttttctgtgttagaagaatggggtcgagagtattaccttttagctcagtgtggccgggccttttgttgcagtcaaatggcaaatacgcactccttgaaatggcttcttttatttggttttgttttcttagacttataaatttgaaaagaatgcaatttaaaaagtgatttctcacaaagagtaaatatgccttttgcaaatcaatttttgtaacaagttatttatatgatattacttaataaactggtttttttctaa

SEQ ID NO: 683 - DNA, 1247 bp, Homo sapiens
ggctgggaacgcctggcagcttttaggagggggcgggcccgggggtggtggccccaggagcggttgccgcggggaccgggcagtgacgcggcccaagggcggaagtgagaaagttgtctgcgtctcgaggcgagttggcggagctgtgcgcgcggcggggcgatggggggctcgggcagtcgcctgtccaaggagctgctggccgagtaccaggacttgacgttcctgacgaagcaggagatcctcctagcccacaggcggttttgtgagctgcttccccaggagcagcggagcgtggagtcgtcacttcgggcacaagtgcccttcgagcagattctcagccttccagagctcaaggccaaccccttcaaggagcgaatctgcagggtcttctccacatccccagccaaagacagccttagctttgaggacttcctggatctcctcagtgtgttcagtgacacagccacgccagacatcaagtcccattatgccttccgcatctttgactttgatgatgacggaaccttgaacagagaagacctgagccggctggtgaactgcctcacgggagagggcgaggacacacggcttagtgcgtctgagatgaagcagctcatcgacaacatcctggaggagtctgacattgacagggatggaaccatcaacctctctgagttccagcacgtcatctcccgttctccagactttgccagctcctttaagattgtcctgtgacagcagccccagcgtgtgtcctggcaccctgtccaagaacctttctactgctgagctgtggccaaggtcaagcctgtgttgccagtgcgggccaagctggcccagcctggagctggcgctgtgcagcctcaccccgggcaggggcggccctcgttgtcagggcctctcctcactgctgttgtcattgctccgtttgtgtttgtactaatcagtaataaaggtttagaagtttgaccctatgtgtgacatgagatacactggtatgaggaaggactggacttctcttctaagagccttcaatcatcctaggaataagcagcatatcgagcagaggccagcgggaagtcaagccgcacccacgctggctgtccccgtgggagggtgtgaggatgaaggggcagcaggaggtgtgggactcgcctgtatcctgattggggtggtggttagatgagtctctgcatgcatcaaaatgtaaagaaccgtacatcagtaaagtctattttactgca

SEQ ID NO: 684 - DNA, 2336 bp, Homo sapiens
cgcggccggcatttctcctcgcagctcgctgcctcctctatccctgcctccctctcccccctctgtttttctcccttccttccctctccgaccctcttcctctccctcccgatcctttccctcctcctctcatctttcccctgtctctccgttctagctcgtcccccaccccaccttttcttctttctcctcctctccttcctctccccctctcctctgtctccttccaccgtctcccctgcctccctgtctttcagtccctgtttttcagccccgtctccctctcggtttctctcccccaccctccctccgggtttcctccccggtgccctccctcctctctccctcccctccccctccgcccctcgcagccccgccgctcgcagctcccagtctgcctccccgaaccggcgccgccgcccgcactcgccgcaggaccggcccgcccggctcccggggtgcgccctcctcggtcccgcgccctccgggctcgcagggacgtctcctccctcccggctcgcggccccgcccggcccggcccccgcccagagccccagcgcgccgaggatgtgagtcctgctcgcctctggcggagcagcagccactcgcgcgcggagccggagcgcagcgcagcgcagccgcgggcgctctccgggccgctcgcgcgagtgccgcgctcttgccctagcggcgtcccccggcctctcgccggcgccaccgccgcagcagcccgcgggccgtccccggccggccgcccccggccccagcgccgctgaccctgtccgccgcgggcggggacgcgggcggaggaggcgccgcggcggagcccccggacgcgaccatgtcggaggtgctgccctacggcgacgagaagctgagcccctacggcgacggcggcgacgtgggccagatcttctcctgccgcctgcaggacaccaacaacttcttcggcgccgggcagaacaagcggccgcccaagctgggccagatcggccggagcaagcgggttgttattgaagatgataggattgatgacgtgctgaaaaatatgaccgacaaggcacctcctggtgtctaactcccccaaagacaatgagttaagggagagaataagaacggcggtaacagttattggcaaaaagcatgaaaagagaaagcactttgaaatttattactagcttgctacccacgatgaaatcaacaacctgtatctggtatcaggccgggagacagatgaggcgagaggaggaggaggaggaggagaaggctctgggctcctctgcaaaaataaaaataaaaaaataaataaaattttaaaaataataaaaattcactatatacacatataaagaaataaaaagaagtctcagttgcagctatttgtcaaaattaatatccatttctttttatatacggtgaatattgcgcaattatagatctggattttgaaccacttaatgaagcggcaacaccaggtgttttgaggtgttggcattcttcgctgatttggctgttcccaatgtttacattatttaatcttgcaaaaatggttctgtgcacttggatgtgaaatgctgtccagttttattttttttatgttgttatccttggatgtacaaaaaattcagaaaatgatctctgtagatattctgttttattttggtcatctttagaagttatcaggaatgtgtttaaaacaagaagagaacttttctaaggaatgatacatagaaaagattttattttaaaatgagttgtaaagcttgtgtttctttgttgctgcaagctatctgcccaagttaatgcaaatggacacattttttatgtcagaaaaacacacacacacacacacacacacacacacacacacgaaaaacaaagaaaaaaatgcttgagctttttctaacttccccttgcagtctgttgtgtgagcagcctgtttatttctctaatattatgtcagtttattctctttaatggactgtaaaaaaatgtaatcacaagagtgccaaatatcttgaaatgccaaaaggcattttagtttcttttctctgtgctctgagtccacgtacaggaatgcttggagtgtcttttctgttatttatagggattctcttaaggcacaccagctgcctgttttgcatggtatttgcaaaaatgcctcttgcgtgaggaaatcttttaccattttttgtttgcaactttggacctcaagaggtttcccttcccttccccgttccctcttttcttaattcaatattctgtatgttgcaccttgaaccagcacacagggctatttctccaatgtacaataaaagaattgttcctgtgtctca

SEQ ID NO: 685 - DNA, 2459 bp, Homo sapiens
tctgggccccagcgaggcggtggggcggggcggggcggggcggggcgcgcagcaggagcgagtggggccgcccgccgggccgcggacactgtcgcccggcgcccaggttcccaacaaggctacgcagaagaacccccttgactgaagcaatggaggggggtccagctgtctgctgccaggatcctcgggcagagctggtagaacgggtggcagccatcgatgtgactcacttggaggaggcagatggtggcccagagcctactagaaacggtgtggaccccccaccacgggccagagctgcctctgtgatccctggcagtacttcaagactgctcccagcccggcctagcctctcagccaggaagctttccctacaggagcggccagcaggaagctatctggaggcgcaggctgggccttatgccacggggcctgccagccacatctccccccgggcctggcggaggcccaccatcgagtcccaccacgtggccatctcagatgcagaggactgcgtgcagctgaaccagtacaagctgcagagtgagattggcaagggtgcctacggtgtggtgaggctggcctacaacgaaagtgaagacagacactatgcaatgaaagtcctttccaaaaagaagttactgaagcagtatggctttccacgtcgccctcccccgagagggtcccaggctgcccagggaggaccagccaagcagctgctgcccctggagcgggtgtaccaggagattgccatcctgaagaagctggaccacgtgaatgtggtcaaactgatcgaggtcctggatgacccagctgaggacaacctctatttggccctgcagaaccaggcccagaatatccagttagattcaacaaatatcgccaagccccactccctgcttccctctgagcagcaagacagtggatccacgtgggctgcgcgctcagtgtttgacctcctgagaaaggggcccgtcatggaagtgccctgtgacaagcccttctcggaggagcaagctcgcctctacctgcgggacgtcatcctgggcctcgagtacttgcactgccagaagatcgtccacagggacatcaagccatccaacctgctcctgggggatgatgggcacgtgaagatcgccgactttggcgtcagcaaccagtttgaggggaacgacgctcagctgtccagcacggcgggaaccccagcattcatggcccccgaggccatttctgattccggccagagcttcagtgggaaggccttggatgtatgggccactggcgtcacgttgtactgctttgtctatgggaagtgcccattcatcgacgatttcatcctggccctccacaggaagatcaagaatgagcccgtggtgtttcctgaggagccagaaatcagcgaggagctcaaggacctgatcctgaagatgttagacaagaatcccgagacgagaattggggtgccagacatcaagttgcacccttgggtgaccaagaacggggaggagccccttccttcggaggaggagcactgcagcgtggtggaggtgacagaggaggaggttaagaactcagtcaggctcatccccagctggaccacggtgatcctggtgaagtccatgctgaggaagcgttcctttgggaacccgtttgagccccaagcacggagggaagagcgatccatgtctgctccaggaaacctactggtgtaagtactggtgggccagggactgccgggcactccctggagttgggtggggaggtctgaggcccatcctcccactctcactgtcgttgggccaaggccagagcctggggacttggccaggtctcggtgttggccccatttgcatctctgtccccaaggttagtcggggctagaagggaccttttgggcccagctcttgcttcattcctggggccagcatccctcacacacacacttccagggatgaggagctcacgcagcccctccatgggacaggaagacccttcttccatgcagcttgatgtcactctctcactgggtccagcccctctggggcttcaaatctgtggccccctcagcccttggcagcctggcagaggtttgcagacaggctgatgttggcttcctgtaggaggctggcgggctgtagaggaggggtgctggcccctctgcctggccctggggactgttggctgctctcccaagtggcccaggctgcctgcagccattgctggggctctgtgcccagtcagcactttgtgagtgcttgttcagtgagtaagcagggacaggctggccggtggaccacgggagaggaacccgcattggccgagggctccctatggtgagccacgcctgtgggttcaccacctcctaggagggtccagaaaagcagctccccaagcctgtgcgcctcgtcctcagcagatccaccttcttcactataataaaagccagtctgggatgctaa

SEQ ID NO: 686 - DNA, 3563 bp, Homo sapiens
tctgggccccagcgaggcggtggggcggggcggggcggggcggggcgcgcagcaggagcgagtggggccgcccgccgggccgcggacactgtcgcccggcgcccaggttcccaacaaggctacgcagaagaacccccttgactgaagcaatggaggggggtccagctgtctgctgccaggatcctcgggcagagctggtagaacgggtggcagccatcgatgtgactcacttggaggaggcagatggtggcccagagcctactagaaacggtgtggaccccccaccacgggccagagctgcctctgtgatccctggcagtacttcaagactgctcccagcccggcctagcctctcagccaggaagctttccctacaggagcggccagcaggaagctatctggaggcgcaggctgggccttatgccacggggcctgccagccacatctccccccgggcctggcggaggcccaccatcgagtcccaccacgtggccatctcagatgcagaggactgcgtgcagctgaaccagtacaagctgcagagtgagattggcaagggtgcctacggtgtggtgaggctggcctacaacgaaagtgaagacagacactatgcaatgaaagtcctttccaaaaagaagttactgaagcagtatggctttccacgtcgccctcccccgagagggtcccaggctgcccagggaggaccagccaagcagctgctgcccctggagcgggtgtaccaggagattgccatcctgaagaagctggaccacgtgaatgtggtcaaactgatcgaggtcctggatgacccagctgaggacaacctctatttggtgtttgacctcctgagaaaggggcccgtcatggaagtgccctgtgacaagcccttctcggaggagcaagctcgcctctacctgcgggacgtcatcctgggcctcgagtacttgcactgccagaagatcgtccacagggacatcaagccatccaacctgctcctgggggatgatgggcacgtgaagatcgccgactttggcgtcagcaaccagtttgaggggaacgacgctcagctgtccagcacggcgggaaccccagcattcatggcccccgaggccatttctgattccggccagagcttcagtgggaaggccttggatgtatgggccactggcgtcacgttgtactgctttgtctatgggaagtgcccattcatcgacgatttcatcctggccctccacaggaagatcaagaatgagcccgtggtgtttcctgaggagccagaaatcagcgaggagctcaaggacctgatcctgaagatgttagacaagaatcccgagacgagaattggggtgccagacatcaagttgcacccttgggtgaccaagaacggggaggagccccttccttcggaggaggagcactgcagcgtggtggaggtgacagaggaggaggttaagaactcagtcaggctcatccccagctggaccacggtgatcctggtgaagtccatgctgaggaagcgttcctttgggaacccgtttgagccccaagcacggagggaagagcgatccatgtctgctccaggaaacctactggtgaaagaagggtttggtgaagggggcaagagcccagagctccccggcgtccaggaagacgaggctgcatcctgagcccctgcatgcacccagggccacccggcagcacactcatcccgcgcctccagaggcccacccctcatgcaacagccgcccccgcaggcagggggctggggactgcagccccactcccgcccctcccccatcgtgctgcatgacctccacgcacgcacgtccagggacagactggaatgtatgtcatttggggtcttgggggcagggctcccacgaggccatcctcctcttcttggacctccttggcctgacccattctgtggggaaaccgggtgcccatggagcctcagaaatgccacccggctggttggcatggcctggggcaggaggcagaggcaggagaccaagatggcaggtggaggccaggcttaccacaacggaagagacctcccgctggggccgggcaggcctggctcagctgccacaggcatatggtggagaggggggtaccctgcccaccttggggtggtggcaccagagctcttgtctattcagacgctggtatgggggctcggacccctcactggggacagggccagtgttggagaattctgattccttttttgttgtcttttacttttgtttttaacctgggggttcggggagaggccctgcttgggaacatctcacgagctttcctacatcttccgtggttcccagcacagcccaagattatttggcagccaagtggatggaactaactttcctggactgtgtttcgcattcggcgttatctggaaagtggactgaacggaatcaagctctgagcagaggcctgaagcggaagcaccacatcgtccctgcccatctcactctctcccttgatgatgcccctagagctgaggctggagaagacaccagggctgactttgaccgagggccatggacgcgacaggcctgtggccctgcgcatgctgaaataactggaacccagcctctcctcctacaccggcctacccatctgggcccaagagctgcactcacactcctacaacgaaggacaaactgtccaggtcggagggatcacgagacacagaacctggaggggtgtgcacgctggcaggtggcctctgcggcaattgcctcaccctgaggacatcagcagtcagcctgctcagagcgggggtgctggagcgcgtgcagacacagctcttccggagcagccttcaccttctctctgggatcagtgtccggctggccgacgtggcatttgctgaccgaatgctcatagaggttgacccccacagggtcacgcaggactcggacactgccctggaaacatggatggacaagggcttttggccacaggtgtgggtgtcctgttggaggagggcttgtttggagaagggaggctggctgggggagaaacccggatcccgctgcatctccgcgcctgtgggtgcatgtcgcgtgctcatctgttgcacacagctcactcgtatgtcctgcactggtacatgcatctgtaatacagtttctacgtctatttaaggctaggagccgaatgtgccccattgtcagtgggtccacgtttctccccggctcctctgggctaaggcagtgtggcccgaagcttaaaaagttactcggtactgtttttaagaacacttttatagagttagtggaaggcaagttaagagccaatcactgatccccaagtgtttcttgagcatctggtctggggggaccactttgatcggacccacccttggaaagctcaggggtaggcccaggtgggatgctcaccctgtcactgagggttttggttggcatcgttgtttttgaatgtagcacaagcgatgagcaaactctataagagtgttttaaaaattaacttcccaggaagtgagttaaaaacaataaaagccctttcttgagttaaaaagaaaaaaaaaa

SEQ ID NO: 687 - DNA, 3509 bp, Homo sapiens
cagcagaacagagtatgcaatttgggaagctgtggtgtggctgcagtggagagttcccaacaaggctacgcagaagaacccccttgactgaagcaatggaggggggtccagctgtctgctgccaggatcctcgggcagagctggtagaacgggtggcagccatcgatgtgactcacttggaggaggcagatggtggcccagagcctactagaaacggtgtggaccccccaccacgggccagagctgcctctgtgatccctggcagtacttcaagactgctcccagcccggcctagcctctcagccaggaagctttccctacaggagcggccagcaggaagctatctggaggcgcaggctgggccttatgccacggggcctgccagccacatctccccccgggcctggcggaggcccaccatcgagtcccaccacgtggccatctcagatgcagaggactgcgtgcagctgaaccagtacaagctgcagagtgagattggcaagggtgcctacggtgtggtgaggctggcctacaacgaaagtgaagacagacactatgcaatgaaagtcctttccaaaaagaagttactgaagcagtatggctttccacgtcgccctcccccgagagggtcccaggctgcccagggaggaccagccaagcagctgctgcccctggagcgggtgtaccaggagattgccatcctgaagaagctggaccacgtgaatgtggtcaaactgatcgaggtcctggatgacccagctgaggacaacctctatttggtgtttgacctcctgagaaaggggcccgtcatggaagtgccctgtgacaagcccttctcggaggagcaagctcgcctctacctgcgggacgtcatcctgggcctcgagtacttgcactgccagaagatcgtccacagggacatcaagccatccaacctgctcctgggggatgatgggcacgtgaagatcgccgactttggcgtcagcaaccagtttgaggggaacgacgctcagctgtccagcacggcgggaaccccagcattcatggcccccgaggccatttctgattccggccagagcttcagtgggaaggccttggatgtatgggccactggcgtcacgttgtactgctttgtctatgggaagtgcccattcatcgacgatttcatcctggccctccacaggaagatcaagaatgagcccgtggtgtttcctgaggagccagaaatcagcgaggagctcaaggacctgatcctgaagatgttagacaagaatcccgagacgagaattggggtgccagacatcaagttgcacccttgggtgaccaagaacggggaggagccccttccttcggaggaggagcactgcagcgtggtggaggtgacagaggaggaggttaagaactcagtcaggctcatccccagctggaccacggtgatcctggtgaagtccatgctgaggaagcgttcctttgggaacccgtttgagccccaagcacggagggaagagcgatccatgtctgctccaggaaacctactggtgaaagaagggtttggtgaagggggcaagagcccagagctccccggcgtccaggaagacgaggctgcatcctgagcccctgcatgcacccagggccacccggcagcacactcatcccgcgcctccagaggcccacccctcatgcaacagccgcccccgcaggcagggggctggggactgcagccccactcccgcccctcccccatcgtgctgcatgacctccacgcacgcacgtccagggacagactggaatgtatgtcatttggggtcttgggggcagggctcccacgaggccatcctcctcttcttggacctccttggcctgacccattctgtggggaaaccgggtgcccatggagcctcagaaatgccacccggctggttggcatggcctggggcaggaggcagaggcaggagaccaagatggcaggtggaggccaggcttaccacaacggaagagacctcccgctggggccgggcaggcctggctcagctgccacaggcatatggtggagaggggggtaccctgcccaccttggggtggtggcaccagagctcttgtctattcagacgctggtatgggggctcggacccctcactggggacagggccagtgttggagaattctgattccttttttgttgtcttttacttttgtttttaacctgggggttcggggagaggccctgcttgggaacatctcacgagctttcctacatcttccgtggttcccagcacagcccaagattatttggcagccaagtggatggaactaactttcctggactgtgtttcgcattcggcgttatctggaaagtggactgaacggaatcaagctctgagcagaggcctgaagcggaagcaccacatcgtccctgcccatctcactctctcccttgatgatgcccctagagctgaggctggagaagacaccagggctgactttgaccgagggccatggacgcgacaggcctgtggccctgcgcatgctgaaataactggaacccagcctctcctcctacaccggcctacccatctgggcccaagagctgcactcacactcctacaacgaaggacaaactgtccaggtcggagggatcacgagacacagaacctggaggggtgtgcacgctggcaggtggcctctgcggcaattgcctcaccctgaggacatcagcagtcagcctgctcagagcgggggtgctggagcgcgtgcagacacagctcttccggagcagccttcaccttctctctgggatcagtgtccggctggccgacgtggcatttgctgaccgaatgctcatagaggttgacccccacagggtcacgcaggactcggacactgccctggaaacatggatggacaagggcttttggccacaggtgtgggtgtcctgttggaggagggcttgtttggagaagggaggctggctgggggagaaacccggatcccgctgcatctccgcgcctgtgggtgcatgtcgcgtgctcatctgttgcacacagctcactcgtatgtcctgcactggtacatgcatctgtaatacagtttctacgtctatttaaggctaggagccgaatgtgccccattgtcagtgggtccacgtttctccccggctcctctgggctaaggcagtgtggcccgaagcttaaaaagttactcggtactgtttttaagaacacttttatagagttagtggaaggcaagttaagagccaatcactgatccccaagtgtttcttgagcatctggtctggggggaccactttgatcggacccacccttggaaagctcaggggtaggcccaggtgggatgctcaccctgtcactgagggttttggttggcatcgttgtttttgaatgtagcacaagcgatgagcaaactctataagagtgttttaaaaattaacttcccaggaagtgagttaaaaacaataaaagccctttcttgagttaaaaagaaaaaaaaaa

SEQ ID NO: 688 - DNA, 3660 bp, Homo sapiens
ctgggccccagcgaggcggtggggcggggcggggcggggcggggcgcgcagcaggagcgagtggggccgcccgccgggccgcggacactgtcgcccggcgcccaggttcccaacaaggctacgcagaagaacccccttgactgaagcaatggaggggggtccagctgtctgctgccaggatcctcgggcagagctggtagaacgggtggcagccatcgatgtgactcacttggaggaggcagatggtggcccagagcctactagaaacggtgtggaccccccaccacgggccagagctgcctctgtgatccctggcagtacttcaagactgctcccagcccggcctagcctctcagccaggaagctttccctacaggagcggccagcaggaagctatctggaggcgcaggctgggccttatgccacggggcctgccagccacatctccccccgggcctggcggaggcccaccatcgagtcccaccacgtggccatctcagatgcagaggactgcgtgcagctgaaccagtacaagctgcagagtgagattggcaagggtgcctacggtgtggtgaggctggcctacaacgaaagtgaagacagacactatgcaatgaaagtcctttccaaaaagaagttactgaagcagtatggctttccacgtcgccctcccccgagagggtcccaggctgcccagggaggaccagccaagcagctgctgcccctggagcgggtgtaccaggagattgccatcctgaagaagctggaccacgtgaatgtggtcaaactgatcgaggtcctggatgacccagctgaggacaacctctatttggccctgcagaaccaggcccagaatatccagttagattcaacaaatatcgccaagccccactccctgcttccctctgagcagcaagacagtggatccacgtgggctgcgcgctcagtgtttgacctcctgagaaaggggcccgtcatggaagtgccctgtgacaagcccttctcggaggagcaagctcgcctctacctgcgggacgtcatcctgggcctcgagtacttgcactgccagaagatcgtccacagggacatcaagccatccaacctgctcctgggggatgatgggcacgtgaagatcgccgactttggcgtcagcaaccagtttgaggggaacgacgctcagctgtccagcacggcgggaaccccagcattcatggcccccgaggccatttctgattccggccagagcttcagtgggaaggccttggatgtatgggccactggcgtcacgttgtactgctttgtctatgggaagtgcccattcatcgacgatttcatcctggccctccacaggaagatcaagaatgagcccgtggtgtttcctgaggagccagaaatcagcgaggagctcaaggacctgatcctgaagatgttagacaagaatcccgagacgagaattggggtgccagacatcaagttgcacccttgggtgaccaagaacggggaggagccccttccttcggaggaggagcactgcagcgtggtggaggtgacagaggaggaggttaagaactcagtcaggctcatccccagctggaccacggtgatcctggtgaagtccatgctgaggaagcgttcctttgggaacccgtttgagccccaagcacggagggaagagcgatccatgtctgctccaggaaacctactggtgaaagaagggtttggtgaagggggcaagagcccagagctccccggcgtccaggaagacgaggctgcatcctgagcccctgcatgcacccagggccacccggcagcacactcatcccgcgcctccagaggcccacccctcatgcaacagccgcccccgcaggcagggggctggggactgcagccccactcccgcccctcccccatcgtgctgcatgacctccacgcacgcacgtccagggacagactggaatgtatgtcatttggggtcttgggggcagggctcccacgaggccatcctcctcttcttggacctccttggcctgacccattctgtggggaaaccgggtgcccatggagcctcagaaatgccacccggctggttggcatggcctggggcaggaggcagaggcaggagaccaagatggcaggtggaggccaggcttaccacaacggaagagacctcccgctggggccgggcaggcctggctcagctgccacaggcatatggtggagaggggggtaccctgcccaccttggggtggtggcaccagagctcttgtctattcagacgctggtatgggggctcggacccctcactggggacagggccagtgttggagaattctgattccttttttgttgtcttttacttttgtttttaacctgggggttcggggagaggccctgcttgggaacatctcacgagctttcctacatcttccgtggttcccagcacagcccaagattatttggcagccaagtggatggaactaactttcctggactgtgtttcgcattcggcgttatctggaaagtggactgaacggaatcaagctctgagcagaggcctgaagcggaagcaccacatcgtccctgcccatctcactctctcccttgatgatgcccctagagctgaggctggagaagacaccagggctgactttgaccgagggccatggacgcgacaggcctgtggccctgcgcatgctgaaataactggaacccagcctctcctcctacaccggcctacccatctgggcccaagagctgcactcacactcctacaacgaaggacaaactgtccaggtcggagggatcacgagacacagaacctggaggggtgtgcacgctggcaggtggcctctgcggcaattgcctcaccctgaggacatcagcagtcagcctgctcagagcgggggtgctggagcgcgtgcagacacagctcttccggagcagccttcaccttctctctgggatcagtgtccggctggccgacgtggcatttgctgaccgaatgctcatagaggttgacccccacagggtcacgcaggactcggacactgccctggaaacatggatggacaagggcttttggccacaggtgtgggtgtcctgttggaggagggcttgtttggagaagggaggctggctgggggagaaacccggatcccgctgcatctccgcgcctgtgggtgcatgtcgcgtgctcatctgttgcacacagctcactcgtatgtcctgcactggtacatgcatctgtaatacagtttctacgtctatttaaggctaggagccgaatgtgccccattgtcagtgggtccacgtttctccccggctcctctgggctaaggcagtgtggcccgaagcttaaaaagttactcggtactgtttttaagaacacttttatagagttagtggaaggcaagttaagagccaatcactgatccccaagtgtttcttgagcatctggtctggggggaccactttgatcggacccacccttggaaagctcaggggtaggcccaggtgggatgctcaccctgtcactgagggttttggttggcatcgttgtttttgaatgtagcacaagcgatgagcaaactctataagagtgttttaaaaattaacttcccaggaagtgagttaaaaacaataaaagccctttcttgagtt

SEQ ID NO: 689 - DNA, 4544 bp, Homo sapiens
gatgagtgatttcctgagcatgcctagggaatgacaggcatctccacaggcaggctgcatccaccttggctggggtgtcgtcattggctgcctattagaaaaacgacaggacaatgcataccaccgcctcccgactgtaaacataggggatatgtgttcacttagcatggacttctgggaggggccaaggaagggcggtctggagttttattgaatagagcagtgtgtattcggctgcctgcctgcccgcctgcttgctctctggctgtgctcctgcttaaagaaatcagtccttcctttccgacttagtcctcgggaagaagtttcagactacaaggtatcattggaacatttcaagatcatcaaatcaaattccacagggattggtgaccaaccagaaggctcagacatctgattgctgacctgtccagacatcatctggtctccctgaacctgaaatcacaccatggatgattttgagcgtcgcagagaacttagaaggcaaaagagggaggagatgcgactcgaagcagaaagaatcgcctaccagaggaatgacgatgatgaagaggaggcagcccgggaacggcgccgccgagcccgacaggaacggctgcggcagaagcaggaggaagaatccttgggacaggtgaccgaccaggtggaggtgaatgcccagaacagtgtgcctgacgaggaggccaagacaaccaccacaaacactcaagtggaaggggatgatgaggccgcattcctggagcgcctggctcggcgtgaggaaagacgccaaaaacgccttcaggaggctctggagcggcagaaggagttcgacccaacaataacagatgcaagtctgtcgctcccaagcagaagaatgcaaaatgacacagcagaaaatgaaactaccgagaaggaagaaaaaagtgaaagtcgccaagaaagatacgagatagaggaaacagaaacagtcaccaagtcctaccagaagaatgattggagggatgctgaagaaaacaagaaagaagacaaggaaaaggaggaggaggaagaggagaagccaaagcgagggagcattggagaaaatcagggagaagagaagggaactaaagtgcaagctaaaagagaaaagctccaagaagacaagcctaccttcaaaaaagaagagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaagatagaagagcgagcagaatttttgaataagtctgtgcagaaaagcagtggtgtcaaatcgacccatcaagcagcaatagtctccaagattgacagcagactggagcagtataccagtgcaattgagggaacaaaaagcgcaaaacctacaaagccggcagcctcggatcttcctgttcctgctgaaggtgtacgcaacatcaagagtatgtgggagaaagggaatgtgttttcatcccccactgcagcaggcacaccaaataaggaaactgctggcttgaaggtaggggtttctagccgcatcaatgaatggctaactaaaaccccagatggaaacaagtcacctgctcccaaaccttctgacttgagaccaggagacgtatccagcaagcggaacctctgggaaaagcaatctgtggataaggtcacttcccccactaaggtttgagacagttccagaaagaacccaagctcaagacgcaggacgagctcagttgtagagggctaattcgctctgttttgtatttatgttgatttactaaattgggttcattatcttttatttttcaatatcccagtaaacccatgtatattatcactatatttaataatcacagtctagagatgttcatggtaaaagtactgcctttgcacaggagcctgtttctaaagaaacccatgctgtgaaatagagacttttctactgatcatcataactctgtatctgagcagtgataccaaccacatctgaagtcaacagaagatccaagtttaaaattgcctgcggaatgtgtgcagtatctagaaaaatgaaccgtagtttttgtttttttaaatacagaagtcatgttgtttctgcactttataataaagcatggaagaaattatcttagtaggcaattgtaacactttttgaaagtaacccatttcagatttgaaatactgcaataatggttgtctttaaaaaaaaaaaagaaatgtactgttaaggtattactttttttcatgctgatgattcatatctaaattacattattatgttagctgacagtggtactgattttttaggttggttgttttgtggatttctttagtagtgatagtagcctgaaccacattttagataactcaattatgtatgtatgtgcatacacatatacaaacacactaatggtagaatgcttttttatgtgctagactattatatttagtagtatgtcattgtaactagccaatatcacagcttttgaaaaattaaaaaatcacactatattaatattttatatttgccaacagaaacatggcagataggtatcaatatgttttcaatgcctgatgacctataagaagaaagtattgaaaagaagagagattagaactgttagaaggagttgaaattttctaaaagacatagtatttagtttataattaaatgcattcttgaagtccagtgtgaattttattaatgctatcatctcgaccaagctcaaagcctacttattagaaacaatgaagttcacaataggtcataaggtctcttccttttctaaaattgaaagacaagaaatttagtgccaatattgtacagacagaaattccatgtatgagtctcaacaaagactacctttggctaaatgtctagaagcagagaagtaaagtgagcaaaatccagtgttgaggagtcatgacagtactttgatctttatatactctgaagcatttcttcaaacttttctacttttatttgtcattgatacctgtagtaagttgacaatgtggtgaaatttcaaaattatatgtaacttctactagttttactttctcccccaagtcttttttaactcatgatttttacacacacaatccagaacttattatatagcctctaagtctttattcttcacagtagataatgaaagagtcctccagtgtcttggcaaaatgttctagtatagctggatacatacagtggagttctataaactcatacctcagtggacttaaccaaaattgtgttagtctcaattcctaccacactgagggagcctcccaaataactattttcttatctgcagtattcctccagaagagctaaccagggcagggctggcatgagaagtgacatctgcgttacaaagtctatcttcctcataagtctgtaaagagcaattgaatcttctagctttagcaaacctaagccaaaggaaggaaagccatgaagaatgcagaagtcaaaccctcatgacaaagtaggcacaagtctacaataagctaaatcagaatttacaaatacaagtgtcccaggtagcattgactcccgtcattggagtgaaatggatcaaagtttgaattaaggcctatggtaaggtaacattgctttgttgtacttttgaacaagagctcctcctgatcactattacatatttttctagaaaatctaaagttcagaagagaatgtatcactgctgacttttattccaatatttggatggagtaagttttagggtagaattttgttcagtttggatttaatcttttgaaaagtaaattccttgtttactggtttgactataattctctgttatctttacgaggtaaaactgcaagctgactagcatgttctgtgaatctgccattcctaaaaattttataaacacttgatacttttcactgataatggatcgctccaataaacatatattgtgaaaatgcatccacaataaatggaattccttcctgcaaaatgtctttttctcacttatttttatgtacaatattgatagtgagaggtatgtctattataataaagattatggcacagtaaaacctgt

SEQ ID NO: 690 - DNA, 3612 bp, Homo sapiens
cctgcctgcccgcctgcttgctctctggctgtgctcctgcttaaagaaatcagtccttcctttccgacttagtcctcgggaagaagtttcagactacaaggtatcattggaacatttcaagatcatcaaatcaaattccacagggattggtgaccaaccagaaggctcagacatctgattgctgacctgtccagacatcatctggtctccctgaacctgaaatcacaccatggatgattttgagcgtcgcagagaacttagaaggcaaaagagggaggagatgcgactcgaagcagaaagaatcgcctaccagaggaatgacgatgatgaagaggaggcagcccgggaacggcgccgccgagcccgacaggaacggctgcggcagaagcaggaggaagaatccttgggacaggtgaccgaccaggtggaggtgaatgcccagaacagtgtgcctgacgaggaggccaagacaaccaccacaaacactcaagtggaaggggatgatgaggccgcattcctggagcgcctggctcggcgtgaggaaagacgccaaaaacgccttcaggaggctctggagcggcagaaggagttcgacccaacaataacagatgcaagtctgtcgctcccaagcagaagaatgcaaaatgacacagcagaaaatgaaactaccgagaaggaagaaaaaagtgaaagtcgccaagaaagatacgagatagaggaaacagaaacagtcaccaagtcctaccagaagaatgattggagggatgctgaagaaaacaagaaagaagacaaggaaaaggaggaggaggaagaggagaagccaaagcgagggagcattggagaaaatcaggtagaggtgatggtggaagagaaaacaactgaaagccaggaggaaacagtggtaatgtcattaaaaaatgggcagatcagttcagaagagcctaaacaagaggaggagagggaacaaggttcagatgagatttcccatcatgaaaagatggaagaggaagacaaggaaagagctgaggcagagagggcaaggttggaagcagaagaaagagaaagaattaaagccgagcaagacaaaaagatagcagatgaacgagcaagaattgaagcagaagaaaaagcagctgcccaagaaagagaaaggagagaggcagaagagagggaaaggatgagggaggaagagaaaagggcagcagaggagaggcagaggataaaggaggaagagaaaagggcagcagaggagaggcagaggataaaggaggaagagaaaagggcagcagaggagaggcagaggataaaagaggaagagaaaagggcagcagaggagaggcaaagggccagggcagaggaggaagagaaggctaaggtagaagagcagaaacgtaacaagcagctagaagagaaaaaacatgccatgcaagagacaaagataaaaggggaaaaggtagaacagaaaatagaagggaaatgggtaaatgaaaagaaagcacaagaagataaacttcagacagctgtcctaaagaaacagggagaagagaagggaactaaagtgcaagctaaaagagaaaagctccaagaagacaagcctaccttcaaaaaagaagagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaagatagaagagcgagcagaatttttgaataagtctgtgcagaaaagcagtggtgtcaaatcgacccatcaagcagcaatagtctccaagattgacagcagactggagcagtataccagtgcaattgagggaacaaaaagcgcaaaacctacaaagccggcagcctcggatcttcctgttcctgctgaaggtgtacgcaacatcaagagtatgtgggagaaagggaatgtgttttcatcccccactgcagcaggcacaccaaataaggaaactgctggcttgaaggtaggggtttctagccgcatcaatgaatggctaactaaaaccccagatggaaacaagtcacctgctcccaaaccttctgacttgagaccaggagacgtatccagcaagcggaacctctgggaaaagcaatctgtggataaggtcacttcccccactaaggtttgagacagttccagaaagaacccaagctcaagacgcaggacgagctcagttgtagagggctaattcgctctgttttgtatttatgttgatttactaaattgggttcattatcttttatttttcaatatcccagtaaacccatgtatattatcactatatttaataatcacagtctagagatgttcatggtaaaagtactgcctttgcacaggagcctgtttctaaagaaacccatgctgtgaaatagagacttttctactgatcatcataactctgtatctgagcagtgataccaaccacatctgaagtcaacagaagatccaagtttaaaattgcctgcggaatgtgtgcagtatctagaaaaatgaaccgtagtttttgtttttttaaatacagaagtcatgttgtttctgcactttataataaagcatggaagaaattatcttagtaggcaattgtaacactttttgaaagtaacccatttcagatttgaaatactgcaataatggttgtctttaaaaaaaaaaaagaaatgtactgttaaggtattactttttttcatgctgatgattcatatctaaattacattattatgttagctgacagtggtactgattttttaggttggttgttttgtggatttctttagtagtgatagtagcctgaaccacattttagataactcaattatgtatgtatgtgcatacacatatacaaacacactaatggtagaatgcttttttatgtgctagactattatatttagtagtatgtcattgtaactagccaatatcacagcttttgaaaaattaaaaaatcacactatattaatattttatatttgccaacagaaacatggcagataggtatcaatatgttttcaatgcctgatgacctataagaagaaagtattgaaaagaagagagattagaactgttagaaggagttgaaattttctaaaagacatagtatttagtttataattaaatgcattcttgaagtcc

SEQ ID NO: 691 - DNA, 4114 bp, Homo sapiens
ctgtgctcctgcttaaagaaatcagtccttcctttccgacttagtcctcgggaagaagtttcagactacaaggtatcattggaacatttcaagatcatcaaatcaaattccacagggattggtgaccaaccagaaggctcagacatctgattgctgacctgtccagacatcatctggtctccctgaacctgaaatcacaccatggatgattttgagcgtcgcagagaacttagaaggcaaaagagggaggagatgcgactcgaagcagaaagaatcgcctaccagaggaatgacgatgatgaagaggaggcagcccgggaacggcgccgccgagcccgacaggaacggctgcggcagaagcaggaggaagaatccttgggacaggtgaccgaccaggtggaggtgaatgcccagaacagtgtgcctgacgaggaggccaagacaaccaccacaaacactcaagtggaaggggatgatgaggccgcattcctggagcgcctggctcggcgtgaggaaagacgccaaaaacgccttcaggaggctctggagcggcagaaggagttcgacccaacaataacagatgcaagtctgtcgctcccaagcagaagaatgcaaaatgacacagcagaaaatgaaactaccgagaaggaagaaaaaagtgaaagtcgccaagaaagatacgagatagaggaaacagaaacagtcaccaagtcctaccagaagaatgattggagggatgctgaagaaaacaagaaagaagacaaggaaaaggaggaggaggaagaggagaagccaaagcgagggagcattggagaaaatcagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaagatagaagagcgagcagaatttttgaataagtctgtgcagaaaagcagtggtgtcaaatcgacccatcaagcagcaatagtctccaagattgacagcagactggagcagtataccagtgcaattgagggaacaaaaagcgcaaaacctacaaagccggcagcctcggatcttcctgttcctgctgaaggtgtacgcaacatcaagagtatgtgggagaaagggaatgtgttttcatcccccactgcagcaggcacaccaaataaggaaactgctggcttgaaggtaggggtttctagccgcatcaatgaatggctaactaaaaccccagatggaaacaagtcacctgctcccaaaccttctgacttgagaccaggagacgtatccagcaagcggaacctctgggaaaagcaatctgtggataaggtcacttcccccactaaggtttgagacagttccagaaagaacccaagctcaagacgcaggacgagctcagttgtagagggctaattcgctctgttttgtatttatgttgatttactaaattgggttcattatcttttatttttcaatatcccagtaaacccatgtatattatcactatatttaataatcacagtctagagatgttcatggtaaaagtactgcctttgcacaggagcctgtttctaaagaaacccatgctgtgaaatagagacttttctactgatcatcataactctgtatctgagcagtgataccaaccacatctgaagtcaacagaagatccaagtttaaaattgcctgcggaatgtgtgcagtatctagaaaaatgaaccgtagtttttgtttttttaaatacagaagtcatgttgtttctgcactttataataaagcatggaagaaattatcttagtaggcaattgtaacactttttgaaagtaacccatttcagatttgaaatactgcaataatggttgtctttaaaaaaaaaaaagaaatgtactgttaaggtattactttttttcatgctgatgattcatatctaaattacattattatgttagctgacagtggtactgattttttaggttggttgttttgtggatttctttagtagtgatagtagcctgaaccacattttagataactcaattatgtatgtatgtgcatacacatatacaaacacactaatggtagaatgcttttttatgtgctagactattatatttagtagtatgtcattgtaactagccaatatcacagcttttgaaaaattaaaaaatcacactatattaatattttatatttgccaacagaaacatggcagataggtatcaatatgttttcaatgcctgatgacctataagaagaaagtattgaaaagaagagagattagaactgttagaaggagttgaaattttctaaaagacatagtatttagtttataattaaatgcattcttgaagtccagtgtgaattttattaatgctatcatctcgaccaagctcaaagcctacttattagaaacaatgaagttcacaataggtcataaggtctcttccttttctaaaattgaaagacaagaaatttagtgccaatattgtacagacagaaattccatgtatgagtctcaacaaagactacctttggctaaatgtctagaagcagagaagtaaagtgagcaaaatccagtgttgaggagtcatgacagtactttgatctttatatactctgaagcatttcttcaaacttttctacttttatttgtcattgatacctgtagtaagttgacaatgtggtgaaatttcaaaattatatgtaacttctactagttttactttctcccccaagtcttttttaactcatgatttttacacacacaatccagaacttattatatagcctctaagtctttattcttcacagtagataatgaaagagtcctccagtgtcttggcaaaatgttctagtatagctggatacatacagtggagttctataaactcatacctcagtggacttaaccaaaattgtgttagtctcaattcctaccacactgagggagcctcccaaataactattttcttatctgcagtattcctccagaagagctaaccagggcagggctggcatgagaagtgacatctgcgttacaaagtctatcttcctcataagtctgtaaagagcaattgaatcttctagctttagcaaacctaagccaaaggaaggaaagccatgaagaatgcagaagtcaaaccctcatgacaaagtaggcacaagtctacaataagctaaatcagaatttacaaatacaagtgtcccaggtagcattgactcccgtcattggagtgaaatggatcaaagtttgaattaaggcctatggtaaggtaacattgctttgttgtacttttgaacaagagctcctcctgatcactattacatatttttctagaaaatctaaagttcagaagagaatgtatcactgctgacttttattccaatatttggatggagtaagttttagggtagaattttgttcagtttggatttaatcttttgaaaagtaaattccttgtttactggtttgactataattctctgttatctttacgaggtaaaactgcaagctgactagcatgttctgtgaatctgccattcctaaaaattttataaacacttgatacttttcactgataatggatcgctccaataaacatatattgtgaaaatgcatccacaataaatggaattccttcctgcaaaa

SEQ ID NO: 692 - DNA, 4281 bp, Homo sapiens
aacgggttgggaggagtagatttggctgaggacaagcccagactttcgtcacagggacagaccaacgtgttaacacaaagggagaacacgggagcatcctgcaccgtgcatttcagccacagatcacatggcccctccgcgggcccagcccacgccctgaccgcccggcctggccaggtctccgtatctctctgccccgccgccccttcccaactgcggacatgctgggtggatccggatcgcatggaagacgcagcctggccgcgctctcccaaatcgcctaccagaggaatgacgatgatgaagaggaggcagcccgggaacggcgccgccgagcccgacaggaacggctgcggcagaagcaggaggaagaatccttgggacaggtgaccgaccaggtggaggtgaatgcccagaacagtgtgcctgacgaggaggccaagacaaccaccacaaacactcaagtggaaggggatgatgaggccgcattcctggagcgcctggctcggcgtgaggaaagacgccaaaaacgccttcaggaggctctggagcggcagaaggagttcgacccaacaataacagatgcaagtctgtcgctcccaagcagaagaatgcaaaatgacacagcagaaaatgaaactaccgagaaggaagaaaaaagtgaaagtcgccaagaaagatacgagatagaggaaacagaaacagtcaccaagtcctaccagaagaatgattggagggatgctgaagaaaacaagaaagaagacaaggaaaaggaggaggaggaagaggagaagccaaagcgagggagcattggagaaaatcagggagaagagaagggaactaaagtgcaagctaaaagagaaaagctccaagaagacaagcctaccttcaaaaaagaagagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaagatagaagagcgagcagaatttttgaataagtctgtgcagaaaagcagtggtgtcaaatcgacccatcaagcagcaatagtctccaagattgacagcagactggagcagtataccagtgcaattgagggaacaaaaagcgcaaaacctacaaagccggcagcctcggatcttcctgttcctgctgaaggtgtacgcaacatcaagagtatgtgggagaaagggaatgtgttttcatcccccactgcagcaggcacaccaaataaggaaactgctggcttgaaggtaggggtttctagccgcatcaatgaatggctaactaaaaccccagatggaaacaagtcacctgctcccaaaccttctgacttgagaccaggagacgtatccagcaagcggaacctctgggaaaagcaatctgtggataaggtcacttcccccactaaggtttgagacagttccagaaagaacccaagctcaagacgcaggacgagctcagttgtagagggctaattcgctctgttttgtatttatgttgatttactaaattgggttcattatcttttatttttcaatatcccagtaaacccatgtatattatcactatatttaataatcacagtctagagatgttcatggtaaaagtactgcctttgcacaggagcctgtttctaaagaaacccatgctgtgaaatagagacttttctactgatcatcataactctgtatctgagcagtgataccaaccacatctgaagtcaacagaagatccaagtttaaaattgcctgcggaatgtgtgcagtatctagaaaaatgaaccgtagtttttgtttttttaaatacagaagtcatgttgtttctgcactttataataaagcatggaagaaattatcttagtaggcaattgtaacactttttgaaagtaacccatttcagatttgaaatactgcaataatggttgtctttaaaaaaaaaaaagaaatgtactgttaaggtattactttttttcatgctgatgattcatatctaaattacattattatgttagctgacagtggtactgattttttaggttggttgttttgtggatttctttagtagtgatagtagcctgaaccacattttagataactcaattatgtatgtatgtgcatacacatatacaaacacactaatggtagaatgcttttttatgtgctagactattatatttagtagtatgtcattgtaactagccaatatcacagcttttgaaaaattaaaaaatcacactatattaatattttatatttgccaacagaaacatggcagataggtatcaatatgttttcaatgcctgatgacctataagaagaaagtattgaaaagaagagagattagaactgttagaaggagttgaaattttctaaaagacatagtatttagtttataattaaatgcattcttgaagtccagtgtgaattttattaatgctatcatctcgaccaagctcaaagcctacttattagaaacaatgaagttcacaataggtcataaggtctcttccttttctaaaattgaaagacaagaaatttagtgccaatattgtacagacagaaattccatgtatgagtctcaacaaagactacctttggctaaatgtctagaagcagagaagtaaagtgagcaaaatccagtgttgaggagtcatgacagtactttgatctttatatactctgaagcatttcttcaaacttttctacttttatttgtcattgatacctgtagtaagttgacaatgtggtgaaatttcaaaattatatgtaacttctactagttttactttctcccccaagtcttttttaactcatgatttttacacacacaatccagaacttattatatagcctctaagtctttattcttcacagtagataatgaaagagtcctccagtgtcttggcaaaatgttctagtatagctggatacatacagtggagttctataaactcatacctcagtggacttaaccaaaattgtgttagtctcaattcctaccacactgagggagcctcccaaataactattttcttatctgcagtattcctccagaagagctaaccagggcagggctggcatgagaagtgacatctgcgttacaaagtctatcttcctcataagtctgtaaagagcaattgaatcttctagctttagcaaacctaagccaaaggaaggaaagccatgaagaatgcagaagtcaaaccctcatgacaaagtaggcacaagtctacaataagctaaatcagaatttacaaatacaagtgtcccaggtagcattgactcccgtcattggagtgaaatggatcaaagtttgaattaaggcctatggtaaggtaacattgctttgttgtacttttgaacaagagctcctcctgatcactattacatatttttctagaaaatctaaagttcagaagagaatgtatcactgctgacttttattccaatatttggatggagtaagttttagggtagaattttgttcagtttggatttaatcttttgaaaagtaaattccttgtttactggtttgactataattctctgttatctttacgaggtaaaactgcaagctgactagcatgttctgtgaatctgccattcctaaaaattttataaacacttgatacttttcactgataatggatcgctccaataaacatatattgtgaaaatgcatccacaataaatggaattccttcctgcaaaatgtctttttctcacttatttttatgtacaatattgatagtgagaggtatgtctattataataaagattatggcacagtaaaacctgt

SEQ ID NO: 693 - DNA, 1915 bp, Homo sapiens
atattcaagcctgctctcaggcctgaaatcttttgacttcattctcaggaggcaagactgggtctacctctagatgtctctgatgggatttagtgtgcagcttgaaatgcaggtatcattggaacatttcaagatcatcaaatcaaattccacagggattggtgaccaaccagaaggctcagacatctgattgctgacctgtccagacatcatctggtctccctgaacctgaaatcacaccatggatgattttgagcgtcgcagagaacttagaaggcaaaagagggaggagatgcgactcgaagcagaaagaatcgcctaccagaggaatgacgatgatgaagaggaggcagcccgggaacggcgccgccgagcccgacaggaacggctgcggcagaagcaggaggaagaatccttgggacaggtgaccgaccaggtggaggtgaatgcccagaacagtgtgcctgacgaggaggccaagacaaccaccacaaacactcaagtggaaggggatgatgaggccgcattcctggagcgcctggctcggcgtgaggaaagacgccaaaaacgccttcaggaggctctggagcggcagaaggagttcgacccaacaataacagatgcaagtctgtcgctcccaagcagaagaatgcaaaatgacacagcagaaaatgaaactaccgagaaggaagaaaaaagtgaaagtcgccaagaaagatacgagatagaggaaacagaaacagtcaccaagtcctaccagaagaatgattggagggatgctgaagaaaacaagaaagaagacaaggaaaaggaggaggaggaagaggagaagccaaagcgagggagcattggagaaaatcagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaagatagaagagcgagcagaatttttgaataagtctgtgcagaaaagcagtggtgtcaaatcgacccatcaagcagcaatagtctccaagattgacagcagactggagcagtataccagtgcaattgagggaacaaaaagcgcaaaacctacaaagccggcagcctcggatcttcctgttcctgctgaaggtgtacgcaacatcaagagtatgtgggagaaagggaatgtgttttcatcccccactgcagcaggcacaccaaataaggaaactgctggcttgaaggtaggggtttctagccgcatcaatgaatggctaactaaaaccccagatggaaacaagtcacctgctcccaaaccttctgacttgagaccaggagacgtatccagcaagcggaacctctgggaaaagcaatctgtggataaggtcacttcccccactaaggtttgagacagttccagaaagaacccaagctcaagacgcaggacgagctcagttgtagagggc

SEQ ID NO: 694 - DNA, 2665 bp, Homo sapiens
gatttcctgagcatgcctagggaatgacaggcatctccacaggcaggctgcatccaccttggctggggtgtcgtcattggctgcctattagaaaaacgacaggacaatgcataccaccgcctcccgactgtaaacataggggatatgtgttcacttagcatggacttctgggaggggccaaggaagggcggtctggagttttattgaatagagcagtgtgtattcggctgcctgcctgcccgcctgcttgctctctggctgtgctcctgcttaaagaaatcagtccttcctttccgacttagtcctcgggaagaagtttcagactacaaggtatcattggaacatttcaagatcatcaaatcaaattccacagggattggtgaccaaccagaaggctcagacatctgattgctgacctgtccagacatcatctggtctccctgaacctgaaatcacaccatggatgattttgagcgtcgcagagaacttagaaggcaaaagagggaggagatgcgactcgaagcagaaagaatcgcctaccagaggaatgacgatgatgaagaggaggcagcccgggaacggcgccgccgagcccgacaggaacggctgcggcagaagcaggaggaagaatccttgggacaggtgaccgaccaggtggaggtgaatgcccagaacagtgtgcctgacgaggaggccaagacaaccaccacaaacactcaagtggaaggggatgatgaggccgcattcctggagcgcctggctcggcgtgaggaaagacgccaaaaacgccttcaggaggctctggagcggcagaaggagttcgacccaacaataacagatgcaagtctgtcgctcccaagcagaagaatgcaaaatgacacagcagaaaatgaaactaccgagaaggaagaaaaaagtgaaagtcgccaagaaagatacgagatagaggaaacagaaacagtcaccaagtcctaccagaagaatgattggagggatgctgaagaaaacaagaaagaagacaaggaaaaggaggaggaggaagaggagaagccaaagcgagggagcattggagaaaatcagggagaagagaagggaactaaagtgcaagctaaaagagaaaagctccaagaagacaagcctaccttcaaaaaagaagagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaagatagaagagcgagcagaatttttgaataagtctgtgcagaaaagtggtgtcaaatcgacccatcaagcagcaatagtctccaagattgacagcagactggagcagtataccagtgcaattgagggaacaaaaagcgcaaaacctacaaagccggcagcctcggatcttcctgttcctgctgaaggtgtacgcaacatcaagagtatgtgggagaaagggaatgtgttttcatcccccactgcagcaggcacaccaaataaggaaactgctggcttgaaggtaggggtttctagccgcatcaatgaatggctaactaaaaccccagatggaaacaagtcacctgctcccaaaccttctgacttgagaccaggagacgtatccagcaagcggaacctctgggaaaagcaatctgtggataaggtcacttcccccactaaggtttgagacagttccagaaagaacccaagctcaagacgcaggacgagctcagttgtagagggctaattcgctctgttttgtatttatgttgatttactaaattgggttcattatcttttatttttcaatatcccagtaaacccatgtatattatcactatatttaataatcacagtctagagatgttcatggtaaaagtactgcctttgcacaggagcctgtttctaaagaaacccatgctgtgaaatagagacttttctactgatcatcataactctgtatctgagcagtgataccaaccacatctgaagtcaacagaagatccaagtttaaaattgcctgcggaatgtgtgcagtatctagaaaaatgaaccgtagtttttgtttttttaaatacagaagtcatgttgtttctgcactttataataaagcatggaagaaattatcttagtaggcaattgtaacactttttgaaagtaacccatttcagatttgaaatactgcaataatggttgtcttt

SEQ ID NO: 695 - DNA, 2124 bp, Homo sapiens
caactgcggacatgctgggtggatccggatcgcatggaagacgcagcctggccgcgctctcccaaatcgcctaccagaggaatgacgatgatgaagaggaggcagcccgggaacggcgccgccgagcccgacaggaacggctgcggcagaagcaggaggaagaatccttgggacaggtgaccgaccaggtggaggtgaatgcccagaacagtgtgcctgacgaggaggccaagacaaccaccacaaacactcaagtggaaggggatgatgaggccgcattcctggagcgcctggctcggcgtgaggaaagacgccaaaaacgccttcaggaggctctggagcggcagaaggagttcgacccaacaataacagatgcaagtctgtcgctcccaagcagaagaatgcaaaatgacacagcagaaaatgaaactaccgagaaggaagaaaaaagtgaaagtcgccaagaaagatacgagatagaggaaacagaaacagtcaccaagtcctaccagaagaatgattggagggatgctgaagaaaacaagaaagaagacaaggaaaaggaggaggaggaagaggagaagccaaagcgagggagcattggagaaaatcagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaagatagaagagcgagcagaatttttgaataagtctgtgcagaaaagcagtggtgtcaaatcgacccatcaagcagcaatagtctccaagattgacagcagactggagcagtataccagtgcaattgagggaacaaaaagcgcaaaacctacaaagccggcagcctcggatcttcctgttcctgctgaaggtgtacgcaacatcaagagtatgtgggagaaagggaatgtgttttcatcccccactgcagcaggcacaccaaataaggaaactgctggcttgaaggtaggggtttctagccgcatcaatgaatggctaactaaaaccccagatggaaacaagtcacctgctcccaaaccttctgacttgagaccaggagacgtatccagcaagcggaacctctgggaaaagcaatctgtggataaggtcacttcccccactaaggtttgagacagttccagaaagaacccaagctcaagacgcaggacgagctcagttgtagagggctaattcgctctgttttgtatttatgttgatttactaaattgggttcattatcttttatttttcaatatcccagtaaacccatgtatattatcactatatttaataatcacagtctagagatgttcatggtaaaagtactgcctttgcacaggagcctgtttctaaagaaacccatgctgtgaaatagagacttttctactgatcatcataactctgtatctgagcagtgataccaaccacatctgaagtcaacagaagatccaagtttaaaattgcctgcggaatgtgtgcagtatctagaaaaatgaaccgtagtttttgtttttttaaatacagaagtcatgttgtttctgcactttataataaagcatggaagaaattatcttagtaggcaattgtaacactttttgaaagtaacccatttcagatttgaaatactgcaataatggttgtcttt

SEQ ID NO: 696 - DNA, 2163 bp, Homo sapiens
gatttcctgagcatgcctagggaatgacaggcatctccacaggcaggctgcatccaccttggctggggtgtcgtcattggctgcctattagaaaaacgacaggacaatgcataccaccgcctcccgactgtaaacataggggatatgtgttcacttagcatggacttctgggaggggccaaggaagggcggtctggagttttattgaatagagcagtgtgtattcggctgcctgcctgcccgcctgcttgctctctggctgtgctcctgcttaaagaaatcagtccttcctttccgacttagtcctcgggaagaagtttcagactacaaggtatcattggaacatttcaagatcatcaaatcaaattccacagggattggtgaccaaccagaaggctcagacatctgattgctgacctgtccagacatcatctggtctccctgaacctgaaatcacaccatggatgattttgagcgtcgcagagaacttagaaggcaaaagagggaggagatgcgactcgaagcagaaagaatcgcctaccagaggaatgacgatgatgaagaggaggcagcccgggaacggcgccgccgagcccgacaggaacggctgcggcagaagcaggaggaagaatccttgggacaggtgaccgaccaggtggaggtgaatgcccagaacagtgtgcctgacgaggaggccaagacaaccaccacaaacactcaagtggaaggggatgatgaggccgcattcctggagcgcctggctcggcgtgaggaaagacgccaaaaacgccttcaggaggctctggagcggcagaaggagttcgacccaacaataacagatgcaagtctgtcgctcccaagcagaagaatgcaaaatgacacagcagaaaatgaaactaccgagaaggaagaaaaaagtgaaagtcgccaagaaagatacgagatagaggaaacagaaacagtcaccaagtcctaccagaagaatgattggagggatgctgaagaaaacaagaaagaagacaaggaaaaggaggaggaggaagaggagaagccaaagcgagggagcattggagaaaatcagggagaagagaagggaactaaagtgcaagctaaaagagaaaagctccaagaagacaagcctaccttcaaaaaagaagagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaagatagaagagcgagcagaatttttgaataagtctgtgcagaaaagtggtgtcaaatcgacccatcaagcagcaatagtctccaagattgacagcagactggagcagtataccagtgcaattgagggaacaaaaagcgcaaaacctacaaagccggcagcctcggatcttcctgttcctgctgaaggtgtacgcaacatcaagagtatgtgggagaaagggaatgtgttttcatcccccactgcagcaggcacaccaaataaggaaactgctggcttgaaggtaggggtttctagccgcatcaatgaatggctaactaaaaccccagatggaaacaagtcacctgctcccaaaccttctctgaccttctgttcctcactctttggtctctggttgattggaaacctgcttctcctgccttcatttctccctcttcttccggagtgggtctttctctaa

SEQ ID NO: 697 - DNA, 458 bp, Homo sapiens
aaccactgacagctctgtaaacaaagcaaggacaaaaagagcccgcttccccctttctggtagtcattttgggtttgggggctgcaggggaattctggaatacttgactccatggcacagaaacgcaggggaaacgggctcctcatttaaagagctggaaggggaaggtctttccggaattaaaaccatcacagaggaggtccagacatcatctggtctccctgaacctgaaatcacaccatggatgattttgagcgtcgcagagaacttagaaggcaaaagagggaggagatgcgactcgaagcagaaagaatcgcctaccagaggaatgacgatgatgaagaggaggcagcccgggaacggcgccgccgagcccgacaggaacggctgcggcagaagcaggaggaagaatccttgggacaggtgaccgaccaggtggaggtgaatgcccagaacag

SEQ ID NO: 698 - DNA, 1614 bp, Homo sapiens
aagaattctggattaaactccctcccttgcattgtattcaggggtgccttccttgaagaattgaaagcagaaagatttgggagctgagagttaagctgaacaaaaggtatcattggaacatttcaagatcatcaaatcaaattccacagggattggtgaccaaccagaaggctcagacatctgattgctgacctgtccagacatcatctggtctccctgaacctgaaatcacaccatggatgattttgagcgtcgcagagaacttagaaggcaaaagagggaggagatgcgactcgaagcagaaagaatcgcctaccagaggaatgacgatgatgaagaggaggcagcccgggaacggcgccgccgagcccgacaggaacggctgcggcagaagcaggaggaagaatccttgggacaggtgaccgaccaggtggaggtgaatgcccagaacagtgtgcctgacgaggaggccaagacaaccaccacaaacactcaagtggaaggggatgatgaggccgcattcctggagcgcctggctcggcgtgaggaaagacgccaaaaacgccttcaggaggctctggagcggcagaaggagttcgacccaacaataacagatgcaagtctgtcgctcccaagcagaagaatgcaaaatgacacagcagaaaatgaaactaccgagaaggaagaaaaaagtgaaagtcgccaagaaagatacgagatagaggaaacagaaacagtcaccaagtcctaccagaagaatgattggagggatgctgaagaaaacaagaaagaagacaaggaaaaggaggaggaggaagaggagaagccaaagcgagggagcattggagaaaatcagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaagatagaagagcgagcagaatttttgaataagtctgtgcagaaaagcagtggtgtcaaatcgacccatcaagcagcaatagtctccaagattgacagcagactggagcagtataccagtgcaattgagggaacaaaaagcgcaaaacctacaaagccggcagcctcggatcttcctgttcctgctgaaggtgtacgcaacatcaagagtat

SEQ ID NO: 699 - DNA, 558 bp, Homo sapiens
gaatagagcagtgtgtattcggctgcctgcctgcccgcctgcttgctctctggctgtgctcctgcttaaagaaatcagtccttcctttccgacttagtcctcgggaagaagtttcagactacaaggtatcattggaacatttcaagatcatcaaatcaaattccacagggattggtgaccaaccagaaggctcagacatctgattgctgaccttcctggatcaatcatgaagtcttcacttcctgtgaaaaatgctagtgacttgaatcaataaagacaacatgagtcagccttccaaggtccagacatcatctggtctccctgaacctgaaatcacaccatggatgattttgagcgtcgcagagaacttagaaggcaaaagagggaggagatgcgactcgaagcagaaagaatcgcctaccagaggaatgacgatgatgaagaggaggcagcccgggaacggcgccgccgagcccgacaggaacggctgcggcagaagcaggaggaagaatccttgggacaggtgaccgaccaggtggaggtgaatgcccagaacag

SEQ ID NO: 700 - DNA, 1978 bp, Homo sapiens
gaggctgtgagccccaggcattcttctttggggtgtggccttcatggggagtgtattgctgcagaaagctggggacagaatagtgttctggattgagtatctcagttaccagcctgaaatctccatcgaccaacactgccttctctcaaatgacttcttatatgaaagtggacagacagtggaatgcagaaattttagagctgatcttggggaccggtcaactgtctactggccaaatcgcctaccagaggaatgacgatgatgaagaggaggcagcccgggaacggcgccgccgagcccgacaggaacggctgcggcagaagcaggaggaagaatccttgggacaggtgaccgaccaggtggaggtgaatgcccagaacagtgtgcctgacgaggaggccaagacaaccaccacaaacactcaagtggaaggggatgatgaggccgcattcctggagcgcctggctcggcgtgaggaaagacgccaaaaacgccttcaggaggctctggagcggcagaaggagttcgacccaacaataacagatgcaagtctgtcgctcccaagcagaagaatgcaaaatgacacagcagaaaatgaaactaccgagaaggaagaaaaaagtgaaagtcgccaagaaagatacgagatagaggaaacagaaacagtcaccaagtcctaccagaagaatgattggagggatgctgaagaaaacaagaaagaagacaaggaaaaggaggaggaggaagaggagaagccaaagcgagggagcattggagaaaatcagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaagatagaagagcgagcagaatttttgaataagtctgtgcagaaaagcagtggtgtcaaatcgacccatcaagcagcaatagtctccaagattgacagcagactggagcagtataccagtgcaattgagggaacaaaaagcgcaaaacctacaaagccggcagcctcggatcttcctgttcctgctgaaggtgtacgcaacatcaagagtatgtgggagaaagggaatgtgttttcatcccccactgcagcaggcacaccaaataaggaaactgctggcttgaaggtaggggtttctagccgcatcaatgaatggctaactaaaaccccagatggaaacaagtcacctgctcccaaaccttctgacttgagaccaggagacgtatccagcaagcggaacctctgggaaaagcaatctgtggataaggtcacttcccccactaaggtttgagacagttccagaaagaacccaagctcaagacgcaggacgagctcagttgtagagggctaattcgctctgttttgtatttatgttgatttactaaattgggttcattatcttttatttttcaatatcccagtaaacccatgtatattatcactatatttaataatcacagtctagagatgttcatggtaaaagtactg

SEQ ID NO: 701 - DNA, 6054 bp, Homo sapiens
gtcccggaaagggatctatgtgatggagagtgatgacacccccgtgacagagtccgacctcagtcgcgcacccataaaaatgagtgcccacatggcaatggtggatgccctgatgatggcctacactgtggagatgatcagcatcgagaaggtggtggccagtgtcaagcgcttctcaacgttcagtgcctcgaaagaacttccgtacgacctcgaggatgccatggtgttctggatcaacaaggtaaatcttaaaatgagagagataacagagaaagaagttaaattaaaacaacagttattggaaagtccagctcatcaaaagatatatgcttaaaggaggtaacgtcgatggccgacagtctgtataatattcggcttctgagagaattctccaatgaatatcttaataaatgtttttatctcaccttggaagatatgctgtatgcgccattagtgttgaagccgaatgttatggtttttattgcggagcttttttggtggttcgagaatgtcaagccagattttgttcagcccagggatgttcaggagctgaaagacgcgaaaacagtgttacaccagaagagcagccggcctcctgtaccgatctccaacgcgaccaaacgcagtttcctaggcagccctgctgcagggaccctggctgagctgcagccccccgtgcagctgccggcggaaggctgtcacaggcactacctgcacccggaagaacctgaatacctcgggaaaggaactgctgccttcagcccatcccatcctttattgccactgagacagaaacagcagaaatccatacagggagaggacatccctgatcagcgacatcgatcgaattctttgacccgagttgatggtcagcctcgaggagcagcaatagcctggccagaaaaaaaaaccaggcctgcgtcccagccaacaccttttgctctacatcacgctgcgagttgtgaagtggatcccagctctggcgacagcatcagcttggcccgctccatcagcaaagacagtttggcatccaacattgttaatctgaccccacagaaccagccacaccccacggccacgaagagccacgggaagagcctcctgagcaatgtcagtattgaggatgaggaagaggagcttgtggctattgttagagcagacgtggttccccagcaggctgacccggagttccccagggcctcaccccgggccttaggccttacagcaaatgcccggtctccccaaggacagctggacacctcggaaagtaagcctgacagttttttcttggagcctttgatgccagcagttcttaagccagcgaaagagaagcaggtgatcaccaaggaggatgaacggggggaagggagaccgaggagcatcgtgtctaggaggcccagcgagggcccccagcctttggtacgaaggaaaatgactggcagtcgcgacttgaataggacttttaccccgattccatgctcagaattccccatgggcatcgaccccaccgagacaggaccactgtcagtggaaaccgcaggagaggtctgtggtgggcctctggcccttggcggattcgatccgttcccccagggaccatccacggatggcttcttccttcatgtaggcagggccgatgaagacaccgagggaaggttatatgttagttgttcaaaaagccccaactcccacgattcagagccgtggactctcctcaggcaggattctgactcggatgtggtggacatagaggaagccgagcacgatttcatgggtgaggcccatcctgtggttttcagcagatacattggggaggaagagtcggccaaactgcaggaggacatgaaggtgaaggaacatgaagacaaagatgacgccagcggccgctcgagcccctgcctgagcacagcctctcagatgagcagtgtctccatggcgagtgggagcgtgaagatgaccagctttgcggagaggaagctccagagactcaacagctgtgagaccaagtccagcaccagcagctcccagaagaccacgccagatgcgtctgagagctgcccagcccctctgacgacgtggaggcagaagagggagcagagtccgagccagcatggcaaggatcccgccagcctcctggcatctgagctggtacagctgcacatgcagctggaggagaagcgcagggccatcgaggcccagaagaagaagatggaggcgctgtcggcaaggcagcgcctgaagctcggcaaggctgcattcctgcatgtggtgaagaagggcaaggccgaggctgccccacccctcaggccggagcactttgcaaaggagtactctcagcacaacggggaggactgtggggacgctgtttccaaaaccgaagactttctcgtgaaggaggagcagagagaggagctccttcacgagccacaggatgtggacaaagagagcctggcctttgctcagcaacataaagcaaaagaccctgtggctctgcacgagctggagagaaataaggtgatctccgctgccctcctggaggacactgttggggaggttgtcgacgtgaatgaatgtgacctttccatcgagaagcttaacgaaaccatcagtacgctgcagcaggccatcctgaaaatctctcagcagcaagagcagcttctgatgaagtcccccacagtcccagtgccaggctctaagaataactcgcaggaccacaaagtgaaggcaccagtccacttcgtggagccactctctcccacgggcgtggctggccaccgcaaagccccccggctgggtcaaggccggaattcccgttccggaaggccggcggagctgaaggtcccaaaagacaggccacagggctcctcccgaagtaaaaccccaacgcccagtgtagagacgctcccgcacttgagacccttccctgccagcagccaccctcggacgcccacggaccctggcctggacagtgccctggagcccagtggtgacccacatgggaagtgtctcttcgacagttacaggctccatgatgaaagcaatcagcggacacttactctgtcctcttccaaagatgccaacattctttcggagcagatgagcctcaaagaagttctggatgcgagtgtgaaggaggtggggtccagctcctcagatgtctcgggaaaagagagcgtccccgtggaggagcctctgaggagcagggccagcctcattgaagtggacctctccgacctgaaggcccccgacgaggatggggagctggtaagcctcgatggctcggcggaccttgtcagcgaaggcgaccagaagccgggggtcggcttcttcttcaaggatgaacagaaagcggaagatgagctcgccaagaagcgggcggccttcctcctgaagcagcagcgcaaggccgaggaggcccgcgtgcgcaagcagcagctggaagcggaggtggagctcaagcgtgacgaagcccggcgcaaagctgaggaagaccgggtgcggaaggaggaggagaaggcgcggcgcgagctcatcaagcaggagtacctgcggaggaagcagcagcagatcctagaggagcaggggctcggcaagcccaagtcaaagccgaagaagccgcggccgaagtcggtgcaccgggaagagtcgtgcagcgactccggcaccaagtgctcctccacccctgataacttgagccggactcagtcaggctccagcctgtccttggcctctgcggcgacgacagaacccgagagcgttcattccgggggcacaccctctcagcgagtggaatcgatggaagccctgcccatactgagccgtaacccaagcaggagcacagaccgagactgggagaccgcgtcggcggcatcttccctggcctcagtggccgagtacacaggtcccaagctctttaaggagcccagtagtaaatcaaacaagccgattattcacaatgccatatcccattgctgcctggctggaaaagtgaacgaaccccacaagaattccatattggaggagctggagaagtgtgatgccaatcactacatcatactgtttcgtgatgctggctgccagttcagggcgctttactgctactatcctgatactgaggaaatctacaaactcactggcacggggccaaagaacatcaccaagaaaatgatcgacaaactgtataaatacagctcagaccgaaaacagtttaacttgatcccagccaaaaccatgtctgtcagtgtggacgcactcacaatccacaaccacctgtggcagcccaagcggcctgcagtgccaaagaaggcccagactcgtaaatgaccccggtgcagctggcgtccaaagggtgacccagactcgtaaatgatgcccttgtggctggcatccagagggtgccacggggtccttatttattgttttcatctatttgggtacgaagtgtgcaaagtcacagaccttttgcaaagaggtttctagacagcagaagaaaacccctctctcagcgctcatctcacgcagaggatgccaggcagggtgaggatgggggagtagatgccgcttttgcagtggctcgcactgctgtggccactgctgaccactgaggctcccagcggagggtgttcacagccaggtcccgggccacggagctcccttacttgaagttctccttcagcatagattagacgtgatccactttgctttcttgcttctcacctcgcccccttgcacattgcctgacaccctcatattggccagctgtaatctcgtgactatgggactgaggctcaatcttggcttggggtgtttgaatgtctatagcaaaggaattcataatgggaaatctttttcatttgagaaattgtatgatatttattggttgtgtctactgccaacatttatatccaattctaagatttctgaaaaaaaattcttatcccttgctgctcagaaaaagtttacggaaaacaccagttcactaaaagcaccgaaatctgcaaagcctgtcttccgctagaacaacgtctacaaatgtgaagatgatgacttctggcacgcggtcatgagggtggggaatggcactaggagctgatgtttgcctcatttaaagtaggcaagccgagccaactgcagccatcattcattaagttttgggtagtgctctaatggtttgttcactttaataaagacagattttggtaaagtagaatatttttcattctgagcatgtttgtcccaaaaggtgatgcacttaagctgacagtcccttcagtggttttgttaggtcacggcttgtcctgtctggattctgcatctggaagcgctgcatgctctcagaggagcgtgccgtttcccctgtagatggatacttttgttttgttgcctatttaaaaacaattaagtggttatttgcagttatttcagaactccaagtaagtggatggctttgggttctttctgccttggtcccaatggtgttgatgcttctgtggagcgcggacattcccaggagcaggtgcgtgccagccatggctgccagacactgctgcaactgaccagctgccggaagattctggagccactaacattagttttgcacatattttcttgggagtgttacttgaatctatctcaaactgcagaaaaaatcaaaagatcaataattgggagaaaaagagacaaatttaactgttacataattttagatagacaaaaaacatgagtgagtcgtgtacataaggagggaacatggtacagaaggctagaaggaattataggtcttattcccctttcctcagtcctttgaagagaagtacagtctcttgcgattttgtatatatcgtgttcgacacagccgctctctgtcctgtaaatagggaactaaaggctgtatgatttctcaagtgctgagttacacagtcctgagtgagctttctgttaccatactttcacacgtgggctttatttctcactgtatgtttgatatgatattactgtatttattttaagaaagcactaagatgtaataaagtgatgaactaatttgcttta

SEQ ID NO: 702 - DNA, 7696 bp, Homo sapiens
ggcgcggcgaggggcggcggcgcctttgttgcggccgggccgccgcctcagccctttgtctgcagatggtggacgcgagcggccgcgccgccgccgagggctggaggaagatggaggccccgccggacggcgccgccgacctcgtgcccctggaccgctacgacgcggcgcgcgccaagatcgccgccaacctgcagtggatctgcgccaaggcctacggccgagataacatccctgaggacctcagagaccctttctacgttgaccagtatgagcaggagcacattaagccgcctgttatcaagcttctcctgtccagcgagctgtactgccgtgtctgcagcctcatcctgaaaggggaccaggtggccgccttacagggacaccagtctgtcatccaggccctgtcccggaaagggatctatgtgatggagagtgatgacacccccgtgacagagtccgacctcagtcgcgcacccataaaaatgagtgcccacatggcaatggtggatgccctgatgatggcctacactgtggagatgatcagcatcgagaaggtggtggccagtgtcaagcgcttctcaacgttcagtgcctcgaaagaacttccgtacgacctcgaggatgccatggtgttctggatcaacaaggtaaatcttaaaatgagagagataacagagaaagaagttaaattaaaacaacagttattggaaagtccagctcatcaaaaggtccgctatcgacgagagcacctttctgctaggcagtcaccctacttcccgttgttggaggatttgatgagagacggcagtgatggtgctgctctcttagctgtgattcactattattgcccagagcagatgaaactggatgatatatgcttaaaggaggtaacgtcgatggccgacagtctgtataatattcggcttctgagagaattctccaatgaatatcttaataaatgtttttatctcaccttggaagatatgctgtatgcgccattagtgttgaagccgaatgttatggtttttattgcggagcttttttggtggttcgagaatgtcaagccagattttgttcagcccagggatgttcaggagctgaaagacgcgaaaacagtgttacaccagaagagcagccggcctcctgtaccgatctccaacgcgaccaaacgcagtttcctaggcagccctgctgcagggaccctggctgagctgcagccccccgtgcagctgccggcggaaggctgtcacaggcactacctgcacccggaagaacctgaatacctcgggaaaggaactgctgccttcagcccatcccatcctttattgccactgagacagaaacagcagaaatccatacagggagaggacatccctgatcagcgacatcgatcgaattctttgacccgagttgatggtcagcctcgaggagcagcaatagcctggccagaaaaaaaaaccaggcctgcgtcccagccaacaccttttgctctacatcacgctgcgagttgtgaagtggatcccagctctggcgacagcatcagcttggcccgctccatcagcaaagacagtttggcatccaacattgttaatctgaccccacagaaccagccacaccccacggccacgaagagccacgggaagagcctcctgagcaatgtcagtattgaggatgaggaagaggagcttgtggctattgttagagcagacgtggttccccagcaggctgacccggagttccccagggcctcaccccgggccttaggccttacagcaaatgcccggtctccccaaggacagctggacacctcggaaagtaagcctgacagttttttcttggagcctttgatgccagcagttcttaagccagcgaaagagaagcaggtgatcaccaaggaggatgaacggggggaagggagaccgaggagcatcgtgtctaggaggcccagcgagggcccccagcctttggtacgaaggaaaatgactggcagtcgcgacttgaataggacttttaccccgattccatgctcagaattccccatgggcatcgaccccaccgagacaggaccactgtcagtggaaaccgcaggagaggtctgtggtgggcctctggcccttggcggattcgatccgttcccccagggaccatccacggatggcttcttccttcatgtaggcagggccgatgaagacaccgagggaaggttatatgttagttgttcaaaaagccccaactcccacgattcagagccgtggactctcctcaggcaggattctgactcggatgtggtggacatagaggaagccgagcacgatttcatgggtgaggcccatcctgtggttttcagcagatacattggggaggaagagtcggccaaactgcaggaggacatgaaggtgaaggaacatgaagacaaagatgacgccagcggccgctcgagcccctgcctgagcacagcctctcagatgagcagtgtctccatggcgagtgggagcgtgaagatgaccagctttgcggagaggaagctccagagactcaacagctgtgagaccaagtccagcaccagcagctcccagaagaccacgccagatgcgtctgagagctgcccagcccctctgacgacgtggaggcagaagagggagcagagtccgagccagcatggcaaggatcccgccagcctcctggcatctgagctggtacagctgcacatgcagctggaggagaagcgcagggccatcgaggcccagaagaagaagatggaggcgctgtcggcaaggcagcgcctgaagctcggcaaggctgcattcctgcatgtggtgaagaagggcaaggccgaggctgccccacccctcaggccggagcactttgcaaaggagtactctcagcacaacggggaggactgtggggacgctgtttccaaaaccgaagactttctcgtgaaggaggagcagagagaggagctccttcacgagccacaggatgtggacaaagagagcctggcctttgctcagcaacataaagcaaaagaccctgtggctctgcacgagctggagagaaataaggtgatctccgctgccctcctggaggacactgttggggaggttgtcgacgtgaatgaatgtgacctttccatcgagaagcttaacgaaaccatcagtacgctgcagcaggccatcctgaaaatctctcagcagcaagagcagcttctgatgaagtcccccacagtcccagtgccaggctctaagaataactcgcaggaccacaaagtgaaggcaccagtccacttcgtggagccactctctcccacgggcgtggctggccaccgcaaagccccccggctgggtcaaggccggaattcccgttccggaaggccggcggagctgaaggtcccaaaagacaggccacagggctcctcccgaagtaaaaccccaacgcccagtgtagagacgctcccgcacttgagacccttccctgccagcagccaccctcggacgcccacggaccctggcctggacagtgccctggagcccagtggtgacccacatgggaagtgtctcttcgacagttacaggctccatgatgaaagcaatcagcggacacttactctgtcctcttccaaagatgccaacattctttcggagcagatgagcctcaaagaagttctggatgcgagtgtgaaggaggtggggtccagctcctcagatgtctcgggaaaagagagcgtccccgtggaggagcctctgaggagcagggccagcctcattgaagtggacctctccgacctgaaggcccccgacgaggatggggagctggtaagcctcgatggctcggcggaccttgtcagcgaaggcgaccagaagccgggggtcggcttcttcttcaaggatgaacagaaagcggaagatgagctcgccaagaagcgggcggccttcctcctgaagcagcagcgcaaggccgaggaggcccgcgtgcgcaagcagcagctggaagcggaggtggagctcaagcgtgacgaagcccggcgcaaagctgaggaagaccgggtgcggaaggaggaggagaaggcgcggcgcgagctcatcaagcaggagtacctgcggaggaagcagcagcagatcctagaggagcaggggctcggcaagcccaagtcaaagccgaagaagccgcggccgaagtcggtgcaccgggaagagtcgtgcagcgactccggcaccaagtgctcctccacccctgataacttgagccggactcagtcaggctccagcctgtccttggcctctgcggcgacgacagaacccgagagcgttcattccgggggcacaccctctcagcgagtggaatcgatggaagccctgcccatactgagccgtaacccaagcaggagcacagaccgagactgggagaccgcgtcggcggcatcttccctggcctcagtggccgagtacacaggtcccaagctctttaaggagcccagtagtaaatcaaacaagccgattattcacaatgccatatcccattgctgcctggctggaaaagtgaacgaaccccacaagaattccatattggaggagctggagaagtgtgatgccaatcactacatcatactgtttcgtgatgctggctgccagttcagggcgctttactgctactatcctgatactgaggaaatctacaaactcactggcacggggccaaagaacatcaccaagaaaatgatcgacaaactgtataaatacagctcagaccgaaaacagtttaacttgatcccagccaaaaccatgtctgtcagtgtggacgcactcacaatccacaaccacctgtggcagcccaagcggcctgcagtgccaaagaaggcccagactcgtaaatgaccccggtgcagctggcgtccaaagggtgacccagactcgtaaatgatgcccttgtggctggcatccagagggtgccacggggtccttatttattgttttcatctatttgggtacgaagtgtgcaaagtcacagaccttttgcaaagaggtttctagacagcagaagaaaacccctctctcagcgctcatctcacgcagaggatgccaggcagggtgaggatgggggagtagatgccgcttttgcagtggctcgcactgctgtggccactgctgaccactgaggctcccagcggagggtgttcacagccaggtcccgggccacggagctcccttacttgaagttctccttcagcatagattagacgtgatccactttgctttcttgcttctcacctcgcccccttgcacattgcctgacaccctcatattggccagctgtaatctcgtgactatgggactgaggctcaatcttggcttggggtgtttgaatgtctatagcaaaggaattcataatgggaaatctttttcatttgagaaattgtatgatatttattggttgtgtctactgccaacatttatatccaattctaagatttctgaaaaaaaattcttatcccttgctgctcagaaaaagtttacggaaaacaccagttcactaaaagcaccgaaatctgcaaagcctgtcttccgctagaacaacgtctacaaatgtgaagatgatgacttctggcacgcggtcatgagggtggggaatggcactaggagctgatgtttgcctcatttaaagtaggcaagccgagccaactgcagccatcattcattaagttttgggtagtgctctaatggtttgttcactttaataaagacagattttggtaaagtagaatatttttcattctgagcatgtttgtcccaaaaggtgatgcacttaagctgacagtcccttcagtggttttgttaggtcacggcttgtcctgtctggattctgcatctggaagcgctgcatgctctcagaggagcgtgccgtttcccctgtagatggatacttttgttttgttgcctatttaaaaacaattaagtggttatttgcagttatttcagaactccaagtaagtggatggctttgggttctttctgccttggtcccaatggtgttgatgcttctgtggagcgcggacattcccaggagcaggtgcgtgccagccatggctgccagacactgctgcaactgaccagctgccggaagattctggagccactaacattagttttgcacatattttcttgggagtgttacttgaatctatctcaaactgcagaaaaaatcaaaagatcaataattgggagaaaaagagacaaatttaactgttacataattttagatagacaaaaaacatgagtgagtcgtgtacataaggagggaacatggtacagaaggctagaaggaattataggtcttattcccctttcctcagtcctttgaagagaagtacagtctcttgcgattttgtatatatcgtgttcgacacagccgctctctgtcctgtaaatagggaactaaaggctgtatgatttctcaagtgctgagttacacagtcctgagtgagctttctgttaccatactttcacacgtgggctttatttctcactgtatgtttgatatgatattactgtatttattttaagaaagcactaagatgtaataaagtgatgaactaatttgctttacattgaatcgtatgtgtgaggttgctgtggctcatttcgctgaccaggcgacaccaactccttgctttataggagtttcacattgttctttaccatggccctatcgaagtcagtggaattggattctttttaatgaagagctagaaaatatctggcatagagctggaaaattgcattcccatgggacgtctgaatcaattctggattttctccatggaatgagtcagtgtgtggaacatcctgaaacttgtccttaagcgtgtagttttcactgttcgttgcgagtaagcactaatgtggcatggacattcctgatgtcccaagtccccaggccagtgttcgcctaatgattgacagaagcgtccctgcgttcttcatgcttggacacagcaacccttttaattagtcttgaaaagtttcagacacaggattaattttcgtggtggtgcttttgggcctttctggcttgggtggtggtaaagtcatgattttgcagttgataacactgacttataactctgtttatcaatgtctcctatattcaaagcccctgcagtggtatttgtgtctcgttgcaaatttctttcagcggaaagcttgcacaactttcgttgtgtctcagaattctaaccttgttatttaagacaagctgctctacccatttaggatataactttgtaaagaaagtgtaaaccaaatgattcaatgtatgatgaagtttatgtgtaaatccttggtaatgctagaattctgggagcccagaagggttgaaagagaaatgaaacttgcgtgagtcccattattttacgcatgtatgtgcagatacgttctacccacacgtgtgcgtgcacatggctgtgtgcgtgcaccaaagatggactgctttccatgtgtccttttgactttctgcacgtgtcactgcggtgcagtctcttagcagacttcaggcccaaactgtattcttcactcaggcaaaattgaaaagtggaataattctaaattacttctaggttatacttttacctccctgaaattgtagttgtcacttggagggcaaaatatttattgaaataaaattttctgttaaaaattca

SEQ ID NO: 703 - DNA, 5730 bp, Homo sapiens
gcccggcgcggcgaggggcggcggcgcctttgttgcggccgggccgccgcctcagccctttgtctgcagatggtggacgcgagcggccgcgccgccgccgagggctggaggaagatggaggccccgccggacggcgccgccgacctcgtgcccctggaccgctacgacgcggcgcgcgccaagatcgccgccaacctgcagtggatctgcgccaaggcctacggccgagataacatccctgaggacctcagagaccctttctacgttgaccagtatgagcaggagcacattaagccgcctgttatcaagcttctcctgtccagcgagctgtactgccgtgtctgcagcctcatcctgaaaggggaccaggtggccgccttacagggacaccagtctgtcatccaggccctgtcccggaaagggatctatgtgatggagagtgatgacacccccgtgacagagtccgacctcagtcgcgcacccataaaaatgagtgcccacatggcaatggtggatgccctgatgatggcctacactgtggagatgatcagcatcgagaaggtggtggccagtgtcaagcgcttctcaacgttcagtgcctcgaaagaacttccgtacgacctcgaggatgccatggtgttctggatcaacaaggtaaatcttaaaatgagagagataacagagaaagaagttaaattaaaacaacagttattggaaagtccagctcatcaaaagtctccctccaagtggtattggaagttagtgcctgtccgctatcgacgagagcacctttctgctaggcagtcaccctacttcccgttgttggaggatttgatgagagacggcagtgatggtgctgctctcttagctgtgattcactattattgcccagagcagatgaaactggatgatatatgcttaaaggaggtaacgtcgatggccgacagtctgtataatattcggcttctgagagaattctccaatgaatatcttaataaatgtttttatctcaccttggaagatatgctgtatgcgccattagtgttgaagccgaatgttatggtttttattgcggagcttttttggtggttcgagaatgtcaagccagattttgttcagcccagggatgttcaggagctgaaagacgcgaaaacagtgttacaccagaagagcagccggcctcctgtaccgatctccaacgcgaccaaacgcagtttcctaggcagccctgctgcagggaccctggctgagctgcagccccccgtgcagctgccggcggaaggctgtcacaggcactacctgcacccggaagaacctgaatacctcgggaaaggaactgctgccttcagcccatcccatcctttattgccactgagacagaaacagcagaaatccatacagggagaggacatccctgatcagcgacatcgatcgaattctttgacccgagttgatggtcagcctcgaggagcagcaatagcctggccagaaaaaaaaaccaggcctgcgtcccagccaacaccttttgctctacatcacgctgcgagttgtgaagtggatcccagctctggcgacagcatcagcttggcccgctccatcagcaaagacagtttggcatccaacattgttaatctgaccccacagaaccagccacaccccacggccacgaagagccacgggaagagcctcctgagcaatgtcagtattgaggatgaggaagaggagcttgtggctattgttagagcagacgtggttccccagcaggctgacccggagttccccagggcctcaccccgggccttaggccttacagcaaatgcccggtctccccaaggacagctggacacctcggaaagtaagcctgacagttttttcttggagcctttgatgccagcagttcttaagccagcgaaagagaagcaggtgatcaccaaggaggatgaacggggggaagggagaccgaggagcatcgtgtctaggaggcccagcgagggcccccagcctttggtacgaaggaaaatgactggcagtcgcgacttgaataggacttttaccccgattccatgctcagaattccccatgggcatcgaccccaccgagacaggaccactgtcagtggaaaccgcaggagaggtctgtggtgggcctctggcccttggcggattcgatccgttcccccagggaccatccacggatggcttcttccttcatgtaggcagggccgatgaagacaccgagggaaggttatatgttagttgttcaaaaagccccaactcccacgattcagagccgtggactctcctcaggcaggattctgactcggatgtggtggacatagaggaagccgagcacgatttcatgggtgaggcccatcctgtggttttcagcagatacattggggaggaagagtcggccaaactgcaggaggacatgaaggtgaaggaacatgaagacaaagatgacgccagcggccgctcgagcccctgcctgagcacagcctctcagatgagcagtgtctccatggcgagtgggagcgtgaagatgaccagctttgcggagaggaagctccagagactcaacagctgtgagaccaagtccagcaccagcagctcccagaagaccacgccagatgcgtctgagagctgcccagcccctctgacgacgtggaggcagaagagggagcagagtccgagccagcatggcaaggatcccgccagcctcctggcatctgagctggtacagctgcacatgcagctggaggagaagcgcagggccatcgaggcccagaagaagaagatggaggcgctgtcggcaaggcagcgcctgaagctcggcaaggctgcattcctgcatgtggtgaagaagggcaaggccgaggctgccccacccctcaggccggagcactttgcaaaggagtactctcagcacaacggggaggactgtggggacgctgtttccaaaaccgaagactttctcgtgaaggaggagcagagagaggagctccttcacgagccacaggatgtggacaaagagagcctggcctttgctcagcaacataaagcaaaagaccctgtggctctgcacgagctggagagaaataaggtgatctccgctgccctcctggaggacactgttggggaggttgtcgacgtgaatgaatgtgacctttccatcgagaagcttaacgaaaccatcagtacgctgcagcaggccatcctgaaaatctctcagcagcaagagcagcttctgatgaagtcccccacagtcccagtgccaggctctaagaataactcgcaggaccacaaagtgaaggcaccagtccacttcgtggagccactctctcccacgggcgtggctggccaccgcaaagccccccggctgggtcaaggccggaattcccgttccggaaggccggcggagctgaaggtcccaaaagacaggccacagggctcctcccgaagtaaaaccccaacgcccagtgtagagacgctcccgcacttgagacccttccctgccagcagccaccctcggacgcccacggaccctggcctggacagtgccctggagcccagtggtgacccacatgggaagtgtctcttcgacagttacaggctccatgatgaaagcaatcagcggacacttactctgtcctcttccaaagatgccaacattctttcggagcagatgagcctcaaagaagttctggatgcgagtgtgaaggaggtggggtccagctcctcagatgtctcgggaaaagagagcgtccccgtggaggagcctctgaggagcagggccagcctcattgaagtggacctctccgacctgaaggcccccgacgaggatggggagctggtaagcctcgatggctcggcggaccttgtcagcgaaggcgaccagaagccgggggtcggcttcttcttcaaggatgaacagaaagcggaagatgagctcgccaagaagcgggcggccttcctcctgaagcagcagcgcaaggccgaggaggcccgcgtgcgcaagcagcagctggaagcggaggtggagctcaagcgtgacgaagcccggcgcaaagctgaggaagaccgggtgcggaaggaggaggagaaggcgcggcgcgagctcatcaagcaggagtacctgcggaggaagcagcagcagatcctagaggagcaggggctcggcaagcccaagtcaaagccgaagaagccgcggccgaagtcggtgcaccgggaagagtcgtgcagcgactccggcaccaagtgctcctccacccctgataacttgagccggactcagtcaggctccagcctgtccttggcctctgcggcgacgacagaacccgagagcgttcattccgggggcacaccctctcagcgagtggaatcgatggaagccctgcccatactgagccgtaacccaagcaggagcacagaccgagactgggagaccgcgtcggcggcatcttccctggcctcagtggccgagtacacaggtcccaagctctttaaggagcccagtagtaaatcaaacaagccgattattcacaatgccatatcccattgctgcctggctggaaaagtgaacgaaccccacaagaattccatattggaggagctggagaagtgtgatgccaatcactacatcatactgtttcgtgatgctggctgccagttcagggcgctttactgctactatcctgatactgaggaaatctacaaactcactggcacggggccaaagaacatcaccaagaaaatgatcgacaaactgtataaatacagctcagaccgaaaacagtttaacttgatcccagccaaaaccatgtctgtcagtgtggacgcactcacaatccacaaccacctgtggcagcccaagcggcctgcagtgccaaagaaggcccagactcgtaaatgaccccggtgcagctggcgtccaaagggtgacccagactcgtaaatgatgcccttgtggctggcatccagagggtgccacggggtccttatttattgttttcatctatttgggtacgaagtgtgcaaagtcacagaccttttgcaaagaggtttctagacagcagaagaaaacccctctctcagcgctcatctcacgcagaggatgccaggcagggtgaggatgggggagtagatgccgcttttgcagtggctcgcactgctgtggccactgctgaccactgaggctcccagcggagggtgttcacagccaggtcccgggccacggagctcccttacttgaagttctccttcagcatagattagacgtgatccactttgctttcttgcttctcacctcgcccccttgcacattgcctgacaccctcatattggccagctgtaatctcgtgactatgggactgaggctcaatcttggcttggggtgtttgaatgtctatagcaaaggaattcataatgggaaatctttttcatttgagaaattgtatgatatttattggttgtgtctactgccaacatttatatccaattctaagatttctgaaaaaaaattcttatcccttgctgctcagaaaaagtttacggaaaacaccagttcactaaaagcaccgaaatctgcaaagcctgtcttccgctagaacaacgtctacaaatgtgaagatgatgacttctggcacgcggtcatgagggtggggaatggcactaggagctgatgtttgcctcatttaaagtaggcaagccgagccaactgcagccatcattc

SEQ ID NO: 704 - DNA, 2390 bp, Homo sapiens
tgggccctgccctgagctgccaccgggaagccagcctcagggactgcagcgacccccaaacacccctcccccaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacgggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtgaactaccgaggccaggtggtgagcctgatccggatgcggaacccctggggcgaggtggagtggacgggagcctggagcgacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgaggtccctccggagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattg

SEQ ID NO: 705 - DNA, 3007 bp, Homo sapiens
aaggagagagggagggcggagggcggaggggcggcgggaggagggcggggaggagcgctcttcctggttgggccctgccctgagctgccaccgggaagccagcctcagggactgcagcgacccccaaacacccctcccccaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtgaactaccgaggccaggtggtgagcctgatccggatgcggaacccctggggcgaggtggagtggacgggagcctggagcgacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgaggtccctccggagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtg

SEQ ID NO: 706 - DNA, 2960 bp, Homo sapiens
tggcccccggcctgcggagggaggggcggggagacaccgtgagtaagagatagtcagagaccgtgccggagagataagggagagccgagaggaagcggggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtgaactaccgaggccaggtggtgagcctgatccggatgcggaacccctggggcgaggtggagtggacgggagcctggagcgacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgaggtccctccggagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtc

SEQ ID NO: 707 - DNA, 550 bp, Homo sapiens
ctaatttgtcctctcgcggaattggcccccggcctgcggagggaggggcggggagacaccgtgagatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgt

SEQ ID NO: 708 - DNA, 3086 bp, Homo sapiens
gggatccgggaaaggagaggtggccggcacgcctgggaactgggaaatccctttcctggattcactgggagcaccgggaggtggctgagaaccctacttctgtgaggggagcagtgaggcagggaaaccctaggtttggggatggataagcaggggcaggagagcagagcttgcaggcaggagcccaggttctagtcttgggaaggcctgggttctgagcaggcccatctgtccggcaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtgaactaccgaggccaggtggtgagcctgatccggatgcggaacccctggggcgaggtggagtggacgggagcctggagcgacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgaggtccctccggagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaag

SEQ ID NO: 709 - DNA, 564 bp, Homo sapiens
actacagagctgcaagcccctgacaatgggatccgggaaaggagaggtggccggcacgcctgggaactgggaaatccctttcctggattcactgggagcaccgggaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccag

SEQ ID NO: 710 - DNA, 582 bp, Homo sapiens
gcgctggcccctccccggggactgctctgccttttactaatttgtcctctcgcggaattggcccccggcctgcggagggaggggcggggagacaccgatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgt

SEQ ID NO: 711 - DNA, 571 bp, Homo sapiens
acccttctctgtccctggacacctgcgcagaaagcctaggagctggttccacccatcactcaccaggttaggtatttcaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcg

SEQ ID NO: 712 - DNA, 593 bp, Homo sapiens
gacacatgggcgcttccaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgctt

SEQ ID NO: 713 - DNA, 576 bp, Homo sapiens
aatctcggccccgcgccggggctggctgggaacggcgggagcagctgcggtcgcgcggagcgaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatca

SEQ ID NO: 714 - DNA, 496 bp, Homo sapiens
actacagagctgcaagcccctgacaatgggatccgggaaaggagaggtggccggcacgcctgggaactgggaaatccctttcctggattcactgggagcaccgggaggtggctgagaaccctacttctgatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcct

SEQ ID NO: 715 - DNA, 568 bp, Homo sapiens
cttcctggttgggccctgccctgagctgccaccgggaagccagcctcagggactgcagcgacccccaaacacccctcccccaggtaagaagctgggtagccgagccgggattccttgaccctggccactgctcctgggctgaggggctgccccagcacggtcccttctcgggggcctctgcgttcctggagcaggggtgggggctggcggagcggcacagcccaggcgcctgtcccagcctggctcaccgctgtccccaggggctgggctagggcccaccagctctgatatcgagcctgctgcgggggcctgaggagggggaccccgaccgtctggggttttcagcccacggcaaggggccggtgcaccaggagcttggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccg

SEQ ID NO: 716 - DNA, 2792 bp, Homo sapiens
ctctcgcggaattggcccccggcctgcggagggaggggcggggagacaccgtgagtaagagatagtcagagaccgatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtgaactaccgaggccaggtggtgagcctgatccggatgcggaacccctggggcgaggtggagtggacgggagcctggagcgacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgaggtccctccggagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctcc

SEQ ID NO: 717 - DNA, 3083 bp, Homo sapiens
gaaagtcgggccgaacggggcagggacttacccaaggtcacgcagcgagcccggtccccctgcgttccccggggagcgctgagccgggacgcggcggtggggtggggaaggggagtggcgcggccctgcggggtgaggctgccgtttgctgagtgtccggcaggggtctgctcgctgccagcccggcccctcctcagagcagctgccgcagcccgaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtgaactaccgaggccaggtggtgagcctgatccggatgcggaacccctggggcgaggtggagtggacgggagcctggagcgacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgaggtccctccggagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtga

SEQ ID NO: 718 - DNA, 573 bp, Homo sapiens
cctgacaatgggatccgggaaaggagaggtggccggcacgcctgggaactgggaaatccctttcctggattcactgggagcaccgggaggtggctgagaaccctacttctgtgaggggagcagtgaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatct

SEQ ID NO: 719 - DNA, 581 bp, Homo sapiens
gttgggccctgccctgagctgccaccgggaagccagcctcagggactgcagcgacccccaaacacccctcccccagttccttgtgctgtctggaggctccgccctgccccacctgacctgctggctcactacagagctgcaagcccctgacaatgggatccgggaaaggagaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttcc

SEQ ID NO: 720 - DNA, 3573 bp, Homo sapiens
cctccccggcgccgggccgcgccatcccgggagctgtccgcagatggcagcaccggccccgggtcgcggcgttcccggcgctcggcaggccgcaggatggcctggtcccgggccgggagcccagcaggccgggagcggctgaggccacaccccgcgggccgggccgcttccctccggtgaatcatcgctcgcagcggcggcgcccgcagtggccgcagcagcgcgccgggccctggccgcgccccagccgagcgcagcgcggagtcgccccgacctttctctgcgcagtacggccgccgggaccgcagcatggcgggcatcgcggccaagctggcgaaggaccgggaggcggccgaggggctgggctcccacgacagggccatcaagtacctcaaccaggactacgaggcgctgcggaacgagtgcctggaggccgggacgctcttccaggacccgtccttcccggccatcccctcggccctgggcttcaaggagttggggccctactccagcaaaacccggggcatcgagtggaagcgccccacggagatctgcgctgacccccagtttatcattggaggagccacccgcacagacatctgccaaggagccctgggtgactgctggctgctggcagccattgcctccctcaccttgaatgaagaaatcctggctcgagtcgtccccctaaaccagagcttccaggaaaactatgcagggatctttcacttccagttctggcaatacggcgagtgggtggaggtggtggtggatgacaggctgcccaccaaggacggggagctgctctttgtgcattcagccgaagggagcgagttctggagcgccctgctggagaaggcatacgccaagatcaacggatgctatgaagcgctatcagggggtgccaccactgagggcttcgaagacttcaccggaggcattgctgagtggtatgagttgaagaagccccctcccaacctgttcaagatcatccagaaagctctgcaaaaaggctctctccttggctgctccatcgacatcaccagcgccgcggactcggaggccatcacgtttcagaagctggtgaaggggcacgcgtactcggtcaccggagccgaggaggttgaaagtaacggaagcctacagaaactgatccgcatccgaaatccctggggagaagtggagtggacagggcggtggaatgacaactgcccaagctggaacactatagacccagaggagagggaaaggctgaccagacggcatgaagatggagaattctggatgtctttcagtgacttcctgaggcactattcccgcctggagatctgtaacctgaccccagacactctcaccagcgatacctacaagaagtggaaactcaccaaaatggatgggaactggaggcggggctccaccgcgggaggttgcaggaactacccgaacacattctggatgaaccctcagtacctgatcaagctggaggaggaggatgaggacgaggaggatggggagagcggctgcaccttcctggtggggctcattcagaagcaccgacggcggcagaggaagatgggcgaggacatgcacaccatcggctttggcatctatgaggttccagaggagttaagtgggcagaccaacatccacctcagcaaaaacttcttcctgacgaatcgcgccagggagcgctcagacaccttcatcaacctccgggaggtgctcaaccgcttcaagctgccgccaggagagtacattctcgtgccttccaccttcgaacccaacaaggatggggatttctgcatccgggtcttttctgaaaagaaagctgactaccaagctgtcgatgatgaaatcgaggccaatcttgaagagttcgacatcagcgaggatgacattgatgatggattcaggagactgtttgcccagttggcaggagaggatgcggagatctctgcctttgagctgcagaccatcctgagaagggttctagcaaagcgccaagatatcaagtcagatggcttcagcatcgagacatgcaaaattatggttgacatgctagattcggacgggagtggcaagctggggctgaaggagttctacattctctggacgaagattcaaaaataccaaaaaatttaccgagaaatcgacgttgacaggtctggtaccatgaattcctatgaaatgcggaaggcattagaagaagcaggtttcaagatgccctgtcaactccaccaagtcatcgttgctcggtttgcagatgaccagctcatcatcgattttgataattttgttcggtgtttggttcggctggaaacgctattcaagatatttaagcagctggatcccgagaatactggaacaatagagctcgaccttatctcttggctctgtttctcagtactttgaagttataactaatctgcctgaagacttctcatgatggaaaatcagccaaggactaagcttccatagaaatacactttgtatctggacctcaaaattatgggaacatttacttaaacggatgatcatagctgaaaataatgatactgtcaatttgagatagcagaagtttcacacatcaaagtaaaagatttgcatatcattatactaaatgcaaatgagtcgcttaacccttgacaaggtcaaagaaagctttaaatctgtaaatagtatacactttttacttttacacactttcctgttcatagcaatattaaatcaggaaaaaaaaatgcagggaggtatttaacagctgagcaaaaacattgagtcgctctcaaaggacacgaggcccttggcagggaatatttaaagcaacttcaagtttaaaatgcagctgttgattctaccaaacaacagtccaagattaccatttcccatgagccaactgggaaacatggtatatcatgaagtaatcttgtcaaggcatctggagagtccaggagagaagactcacctctgtcgcttgggttaaacaagagacaggttttgtagaatattgattggtaatagtaaatcgttctccttacaatcaagttcttgaccctattcggccttatacatctggtcttacaaagaccaaagggatcctgcgcttgatcaactgaaccagtatgccaaaaccaggcatccaatttgtaaaccaattatgataaaggacaaaataagctgtttgccacctcaaaactttatgaacttcaccaccactagtgtctgtccatggagttagaggggacatcacttagaagttcttatagaaaggacacaagtttgtttcctggctttaccttgggaaaatgctagcaacattatagaaattttgccttgttgccttatcttcttccaaatgtactgttaaataaaaataaagggttaccccatgcaatcacaccatgccatgttttccttcctggagggcagccccacaggacggtttatgagcacacaattatagcttgtttctactttaacaaggtatgctgcctctgtaaattcatgtattcaaaggaaaagacaccttgcctataattaaaatgtggaactataaaattttttaaaatccaa

SEQ ID NO: 721 - DNA, 3178 bp, Homo sapiens
gcgcgccgggccctggccgcgccccagccgagcgcagcgcggagtcgccccgacctttctctgcgcagtacggccgccgggaccgcagcatggcgggcatcgcggccaagctggcgaaggaccgggaggcggccgaggggctgggctcccacgacagggccatcaagtacctcaaccaggactacgaggcgctgcggaacgagtgcctggaggccgggacgctcttccaggacccgtccttcccggccatcccctcggccctgggcttcaaggagttggggccctactccagcaaaacccggggcatcgagtggaagcgccccacggagatctgcgctgacccccagtttatcattggaggagccacccgcacagacatctgccaaggagccctgggtgactgctggctgctggcagccattgcctccctcaccttgaatgaagaaatcctggctcgagtcgtccccctaaaccagagcttccaggaaaactatgcagggatctttcacttccagttctggcaatacggcgagtgggtggaggtggtggtggatgacaggctgcccaccaaggacggggagctgctctttgtgcattcagccgaagggagcgagttctggagcgccctgctggagaaggcatacgccaagatcaacggatgctatgaagcgctatcagggggtgccaccactgagggcttcgaagacttcaccggaggcattgctgagtggtatgagttgaagaagccccctcccaacctgttcaagatcatccagaaagctctgcaaaaaggctctctccttggctgctccatcgacatcaccagcgccgcggactcggaggccatcacgtttcagaagctggtgaaggggcacgcgtactcggtcaccggagccgaggaggttgaaagtaacggaagcctacagaaactgatccgcatccgaaatccctggggagaagtggagtggacagggcggtggaatgacaactgcccaagctggaacactatagacccagaggagagggaaaggctgaccagacggcatgaagatggagaattctggatgtctttcagtgacttcctgaggcactattcccgcctggagatctgtaacctgaccccagacactctcaccagcgatacctacaagaagtggaaactcaccaaaatggatgggaactggaggcggggctccaccgcgggaggttgcaggaactacccgaacacattctggatgaaccctcagtacctgatcaagctggaggaggaggatgaggacgaggaggatggggagagcggctgcaccttcctggtggggctcattcagaagcaccgacggcggcagaggaagatgggcgaggacatgcacaccatcggctttggcatctatgaggtgcatcctcagttaagtgggcagaccaacatccacctcagcaaaaacttcttcctgacgaatcgcgccagggagcgctcagacaccttcatcaacctccgggaggtgctcaaccgcttcaagctgccgccaggagagtacattctcgtgccttccaccttcgaacccaacaaggatggggatttctgcatccgggtcttttctgaaaagaaagctgactaccaagctgtcgatgatgaaatcgaggccaatcttgaagagttcgacatcagcgaggatgacattgatgatggattcaggagactgtttgcccagttggcaggagaggatgcggagatctctgcctttgagctgcagaccatcctgagaagggttctagcaaagcgccaagatatcaagtcagatggcttcagcatcgagacatgcaaaattatggttgacatgctagattcggacgggagtggcaagctggggctgaaggagttctacattctctggacgaagattcaaaaataccaaaaaatttaccgagaaatcgacgttgacaggtctggtaccatgaattcctatgaaatgcggaaggcattagaagaagcaggtttcaagatgccctgtcaactccaccaagtcatcgttgctcggtttgcagatgaccagctcatcatcgattttgataattttgttcggtgtttggttcggctggaaacgctattcaagatatttaagcagctggatcccgagaatactggaacaatagagctcgaccttatctcttggctctgtttctcagtactttgaagttataactaatctgcctgaagacttctcatgatggaaaatcagccaaggactaagcttccatagaaatacactttgtatctggacctcaaaattatgggaacatttacttaaacggatgatcatagctgaaaataatgatactgtcaatttgagatagcagaagtttcacacatcaaagtaaaagatttgcatatcattatactaaatgcaaatgagtcgcttaacccttgacaaggtcaaagaaagctttaaatctgtaaatagtatacactttttacttttacacactttcctgttcatagcaatattaaatcaggaaaaaaaaatgcagggaggtatttaacagctgagcaaaaacattgagtcgctctcaaaggacacgaggcccttggcagggaatatttaaagcaacttcaagtttaaaatgcagctgttgattctaccaaacaacagtccaagattaccatttcccatgagccaactgggaaacatggtatatcatgaagtaatcttgtcaaggcatctggagagtccaggagagaagactcacctctgtcgcttgggttaaacaagagacaggttttgtagaatattgattggtaatagtaaatcgttctccttacaatcaagttcttgaccctattcggccttatacatctggtcttacaaagaccaaagggatcctgcgcttgatcaactgaaccagtatgccaaaaccaggcatccaatttgtaaaccaattatgataaaggacaaaataagctgtttgccacctcaaaactttatgaacttcaccaccactagtgtctgtccatggagttagaggggacatcacttagaagttcttatagaaaggacacaagtttgtttcctggctttaccttgggaaaatgctagcaacattatagaaattttgccttgttgccttatcttcttccaaatgtactgttaaataaaaataaagggttaccccatgcaatcac

SEQ ID NO: 722 - DNA, 3264 bp, Homo sapiens
actcagactctgatggctctgtagctaactggcccatcctcagagactaacgcaaaggaacgaatttccaggatgttcgactatgtggagaaaacaaaaaaaaagcaaagaaaaaaatatttttaaagaaagaaagaaggccaggtgcagtggttcacgcctgtaatcccaacactttgggaggccgaggcagacagatcacctgaggtcaggagttcaagaccagcctggccaacatggagatctgcgctgacccccagtttatcattggaggagccacccgcacagacatctgccaaggagccctgggtgactgctggctgctggcagccattgcctccctcaccttgaatgaagaaatcctggctcgagtcgtccccctaaaccagagcttccaggaaaactatgcagggatctttcacttccagttctggcaatacggcgagtgggtggaggtggtggtggatgacaggctgcccaccaaggacggggagctgctctttgtgcattcagccgaagggagcgagttctggagcgccctgctggagaaggcatacgccaagatcaacggatgctatgaagcgctatcagggggtgccaccactgagggcttcgaagacttcaccggaggcattgctgagtggtatgagttgaagaagccccctcccaacctgttcaagatcatccagaaagctctgcaaaaaggctctctccttggctgctccatcgacatcaccagcgccgcggactcggaggccatcacgtttcagaagctggtgaaggggcacgcgtactcggtcaccggagccgaggaggttgaaagtaacggaagcctacagaaactgatccgcatccgaaatccctggggagaagtggagtggacagggcggtggaatgacaactgcccaagctggaacactatagacccagaggagagggaaaggctgaccagacggcatgaagatggagaattctggatgtctttcagtgacttcctgaggcactattcccgcctggagatctgtaacctgaccccagacactctcaccagcgatacctacaagaagtggaaactcaccaaaatggatgggaactggaggcggggctccaccgcgggaggttgcaggaactacccgaacacattctggatgaaccctcagtacctgatcaagctggaggaggaggatgaggacgaggaggatggggagagcggctgcaccttcctggtggggctcattcagaagcaccgacggcggcagaggaagatgggcgaggacatgcacaccatcggctttggcatctatgaggttccagaggagttaagtgggcagaccaacatccacctcagcaaaaacttcttcctgacgaatcgcgccagggagcgctcagacaccttcatcaacctccgggaggtgctcaaccgcttcaagctgccgccaggagagtacattctcgtgccttccaccttcgaacccaacaaggatggggatttctgcatccgggtcttttctgaaaagaaagctgactaccaagctgtcgatgatgaaatcgaggccaatcttgaagagttcgacatcagcgaggatgacattgatgatggattcaggagactgtttgcccagttggcaggagaggatgcggagatctctgcctttgagctgcagaccatcctgagaagggttctagcaaagcgccaagatatcaagtcagatggcttcagcatcgagacatgcaaaattatggttgacatgctagattcggacgggagtggcaagctggggctgaaggagttctacattctctggacgaagattcaaaaataccaaaaaatttaccgagaaatcgacgttgacaggtctggtaccatgaattcctatgaaatgcggaaggcattagaagaagcaggtttcaagatgccctgtcaactccaccaagtcatcgttgctcggtttgcagatgaccagctcatcatcgattttgataattttgttcggtgtttggttcggctggaaacgctattcaagatatttaagcagctggatcccgagaatactggaacaatagagctcgaccttatctcttggctctgtttctcagtactttgaagttataactaatctgcctgaagacttctcatgatggaaaatcagccaaggactaagcttccatagaaatacactttgtatctggacctcaaaattatgggaacatttacttaaacggatgatcatagctgaaaataatgatactgtcaatttgagatagcagaagtttcacacatcaaagtaaaagatttgcatatcattatactaaatgcaaatgagtcgcttaacccttgacaaggtcaaagaaagctttaaatctgtaaatagtatacactttttacttttacacactttcctgttcatagcaatattaaatcaggaaaaaaaaatgcagggaggtatttaacagctgagcaaaaacattgagtcgctctcaaaggacacgaggcccttggcagggaatatttaaagcaacttcaagtttaaaatgcagctgttgattctaccaaacaacagtccaagattaccatttcccatgagccaactgggaaacatggtatatcatgaagtaatcttgtcaaggcatctggagagtccaggagagaagactcacctctgtcgcttgggttaaacaagagacaggttttgtagaatattgattggtaatagtaaatcgttctccttacaatcaagttcttgaccctattcggccttatacatctggtcttacaaagaccaaagggatcctgcgcttgatcaactgaaccagtatgccaaaaccaggcatccaatttgtaaaccaattatgataaaggacaaaataagctgtttgccacctcaaaactttatgaacttcaccaccactagtgtctgtccatggagttagaggggacatcacttagaagttcttatagaaaggacacaagtttgtttcctggctttaccttgggaaaatgctagcaacattatagaaattttgccttgttgccttatcttcttccaaatgtactgttaaataaaaataaagggttaccccatgcaatcacaccatgccatgttttccttcctggagggcagccccacaggacggtttatgagcacacaattatagcttgtttctactttaacaaggtatgctgcctctgtaaattcatgtattcaaaggaaaagacaccttgcctataattaaaatgtggaactataaaattttttaaaatcc

SEQ ID NO: 723 - DNA, 577 bp, Homo sapiens
caaaggaacgaatttccaggatgttcgactatgtggagaaaacaaaaaaaaagcaaagaaaaaaatatttttaaagaaagaaagaaggccaggtgcagtggttcacgcctgtaatcccaacactttgggaggccgaggcagacagatcacctgaggtcaggagttcaagaccagcctggccaacatggagatctgcgctgacccccagtttatcattggaggagccacccgcacagacatctgccaaggagccctgggtgactgctggctgctggcagccattgcctccctcaccttgaatgaagaaatcctggctcgagtcgtccccctaaaccagagcttccaggaaaactatgcagggatctttcacttccagttctggcaatacggcgagtgggtggaggtggtggtggatgacaggctgcccaccaaggacggggagctgctctttgtgcattcagccgaagggagcgagttctggagcgccctgctggagaaggcatacgccaagatcaacggatgctatgaagcgctatcagggggtgccaccactgagggcttcgaagacttcaccgga

SEQ ID NO: 724 - DNA, 1172 bp, Homo sapiens
agaccactcctcccggcgccgggctcagcccgccttcgccttccctctccccgcggtgtgttacgtgggggagagaataaaactccagcgagatccgggccgtgaacgaaagcagtgacggaggagcttgtaccaccggtaactaaatgaccatggaatctggagccgagaaccagcagagtggagatgcagctgtaacagaagctgaaaaccaacaaatgacagttcaagcccagccacagattgccacattagcccaggtatctatgccagcagctcatgcaacatcatctgctcccaccgtaactctagtacagctgcccaatgggcagacagttcaagtccatggagtcattcaggcggcccagccatcagttattcagtctccacaagtccaaacagttcagtcttcctgtaaggacttaaaaagacttttctccggaacacagatttcaactattgcagaaagtgaagattcacaggagtcagtggatagtgtaactgattcccaaaagcgaagggaaattctttcaaggaggccttcctacaggaaaattttgaatgacttatcttctgatgcaccaggagtgccaaggattgaagaagagaagtctgaagaggagacttcagcacctgccatcaccactgtaacggtgccaactccaatttaccaaactagcagtggacagtatattgccattacccagggaggagcaatacagctggctaacaatggtaccgatggggtacagggcctgcaaacattaaccatgaccaatgcagcagccactcagccgggtactaccattctacagtatgcacagaccactgatggacagcagatcttagtgcccagcaaccaagttgttgttcaagctgcctctggagacgtacaaacataccagattcgcacagcacccactagcactattgcccctggagttgttatggcatcctccccagcacttcctacacagcctgctgaagaagcagcacgaaagagagaggtccgtctaatgaagaacagggaagcagctcgagagtgtcgtagaaagaagaaagaatatgtgaaatgtttagaaaacagagtggcagtgcttgaaaatcaaaacaagacattgattgaggagctaaaagcacttaaggacctttactgccacaaatcagattaa

SEQ ID NO: 725 - DNA, 7588 bp, Homo sapiens
gcgcactcggcactgggcggcgctggctggctccctggctgcggctcctcagtcggcggcggctgctgctgcctgtggcccgggcggctgggagaagcggagtgttggtgagtgacgcggcggaggtgtagtttgacgcggtgtgttacgtgggggagagaataaaactccagcgagatccgggccgtgaacgaaagcagtgacggaggagcttgtaccaccggtaactaaatgaccatggaatctggagccgagaaccagcagagtggagatgcagctgtaacagaagctgaaaaccaacaaatgacagttcaagcccagccacagattgccacattagcccaggtatctatgccagcagctcatgcaacatcatctgctcccaccgtaactctagtacagctgcccaatgggcagacagttcaagtccatggagtcattcaggcggcccagccatcagttattcagtctccacaagtccaaacagttcagatttcaactattgcagaaagtgaagattcacaggagtcagtggatagtgtaactgattcccaaaagcgaagggaaattctttcaaggaggccttcctacaggaaaattttgaatgacttatcttctgatgcaccaggagtgccaaggattgaagaagagaagtctgaagaggagacttcagcacctgccatcaccactgtaacggtgccaactccaatttaccaaactagcagtggacagtatattgccattacccagggaggagcaatacagctggctaacaatggtaccgatggggtacagggcctgcaaacattaaccatgaccaatgcagcagccactcagccgggtactaccattctacagtatgcacagaccactgatggacagcagatcttagtgcccagcaaccaagttgttgttcaagctgcctctggagacgtacaaacataccagattcgcacagcacccactagcactattgcccctggagttgttatggcatcctccccagcacttcctacacagcctgctgaagaagcagcacgaaagagagaggtccgtctaatgaagaacagggaagcagctcgagagtgtcgtagaaagaagaaagaatatgtgaaatgtttagaaaacagagtggcagtgcttgaaaatcaaaacaagacattgattgaggagctaaaagcacttaaggacctttactgccacaaatcagattaatttgggatttaaattttcacctgttaaggtggaaaatggactggcttggccacaacctgaaagacaaaataaacattttattttctaaacatttctttttttctatgcgcaaaactgcctgaaagcaactacagaatttcattcatttgtgcttttgcattaaactgtgaatgttccaacacctgcctccacttctcccctcaagaaattttcaacgccaggaatcatgaagagacttctgcttttcaacccccaccctcctcaagaagtaataatttgtttacttgtaaattgatgggagaaatgaggaaaagaaaatctttttaaaaatgatttcaaggtttgtgctgagctccttgattgccttagggacagaattaccccagcctcttgagctgaagtaatgtgtgggccgcatgcataaagtaagtaaggtgcaatgaagaagtgttgattgccaaattgacatgttgtcacattctcattgtgaattatgtaaagttgttaagagacataccctctaaaaaagaactttagcatggtattgaaggaattagaaatgaatttggagtgctttttatgtatgttgtcttcttcaatactgaaaatttgtccttggttcttaaaagcattctgtactaatacagctcttccatagggcagttgttgcttcttaattcagttctgtatgtgttcaacatttttgaatacattaaaagaagtaaccaactgaacgacaaagcatggtatttgaattttaaattaaagcaaagtaaataaaagtacaaagcatattttagttagtactaaattcttagtaaaatgctgatcagtaaaccaatcccttgagttatataacaagatttttaaataaatgttattgtcctcaccttcaaaaatatttatattgtcactcatttacgtaaaaagatatttctaatttactgttgcccattgcacttacataccaccaccaagaaagccttcaagatgtcaaataaagcaaagtgatatatatttgtttatgaaatgttacatgtagaaaaatactgattttaaatattttccatattaacaatttaacagagaatctctagtgaattttttaaatgaaagaagttgtaaggatataaaaagtacagtgttagatgtgcacaaggaaagttattttcagacatatttgaatgactgctgtactgcaatatttggattgtcattcttacaaaacatttttttgttctcttgtaaaaagagtagttattagttctgctttagctttccaatatgctgtatagcctttgtcattttataattttaattcctgattaaaacagtctgtatttgtgtatatcatacattgttttcaataccacttttaattgttactcattttattcactaagctcgataaatctaacagttactcttaaaaaaaaaaaaaaaagactaaggtggattttaaaaattggaaactgacataatgttaggttataatttctcatttggagccgggcgcagtggctcacgcctgtaatcccagcactttgggaggccaaggtgggtggatcacctgtggtcaagagttcaagaccagcctggccatcatggtgaaaccccatctctactaaaaatacaaaaattagccaggcgtggtggctggcgcctgtaatcccagctactcaggaggttgaggcagcagaattgcttgaacccaggaggcagagggttgcagtgagccgagatagcaccattgcactccagcctgggcgactccatctcaaaaaataaaaataaaaaaaatgtctcatttgggaaggaaattccttttaaaaaagagttgagacacttagaaaactaatgttttatatttagtcaagagttatttaagaaagtcaagcttgtttaacaacaaaatatgaagatttaagtgttaattgctggatccattttaaaataagattttaattaacatttgtaaatggtatattttcgtttgtaacaaaccattgtcttttttcaaggatgaacagagtttatgaaggagcatcattctaagaattaagtgatgtagtctttatgtttggacagttcaccagattctcaagaaggctttcaaacaactataaagtttgatgtttgtcctgctgagctaatggggaaagttatagcataaaaattgtgtaaccgcatagatatgtcatttttaaaaactggtttaacagaaatcaagcaaagtcacaaatatgttcacaagttggaattatttattgagtcaaaatgtcgaatcgaacattttgaatgaagtaagtgttataaatgaaaaattgcctgatgtttagcagtttgtattctctaaagctttttttcaaaagttcaggctttctacttactgggaagttggtggtcctcttagtccctgataaatcaaggcaatcacattcatgtgagctggatgaatttataagttataaagaccttatccttcataccttgaggatgattgcactggttttgaagtcagttgcttaatgatgaggtgagaaatgtatcctgttgctaaatctgtcttagacccttggtgaaacttgaagatttcagtttataaagataaaatcaagcatcttttgtgcagttttctttttttaatgcaagaatggtggggaggtttgtttgtaagcatgaaactttgagaatctttattaagaaaatgacataatttttaaaaaccttgtagccaagaacatatgtggccacattaccagtaataaatgtttttctctttatattggccaaaagggaataaaaatgtcatcataggaatttgtacatatgctactgatttgcctagaaaatagcaagtttgatattgctcactttgcaaatatagggccatgtggcacttttatctataggacagattaataaaaatgaagtggggaggggtttatttttgatatattactcttatgagttttcaagctttgataatgtttaactgaaaagtggcttagaaagggctagatccaatgtgttcattattaaataattgctatcagatacaattttaagttcattctttttcaaactcaagtaccatattggcaaccataatattgtcataggtgctctcttcatttagatattcttggggggggtggcatttgtataatatatgtgtacatatatatatatatatatatatatacatacagtatataatctaaagctctgagagctcttaagtcaggaatgctgagtattatagtatattgaggtcagatgaaattttacatttttgtgtgttctgttgcattccttctggtagtttctatgactgcattactccagcactcatgattgattttatcttctaattttcttccaagtattttattttttattagttttctttggcttgatacttttaaatatgttactagtcacttgaaagcctctcccccaaaagtatttggtttgtatgctttgtctgtggcagctataacagtggtaagaacattttgaagatagctttttaaaggaaccactgattttttcaaaaatcatcctgggggaggaattttggcatttcatttgagcagggattttgtcagaaaatgtgttttgatggtaggtcagcagcagtgctagtctctgaaagcacaataccagtcaggcagcctatcccatcagatgtcatctggctgaagtttatctctgtctctcaggataaatccctgtaggacaaatccctactatcatttctaccttttggggtgacatgtggaatcatacaaaggcttaggaagaaatacgtttgtttaaaccaggatgctttacttacttgaagtgacttcaatctagatttcttttaatatttaacaaatttttaattctatgatcagccacagtcagctattaccataaattggtctctgtttattttgaagatcacggctgcttcattttgcaggattaagtagggctaatgtatcttaaagttaagatcttgaattaaagtgagttttagaaatagtgttacataccttttcagttgttttcaagaggctttatttttgttgcctttgtagccctgaaagctgttggtatattttttccctcatggacccaatagaaaagttgtatatttatttggattatatttacattctgtcctttgtaaatgtttggtgtaacttgcacttttttaaatgacccagtttgggtattagcaacttaagaaattccctcatcaagtaattctcaactttttagtctttctcctctcttcaaatcatgtgactttttaaatggaagtttttcattgattaaaatattttagcacctaaaagctagccttaaaaacagctgtaaaagaaaaacatcaggaaattagatatgactagcccagttaattaaaagacgggctcaaaccttgttttattctttttcatcttggatgaagattgaagggaaaataactcaagtgcataatatttattttcaatttttaatgagactttatcctcatcacaacattaatactgtacatagtatgccaaaatatccattaatttgtctagaatagtacaagactttttaaagcaattgtcctcacagagaccacatgtaatatactgaaatatgttcatttttaatggctttgttaacatcaaagaaatgctgcctaaatttgatttcagatgaggaaggagaaagtaaagtgtgcatagtaaggctgtaggtgaagagttgtgagataaatagttcactcagttgtacaaagcacaactagaactttttgttgggaggcttacatacatcttgaatattcttaatgtaataatgttgactattaagttggctacacagtcactgtatgtactaggaactggtttccttgacattctagaatcaatggctaggagaggcattaatctttgaggggctgaacatatcatgaagctgagtcagtatggaaaattttcaaataaacagggtgctgaagttccatctgtctcatctgcttatgataagttcttattgattagtgaatgtagcttaagcctttgtatgtgtcctcagggggcagaccgactttaagagggaccagataacgtttgaatggagggattatatttcaggtgttttagcttgaaatttattttttaaaaaaagaaaaatttaaaaaatatataaataaaatagaacaaagccggtgatgcaagttgatattataaacaggcagttttagcacagaaagaaaatactgacctgtctgcattctggtacggtgggtgcaggtcccagctgggtatgacatgatacatttttaattattctcaccagcaagtaaaaggaaaatgaacaatcttttggaattgtctttgaaaaggatcaaagagtaggaaattcacatttgacctaacattacttgcctatagaagtatggcatttccaagcttttgtctgaggagcatctcagagaagtgagagtaaatctgagttagcttaaaaattggtagggaggaagaaaatctctgcaaataatgattttatgtttgttggccaagtgaaatgatctatcattgtgtttgggaggttttattttcttatgtttttaaaattggtaaatgctttatagatgtatttttatccaagtgccactccaatttgtgtatgtaataaaattatttatattaaaagtgggaaataattgtcaacattttttttgagtatagatttattaggggtggcaaagaagagtgctagttagcagttttccatgtaaagttgtccttgactgatttgtccacatgtcagttgtaactcccccactccctgcaaaaggaattatttctaacccagatgtatcacttgaaactttttagaagcaaaataatcagggaagttcctagaaaggtgtttggctttttggtttttgagggttggggtaaagaagacttcccccacaactgtcagcacaaaacagggtattgatttttaactctgatgtttctattggagttgaatactaaataaataactataatgagggaaatacatttctaataaaattccctacattctagaaacatccctgttttaatttttttatctaaatctttttgtgctttatgtgtaaagaaaaaaatgtactgagttacaatgcattttattaacactatgtacataatagctgctttgtgttcagaatagtagcagttgctttgtatattaaagtgatccttgtgaatttgtgaaatattgtcataaagtgctttttcttactgtaatctttgtggtatcaactgtcataatgctctttttacacaaacatttatgtgcagtcacataaacatgcttttaaaaactc

SEQ ID NO: 726 - DNA, 1629 bp, Homo sapiens
gaacgaaagcagtgacggaggagcttgtaccaccggtaactaaatgaccatggaatctggagccgagaaccagcagagtggagatgcagctgtaacagaagctgaaaaccaacaaatgacagttcaagcccagccacagattgccacattagcccaggtatctatgccagcagctcatgcaacatcatctgctcccaccgtaactctagtacagctgcccaatgggcagacagttcaagtccatggagtcattcaggcggcccagccatcagttattcagtctccacaagtccaaacagttcagtcttcctgtaaggacttaaaaagacttttctccggaacacagatttcaactattgcagaaagtgaagattcacaggagtcagtggatagtgtaactgattcccaaaagcgaagggaaattctttcaaggaggccttcctacaggaaaattttgaatgacttatcttctgatgcaccaggagtgccaaggattgaagaagagaagtctgaagaggagacttcagcacttcctacacagcctgctgaagaagcagcacgaaagagagaggtccgtctaatgaagaacagggaagcagctcgagagtgtcgtagaaagaagaaagaatatgtgaaatgtttagaaaacagagtggcagtgcttgaaaatcaaaacaagacattgattgaggagctaaaagcacttaaggacctttactgccacaaatcagattaatttgggatttaaattttcacctgttaaggtggaaaatggactggcttggccacaacctgaaagacaaaataaacattttattttctaaacatttctttttttctatgcgcaaaactgcctgaaagcaactacagaatttcattcatttgtgcttttgcattaaactgtgaatgttccaacacctgcctccacttctcccctcaagaaattttcaacgccaggaatcatgaagagacttctgcttttcaacccccaccctcctcaagaagtaataatttgtttacttgtaaattgatgggagaaatgaggaaaagaaaatctttttaaaaatgatttcaaggtttgtgctgagctccttgattgccttagggacagaattaccccagcctcttgagctgaagtaatgtgtgggccgcatgcataaagtaagtaaggtgcaatgaagaagtgttgattgccaaattgacatgttgtcacattctcattgtgaattatgtaaagttgttaagagacataccctctaaaaaagaactttagcatggtattgaaggaattagaaatgaatttggagtgctttttatgtatgttgtcttcttcaatactgaaaatttgtccttggttcttaaaagcattctgtactaatacagctcttccatagggcagttgttgcttcttaattcagttctgtatgtgttcaacatttttgaatacattaaaagaagtaaccaactgaacgacaaagcatggtatttgaattttaaattaaagcaaagtaaataaaagtacaaagcatattttagttagtactaaattcttagtaaaatgctgatcagtaaaccaatcccttgagttatataacaagatttttaaataaatgttattgtcctcacctt

SEQ ID NO: 727 - DNA, 580 bp, Homo sapiens
gaattcaggaggagttgcccacttgttagtgtgcagggaaatgtgtttttctcatttctagttgaggtcattctttttttttttttttttttaaaccatagcatgtgttccattagttatgaatgtattatttctttagagtcaaaattcacaactcatttctttgaatattatctctgatcctagatgggatcaaaattgccctagatttaggagttttaaaagtttactaggttgtggggaagatgggtttatttttcataaacttgaactagaatgttgacgattataaggactgggacacttcctaaaggtcaaaatattttaaggcgaaagtaactaaatgaccatggaatctggagccgagaaccagcagagtggagatgcagctgtaacagaagctgaaaaccaacaaatgacagttcaagcccagccacagattgccacattagcccaggtatctatgccagcagctcatgcaacatcatctgctcccaccgtaactctagtacagctgcccaatgggcagacagttcaagtccatggagtcattcaggcggcccagccatcagttattcag

SEQ ID NO: 728 - DNA, 2005 bp, Homo sapiens
agaccactcctcccggcgccgggctcagcccgccttcgccttccctctccccgcggaaccccttctcgtcgcccgaagaaacccgaaggtcttcggcaagttccgtccccagcgcgggggcggggccgctcgagctgctccgggcctagctcggctgtttccgtgcgcggccgctgcgcactcggcactgggcggcgctggctggctccctggctgcggctcctcagtcggcggcggctgctgctgcctgtggcccgggcggctgggagaagcggagtgttggtaactaaatgaccatggaatctggagccgagaaccagcagagtggagatgcagctgtaacagaagctgaaaaccaacaaatgacagttcaagcccagccacagattgccacattagcccaggtatctatgccagcagctcatgcaacatcatctgctcccaccgtaactctagtacagctgcccaatgggcagacagttcaagtccatggagtcattcaggcggcccagccatcagttattcagtctccacaagtccaaacagttcagatttcaactattgcagaaagtgaagattcacaggagtcagtggatagtgtaactgattcccaaaagcgaagggaaattctttcaaggaggccttcctacaggaaaattttgaatgacttatcttctgatgcaccaggagtgccaaggattgaagaagagaagtctgaagaggagacttcagcacctgccatcaccactgtaacggtgccaactccaatttaccaaactagcagtggacagtatattgccattacccagggaggagcaatacagctggctaacaatggtaccgatggggtacagggcctgcaaacattaaccatgaccaatgcagcagccactcagccgggtactaccattctacagtatgcacagaccactgatggacagcagatcttagtgcccagcaaccaagttgttgttcaagctgcctctggagacgtacaaacataccagattcgcacagcacccactagcactattgcccctggagttgttatggcatcctccccagcacttcctacacagcctgctgaagaagcagcacgaaagagagaggtccgtctaatgaagaacagggaagcagctcgagagtgtcgtagaaagaagaaagaatatgtgaaatgtttagaaaacagagtggcagtgcttgaaaatcaaaacaagacattgattgaggagctaaaagcacttaaggacctttactgccacaaatcagattaatttgggatttaaattttcacctgttaaggtggaaaatggactggcttggccacaacctgaaagacaaaataaacattttattttctaaacatttctttttttctatgcgcaaaactgcctgaaagcaactacagaatttcattcatttgtgcttttgcattaaactgtgaatgttccaacacctgcctccacttctcccctcaagaaattttcaacgccaggaatcatgaagagacttctgcttttcaacccccaccctcctcaagaagtaataatttgtttacttgtaaattgatgggagaaatgaggaaaagaaaatctttttaaaaatgatttcaaggtttgtgctgagctccttgattgccttagggacagaattaccccagcctcttgagctgaagtaatgtgtgggccgcatgcataaagtaagtaaggtgcaatgaagaagtgttgattgccaaattgacatgttgtcacattctcattgtgaattatgtaaagttgttaagagacataccctctaaaaaagaactttagcatggtattgaaggaattagaaatgaatttggagtgctttttatgtatgttgtcttcttcaatactgaaaatttgtccttggttcttaaaagcattctgtactaatacagctcttccatagggcagttgttgcttcttaattcagttctgtatgtgttcaacatttttgaatacattaaaagaagtaaccaact

SEQ ID NO: 729 - DNA, 7650 bp, Homo sapiens
tgtttccgtgcgcggccgctgcgcactcggcactgggcggcgctggctggctccctggctgcggctcctcagtcggcggcggctgctgctgcctgtggcccgggcggctgggagaagcggagtgttggtgagtgacgcggcggaggtgtagtttgacgcggtgtgttacgtgggggagagaataaaactccagcgagatccgggccgtgaacgaaagcagtgacggaggagcttgtaccaccggtaactaaatgaccatggaatctggagccgagaaccagcagagtggagatgcagctgtaacagaagctgaaaaccaacaaatgacagttcaagcccagccacagattgccacattagcccaggtatctatgccagcagctcatgcaacatcatctgctcccaccgtaactctagtacagctgcccaatgggcagacagttcaagtccatggagtcattcaggcggcccagccatcagttattcagtctccacaagtccaaacagttcagtcttcctgtaaggacttaaaaagacttttctccggaacacagatttcaactattgcagaaagtgaagattcacaggagtcagtggatagtgtaactgattcccaaaagcgaagggaaattctttcaaggaggccttcctacaggaaaattttgaatgacttatcttctgatgcaccaggagtgccaaggattgaagaagagaagtctgaagaggagacttcagcacctgccatcaccactgtaacggtgccaactccaatttaccaaactagcagtggacagtatattgccattacccagggaggagcaatacagctggctaacaatggtaccgatggggtacagggcctgcaaacattaaccatgaccaatgcagcagccactcagccgggtactaccattctacagtatgcacagaccactgatggacagcagatcttagtgcccagcaaccaagttgttgttcaagctgcctctggagacgtacaaacataccagattcgcacagcacccactagcactattgcccctggagttgttatggcatcctccccagcacttcctacacagcctgctgaagaagcagcacgaaagagagaggtccgtctaatgaagaacagggaagcagctcgagagtgtcgtagaaagaagaaagaatatgtgaaatgtttagaaaacagagtggcagtgcttgaaaatcaaaacaagacattgattgaggagctaaaagcacttaaggacctttactgccacaaatcagattaatttgggatttaaattttcacctgttaaggtggaaaatggactggcttggccacaacctgaaagacaaaataaacattttattttctaaacatttctttttttctatgcgcaaaactgcctgaaagcaactacagaatttcattcatttgtgcttttgcattaaactgtgaatgttccaacacctgcctccacttctcccctcaagaaattttcaacgccaggaatcatgaagagacttctgcttttcaacccccaccctcctcaagaagtaataatttgtttacttgtaaattgatgggagaaatgaggaaaagaaaatctttttaaaaatgatttcaaggtttgtgctgagctccttgattgccttagggacagaattaccccagcctcttgagctgaagtaatgtgtgggccgcatgcataaagtaagtaaggtgcaatgaagaagtgttgattgccaaattgacatgttgtcacattctcattgtgaattatgtaaagttgttaagagacataccctctaaaaaagaactttagcatggtattgaaggaattagaaatgaatttggagtgctttttatgtatgttgtcttcttcaatactgaaaatttgtccttggttcttaaaagcattctgtactaatacagctcttccatagggcagttgttgcttcttaattcagttctgtatgtgttcaacatttttgaatacattaaaagaagtaaccaactgaacgacaaagcatggtatttgaattttaaattaaagcaaagtaaataaaagtacaaagcatattttagttagtactaaattcttagtaaaatgctgatcagtaaaccaatcccttgagttatataacaagatttttaaataaatgttattgtcctcaccttcaaaaatatttatattgtcactcatttacgtaaaaagatatttctaatttactgttgcccattgcacttacataccaccaccaagaaagccttcaagatgtcaaataaagcaaagtgatatatatttgtttatgaaatgttacatgtagaaaaatactgattttaaatattttccatattaacaatttaacagagaatctctagtgaattttttaaatgaaagaagttgtaaggatataaaaagtacagtgttagatgtgcacaaggaaagttattttcagacatatttgaatgactgctgtactgcaatatttggattgtcattcttacaaaacatttttttgttctcttgtaaaaagagtagttattagttctgctttagctttccaatatgctgtatagcctttgtcattttataattttaattcctgattaaaacagtctgtatttgtgtatatcatacattgttttcaataccacttttaattgttactcattttattcactaagctcgataaatctaacagttactcttaaaaaaaaaaaaaaaagactaaggtggattttaaaaattggaaactgacataatgttaggttataatttctcatttggagccgggcgcagtggctcacgcctgtaatcccagcactttgggaggccaaggtgggtggatcacctgtggtcaagagttcaagaccagcctggccatcatggtgaaaccccatctctactaaaaatacaaaaattagccaggcgtggtggctggcgcctgtaatcccagctactcaggaggttgaggcagcagaattgcttgaacccaggaggcagagggttgcagtgagccgagatagcaccattgcactccagcctgggcgactccatctcaaaaaataaaaataaaaaaaatgtctcatttgggaaggaaattccttttaaaaaagagttgagacacttagaaaactaatgttttatatttagtcaagagttatttaagaaagtcaagcttgtttaacaacaaaatatgaagatttaagtgttaattgctggatccattttaaaataagattttaattaacatttgtaaatggtatattttcgtttgtaacaaaccattgtcttttttcaaggatgaacagagtttatgaaggagcatcattctaagaattaagtgatgtagtctttatgtttggacagttcaccagattctcaagaaggctttcaaacaactataaagtttgatgtttgtcctgctgagctaatggggaaagttatagcataaaaattgtgtaaccgcatagatatgtcatttttaaaaactggtttaacagaaatcaagcaaagtcacaaatatgttcacaagttggaattatttattgagtcaaaatgtcgaatcgaacattttgaatgaagtaagtgttataaatgaaaaattgcctgatgtttagcagtttgtattctctaaagctttttttcaaaagttcaggctttctacttactgggaagttggtggtcctcttagtccctgataaatcaaggcaatcacattcatgtgagctggatgaatttataagttataaagaccttatccttcataccttgaggatgattgcactggttttgaagtcagttgcttaatgatgaggtgagaaatgtatcctgttgctaaatctgtcttagacccttggtgaaacttgaagatttcagtttataaagataaaatcaagcatcttttgtgcagttttctttttttaatgcaagaatggtggggaggtttgtttgtaagcatgaaactttgagaatctttattaagaaaatgacataatttttaaaaaccttgtagccaagaacatatgtggccacattaccagtaataaatgtttttctctttatattggccaaaagggaataaaaatgtcatcataggaatttgtacatatgctactgatttgcctagaaaatagcaagtttgatattgctcactttgcaaatatagggccatgtggcacttttatctataggacagattaataaaaatgaagtggggaggggtttatttttgatatattactcttatgagttttcaagctttgataatgtttaactgaaaagtggcttagaaagggctagatccaatgtgttcattattaaataattgctatcagatacaattttaagttcattctttttcaaactcaagtaccatattggcaaccataatattgtcataggtgctctcttcatttagatattcttggggggggtggcatttgtataatatatgtgtacatatatatatatatatatatatatacatacagtatataatctaaagctctgagagctcttaagtcaggaatgctgagtattatagtatattgaggtcagatgaaattttacatttttgtgtgttctgttgcattccttctggtagtttctatgactgcattactccagcactcatgattgattttatcttctaattttcttccaagtattttattttttattagttttctttggcttgatacttttaaatatgttactagtcacttgaaagcctctcccccaaaagtatttggtttgtatgctttgtctgtggcagctataacagtggtaagaacattttgaagatagctttttaaaggaaccactgattttttcaaaaatcatcctgggggaggaattttggcatttcatttgagcagggattttgtcagaaaatgtgttttgatggtaggtcagcagcagtgctagtctctgaaagcacaataccagtcaggcagcctatcccatcagatgtcatctggctgaagtttatctctgtctctcaggataaatccctgtaggacaaatccctactatcatttctaccttttggggtgacatgtggaatcatacaaaggcttaggaagaaatacgtttgtttaaaccaggatgctttacttacttgaagtgacttcaatctagatttcttttaatatttaacaaatttttaattctatgatcagccacagtcagctattaccataaattggtctctgtttattttgaagatcacggctgcttcattttgcaggattaagtagggctaatgtatcttaaagttaagatcttgaattaaagtgagttttagaaatagtgttacataccttttcagttgttttcaagaggctttatttttgttgcctttgtagccctgaaagctgttggtatattttttccctcatggacccaatagaaaagttgtatatttatttggattatatttacattctgtcctttgtaaatgtttggtgtaacttgcacttttttaaatgacccagtttgggtattagcaacttaagaaattccctcatcaagtaattctcaactttttagtctttctcctctcttcaaatcatgtgactttttaaatggaagtttttcattgattaaaatattttagcacctaaaagctagccttaaaaacagctgtaaaagaaaaacatcaggaaattagatatgactagcccagttaattaaaagacgggctcaaaccttgttttattctttttcatcttggatgaagattgaagggaaaataactcaagtgcataatatttattttcaatttttaatgagactttatcctcatcacaacattaatactgtacatagtatgccaaaatatccattaatttgtctagaatagtacaagactttttaaagcaattgtcctcacagagaccacatgtaatatactgaaatatgttcatttttaatggctttgttaacatcaaagaaatgctgcctaaatttgatttcagatgaggaaggagaaagtaaagtgtgcatagtaaggctgtaggtgaagagttgtgagataaatagttcactcagttgtacaaagcacaactagaactttttgttgggaggcttacatacatcttgaatattcttaatgtaataatgttgactattaagttggctacacagtcactgtatgtactaggaactggtttccttgacattctagaatcaatggctaggagaggcattaatctttgaggggctgaacatatcatgaagctgagtcagtatggaaaattttcaaataaacagggtgctgaagttccatctgtctcatctgcttatgataagttcttattgattagtgaatgtagcttaagcctttgtatgtgtcctcagggggcagaccgactttaagagggaccagataacgtttgaatggagggattatatttcaggtgttttagcttgaaatttattttttaaaaaaagaaaaatttaaaaaatatataaataaaatagaacaaagccggtgatgcaagttgatattataaacaggcagttttagcacagaaagaaaatactgacctgtctgcattctggtacggtgggtgcaggtcccagctgggtatgacatgatacatttttaattattctcaccagcaagtaaaaggaaaatgaacaatcttttggaattgtctttgaaaaggatcaaagagtaggaaattcacatttgacctaacattacttgcctatagaagtatggcatttccaagcttttgtctgaggagcatctcagagaagtgagagtaaatctgagttagcttaaaaattggtagggaggaagaaaatctctgcaaataatgattttatgtttgttggccaagtgaaatgatctatcattgtgtttgggaggttttattttcttatgtttttaaaattggtaaatgctttatagatgtatttttatccaagtgccactccaatttgtgtatgtaataaaattatttatattaaaagtgggaaataattgtcaacattttttttgagtatagatttattaggggtggcaaagaagagtgctagttagcagttttccatgtaaagttgtccttgactgatttgtccacatgtcagttgtaactcccccactccctgcaaaaggaattatttctaacccagatgtatcacttgaaactttttagaagcaaaataatcagggaagttcctagaaaggtgtttggctttttggtttttgagggttggggtaaagaagacttcccccacaactgtcagcacaaaacagggtattgatttttaactctgatgtttctattggagttgaatactaaataaataactataatgagggaaatacatttctaataaaattccctacattctagaaacatccctgttttaatttttttatctaaatctttttgtgctttatgtgtaaagaaaaaaatgtactgagttacaatgcattttattaacactatgtacataatagctgctttgtgttcagaatagtagcagttgctttgtatattaaagtgatccttgtgaatttgtgaaatattgtcataaagtgctttttcttactgtaatctttgtggtatcaactgtcataatgctctttttacacaaacatttatgtgcagtcacataaacatgcttttaaaaactc

SEQ ID NO: 730 - DNA, 651 bp, Homo sapiens
actgggcggcgctggctggctccctggctgcggctcctcagtcggcggcggctgctgctgcctgtggcccgggcggctgggagaagcggagtgttggtaactaaatgaccatggaatctggagccgagaaccagcagagtggagatgcagctgtaacagaagctgaaaaccaacaaatgacagttcaagcccagccacagattgccacattagcccaggtatctatgccagcagctcatgcaacatcatctgctcccaccgtaactctagtacagctgcccaatgggcagacagttcaagtccatggagtcattcaggcggcccagccatcagttattcagtctccacaagtccaaacagttcagtcttcctgtaaggacttaaaaagacttttctccggaacacagatttcaactattgcagaaagtgaagattcacaggagtcagtggatagtgtaactgattcccaaaagcgaagggaaattctttcaaggaggccttcctacaggaaaattttgaatgacttatcttctgatgcaccaggagtgccaaggattgaagaagagaagtctgaagaggagacttcagcacctgccatcaccactgtaacggtgccaactccaatttaccaaactagcagtggacagtata

SEQ ID NO: 731 - DNA, 518 bp, Homo sapiens
gaaagcagtgacggaggagcttgtaccaccggaactgttggggacacagtgactaaggcaaaatatgtgtcaaaagaaagcagtcaaaggaaaaagggatcacctttggtgaagtaactaaatgaccatggaatctggagccgagaaccagcagagtggagatgcagctgtaacagaagctgaaaaccaacaaatgacagttcaagcccagccacagattgccacattagcccaggtatctatgccagcagctcatgcaacatcatctgctcccaccgtaactctagtacagctgcccaatgggcagacagttcaagtccatggagtcattcaggcggcccagccatcagttattcagtctccacaagtccaaacagttcagtcttcctgtaaggacttaaaaagacttttctccggaacacagatttcaactattgcagaaagtgaagattcacaggagtcagtggatagtgtaactgattcccaaaagcgaagggaaattctttcaaggaggcctt

SEQ ID NO: 732 - DNA, 1056 bp, Homo sapiens
agaataaaactccagcgagatccgggccgtgaacgaaagcagtgacggaggagcttgtaccaccggtaactaaatgaccatggaatctggagccgagaaccagcagagtggagatgcagctgtaacagaagctgaaaaccaacaaatgacagttcaagcccagccacagattgccacattagcccaggtatctatgccagcagctcatgcaacatcatctgctcccaccgtaactctagtacagctgcccaatgggcagacagttcaagtccatggagtcattcaggcggcccagccatcagttattcagtctccacaagtccaaacagttcagatttcaactattgcagaaagtgaagattcacaggagtcagtggatagtgtaactgattcccaaaagcgaagggaaattctttcaaggaggccttcctacaggaaaattttgaatgacttatcttctgatgcaccaggagtgccaaggattgaagaagagaagtctgaagaggagacttcagcacctgccatcaccactgtaacggtgccaactccaatttaccaaactagcagtggacagtatattgccattacccagggaggagcaatacagctggctaacaatggtaccgatggggtacagggcctgcaaacattaaccatgaccaatgcagcagccactcagccgggtactaccattctacagtatgcacagaccactgatggacagcagatcttagtgcccagcaaccaagttgttgttcaaggtactcaaaaattgtaaagcaggatgtcagtgaatttgaattctgaacgtcagtttgaagatggtaacatgtttagtatataaatcttttccactcaaaccatacattttaattgatattaataattaatatgaataattttataaagaccttcaaatttttttaagtaacattaggttccttattaggagagcatattattacgctgtttttagaagcagtttgacaaatagtgattgtgtttgtttttacaaatggtgaatcagttagaaaaataaaacttcagtttatttag

SEQ ID NO: 733 - DNA, 1029 bp, Homo sapiens
atacatcatacagtaacacacttatgtgcaccattggtgctgagctgctggttatcccactctgccatgtgtgctgtttctctttgcttttgccactactccactctgtgcttgaaattctgtgactcttccctgtatctatgccagcagctcatgcaacatcatctgctcccaccgtaactctagtacagctgcccaatgggcagacagttcaagtccatggagtcattcaggcggcccagccatcagttattcagtctccacaagtccaaacagttcagtcttcctgtaaggacttaaaaagacttttctccggaacacagatttcaactattgcagaaagtgaagattcacaggagtcagtggatagtgtaactgattcccaaaagcgaagggaaattctttcaaggaggccttcctacaggaaaattttgaatgacttatcttctgatgcaccaggagtgccaaggattgaagaagagaagtctgaagaggagacttcagcacctgccatcaccactgtaacggtgccaactccaatttaccaaactagcagtggacagtatacatacctgagggatacaacatactcctgtcagtaacagattcactgttacagagattctcacttgaactaggaagcatgctctttaggaaagaggcctatcagaatctaaaaaggggaaatgaagttgccattacccagggaggagcaatacagctggctaacaatggtaccgatggggtacagggcctgcaaacattaaccatgaccaatgcagcagccactcagccgggtactaccattctacagtatgcacagaccactgatggacagcagatcttagtgcccagcaaccaagttgttgttcaaggtactcaaaaattgtaaagcaggatgtcagtgaatttgaattctgaacgtcagtttgaagatgagtctacttgaaattttttaatatgaatttaccaatatcaaaggaagacactgaggactatactctatctaggaagatcatccaagctgtg

SEQ ID NO: 734 - DNA, 3754 bp, Homo sapiens
cagagcgtctgtaaacacccagagactgtcatggagggggaggaggaggcggcggcggcgaagggaggcgtttggggccgcctccagggtccgctctgccattcctgaactggtccctcgtccccgtgactctggcatcagggaagcgaactgttaggcgagaggaggaggcagccagaaccatatccccttcttcctcggggcgggggccgggccaggccggctgagccgggggagggctccgggagggagtgcctggccaggccggcctgtctgccgcgatggatgacagtaaggtggttggaggcaaagtaaagaagcccggtaaacgtggtcggaagccagccaaaattgacttgaaagcaaaacttgagaggagccggcagagtgcaagagaatgccgagcccgaaaaaagctgagatatcagtatttggaagagttggtatccagtcgagaaagagctatatgtgccctcagagaggaactggaaatgtacaagcagtggtgcatggcaatggaccaaggaaaaatcccttctgaaataaaggccctactcactggagaagagcagaacaaatctcagcagaactcaagcaggcataccaaggctgggaagacagatgctaatagcaattcctggtgaagattatataaagatgagtcagtgattgaagccaatattctgattcccatggaagatggatgggcaagagtgtacttcttggctccatttactacctactgctcagtagtcatctctgtaaatctgcaatttctaccaaaatgtgtgatcgtagatctcaaaggatcttgctttaactttcaacacttagaaaatctacaaacattcagacctgtctgggttggtattgccacccatgacatttaacatgttgtgatgcttgaaaacacaggagtagagaaaatcgatgaagattgtatttttgcaccttaactccacattgctttattggttaatttatattctttccatgtaattcatgtaattgtatgtctgtgtgtgttttatgtgtcaccacctttcatgtttttgattgccctacaaagagaaaccaaatgagctgattactgactataagttctcagcctttatggacctaatcttatttttatttacttgagtaatgtttattctctgcatgaaccatgatttctcctgtgagccattccagcataagctgtgaatatgtattaacaaatatatacatttctatttttataatccataaggatatgcctgttttaaataacatacatattaacaatatctatcaggaaaaccctcaagacagcttctagttaaaacctttgttgctgtcctctcaaactatatttataaaaatttgctagggccaaatccatacttgcagaataattcatcaaattttatttttaagtgaaaagtaacctttcaggcatttcagcagcatacattgacaatctagggtatatatgtatgtatgtttcttattgtatgtctatatatgtatgtggggaggacaggagtgaatgttcacacacttttcttgcgtactcaactaaattggagaatgtttctgaagaaaattggatgaaattagctgctgagattgagtttctgccttaaaatctgaaacaaaaaaagggacaaattgctggtagatctactgactgtagccatcaccagaacacttagtttcttcccagacatgaatttcctgacaggctctgagccagaaacacactgtgggcgtgcatctggttcagccctggatatgcctccactgtggagggaagcattggaactggagttgtgcacagcaccgcagctagtgggcctggctgggggtgcagaagggcagggtagttctttccatttccccttgcagctacacttactttctccctgactaccaaatggagtgacggttgaagaatcaagctcataatatgatacacccagacagacccagaaatcttttgatttccccagcgagatacttaccactctctcttctctttcccatggttaaaacaggagttgtgttctctgtcgctgctaaattattcttcacttgagtgaagcaaatatttagcttccaaataaagtatattttgttctgaactggcagtttaagaggagataccgtagtctagattgtctttgaggtagaatatatgatggaccacatagtttaagattacaaggtactttccctcttctctcaggccatgcatttgaataaagtgcctcccttagcctgagctcctaaagacctcttgtacttggttgcaaactcagatctctagtctagtctagtctagtctagtctagtcatgtgtgactgtgtactgagataccactagcccagtttgctgggtctctatgttttggaagttgggggtttaataatatttaatgtctttttaggatcataaacataaataggtttgttgatattcaggccttcagaatttaagggttttaaatatagcattcagattgtaattggtatgtttttgccatctggtccactcaattgtatatttttattttgcaaaacaacccaaaacttactttatgttgctttgttcagtaccttttgaattcccccagaagagttgttttcaaaacaaacattccagaatgaatgtcgctcttcaatggaacgtctttattgtgcttgaagtatttcttctctggttgtaattctaaattacagagtcatttgagctttctcccctcccgctagtatctttacaggagcagggaagagcagtagaggatgtataattttgggcgaagttaaattacaatttatttgaggttattcctaaacctatttatttggtgttttggaggagatcacacactaagagaacgttgattgcctcggctattgtgctggctggacactttggtcacttttgaagcatgttaataaatgtcactgattaaaacagctggagcatttccttccctttccagtgaaggagcagcatagtgaaatcctggcacccctcacctttttgtgatgacaagatggctgacagtcacggagtccaggagaaggtgctgctctccttgctttctgagtaaacagagtaatgttttttttcttattttcccaaagaaagaaaagggggaaaatatatttgtatgtttagaccagccaaattctgtcattattttagtatcaacctgctgtatattagagcaactgaatataatatggaataagtttgaccaggtcaagttttaggatatagttgaatttctttaaaaagttttctattttatctaaaatctttccattatatctaaattagaatgatcatcctgcgcaaattcagattactgtttgctggctaattgacagtatttctcagcatcactatgtagcattctgttttagcatctttgaattatgatcatttgatttggctaattacaaaaagtacaggtttaaactggacttagcttgagttaaaggcaaagaaaatctaaaaacataaatgttatatttcacaagaaatcagttgcatattatccattacatatttagttttaaaaggaggagtcaccttgaattattttctgagtcaccttgagttatttgatctctcagcctgctttctcatctgtaaaaaaggggggaggataactttcacagggtaattggtaggctaaataggagttacagaaaactgttaaatagggaagaactacattaaatttaaatattcacatta

SEQ ID NO: 735 - DNA, 1150 bp, Homo sapiens
cgctataaaacccaggccggcaggatcgctgcacccgcggcggcctcctcggtgcgcgacccccggctcagaggactctttgctgtcccgcaagatgcggatgctgctggcgctcctggccctctccgcggcgcggccatcggccagtgcagagtcacactggtgctacgaggttcaagccgagtcctccaactacccctgcttggtgccagtcaagtggggtggaaactgccagaaggaccgccagtcccccatcaacatcgtcaccaccaaggcaaaggtggacaaaaaactgggacgcttcttcttctctggctacgataagaagcaaacgtggactgtccaaaataacgggcactcagtgatgatgttgctggagaacaaggccagcatttctggaggaggactgcctgccccataccaggccaaacagttgcacctgcactggtccgacttgccatataagggctcggagcacagcctcgatggggagcactttgccatggagatgcacatagtacatgagaaagagaaggggacatcgaggaatgtgaaagaggcccaggaccctgaagacgaaattgcggtgctggcctttctggtggaggctggaacccaggtgaacgagggcttccagccactggtggaggcactgtctaatatccccaaacctgagatgagcactacgatggcagagagcagcctgttggacctgctccccaaggaggagaaactgaggcactacttccgctacctgggctcactcaccacaccgacctgcgatgagaaggtcgtctggactgtgttccgggagcccattcagcttcacagagaacagatcctggcattctctcagaagctgtactacgacaaggaacagacagtgagcatgaaggacaatgtcaggcccctgcagcagctggggcagcgcacggtgataaagtccggggccccgggtcggccgctgccctgggccctgcctgccctgctgggccccatgctggcctgcctgctggccggcttcctgcgatgatggctcacttctgcacgcagcctctctgttgcctcagctctccaagttccaggcttccggtccttagccttcccaggtgggactttaggcatgattaaaatatggacatatttttgg

SEQ ID NO: 736 - DNA, 1618 bp, Homo sapiens
cagcctgctcccctccaggcttgctcctcccccacccagctctcgtttccaatgcacgtacagcccgtacacaccgtgtgctgggacaccccacagtcagccgcatggctcccctgtgccccagcccctggctccctctgttgatcccggcccctgctccaggcctcactgtgcaactgctgctgtcactgctgcttctggtgcctgtccatccccagaggttgccccggatgcaggaggattcccccttgggaggaggctcttctggggaagatgacccactgggcgaggaggatctgcccagtgaagaggattcacccagagaggaggatccacccggagaggaggatctacctggagaggaggatctacctggagaggaggatctacctgaagttaagcctaaatcagaagaagagggctccctgaagttagaggatctacctactgttgaggctcctggagatcctcaagaaccccagaataatgcccacagggacaaagaaggggatgaccagagtcattggcgctatggaggcgacccgccctggccccgggtgtccccagcctgcgcgggccgcttccagtccccggtggatatccgcccccagctcgccgccttctgcccggccctgcgccccctggaactcctgggcttccagctcccgccgctcccagaactgcgcctgcgcaacaatggccacagtgtgcaactgaccctgcctcctgggctagagatggctctgggtcccgggcgggagtaccgggctctgcagctgcatctgcactggggggctgcaggtcgtccgggctcggagcacactgtggaaggccaccgtttccctgccgagatccacgtggttcacctcagcaccgcctttgccagagttgacgaggccttggggcgcccgggaggcctggccgtgttggccgcctttctggaggagggcccggaagaaaacagtgcctatgagcagttgctgtctcgcttggaagaaatcgctgaggaaggctcagagactcaggtcccaggactggacatatctgcactcctgccctctgacttcagccgctacttccaatatgaggggtctctgactacaccgccctgtgcccagggtgtcatctggactgtgtttaaccagacagtgatgctgagtgctaagcagctccacaccctctctgacaccctgtggggacctggtgactctcggctacagctgaacttccgagcgacgcagcctttgaatgggcgagtgattgaggcctccttccctgctggagtggacagcagtcctcgggctgctgagccagtccagctgaattcctgcctggctgctggtgacatcctagccctggtttttggcctcctttttgctgtcaccagcgtcgcgttccttgtgcagatgagaaggcagcacagaaggggaaccaaagggggtgtgagctaccgcccagcagaggtagccgagactggagcctagaggctggatcttggagaatgtgagaagccagccagaggcatctgagggggagccggtaactgtcctgtcctgctcattatgccacttccttttaactgccaagaaattttttaaaataaatatttataataaaa

SEQ ID NO: 737 - DNA, 1374 bp, Homo sapiens
gcccgtacacaccgtgtgctgggacaccccacagtcagccgcatggctcccctgtgccccagcccctggctccctctgttgatcccggcccctgctccaggcctcactgtgcaactgctgctgtcactgctgcttctggtgcctgtccatccccagaggttgccccggatgcaggaggattcccccttgggaggaggctcttctggggaagatgacccactgggcgaggaggatctgcccagtgaagaggattcacccagagaggaggatccacccggagaggaggatctacctggagaggaggatctacctggagaggaggatctacctgaagttaagcctaaatcagaagaagagggctccctgaagttagaggatctacctactgttgaggctcctggagatcctcaagaaccccagaataatgcccacagggacaaagaaggggatgaccagagtcattggcgctatggaggcgacccgccctggccccgggtgtccccagcctgcgcgggccgcttccagtccccggtggatatccgcccccagctcgccgccttctgcccggccctgcgccccctggaactcctgggcttccagctcccgccgctcccagaactgcgcctgcgcaacaatggccacagtgtgcaactgaccctgcctcctgggctagagatggctctgggtcccgggcgggagtaccgggctctgcagctgcatctgcactggggggctgcaggtcgtccgggctcggagcacactgtggaaggccaccgtttccctgccgagatccacgtggttcacctcagcaccgcctttgccagagttgacgaggccttggggcgcccgggaggcctggccgtgttggccgcctttctggaggagggcccggaagaaaacagtgcctatgagcagttgctgtctcgcttggaagaaatcgctgaggaaggctcagagactcaggtcccaggactggacatatctgcactcctgccctctgacttcagccgctacttccaatatgaggggtctctgactacaccgccctgtgcccagggtgtcatctggactgtgtttaaccagacagtgatgctgagtgctaagcagtcctagccctggtttttggcctcctttttgctgtcaccagcgtcgcgttccttgtgcagatgagaaggcagcacagaaggggaaccaaagggggtgtgagctaccgcccagcagaggtagccgagactggagcctagaggctggatcttggagaatgtgagaagccagccagaggcatctgagggggagccggtaactgtcctgtcctgctcattatgccacttccttttaactgccaagaaattttttaaaataaatatttataat

SEQ ID NO: 738 - DNA, 2907 bp, Homo sapiens
gatgctgagaagtactcctgccctaggaagagactcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacaaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaa

SEQ ID NO: 739 - DNA, 2569 bp, Homo sapiens
tccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaacaaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtatgacagaatacatttgaaaacattggttatattaccaagactttgactagaatgtcgtatttgaggatataaacccataggtaataaacccacaggtactacaaacaaagtctgaagtcagccttggtttggcttcctagtgtcaattaaacttctaaaagtttaatctgagattccttataaaaacttccagcaaagcaactttaaaaaagtctgtgtgggccgggcgcggtggctcacgcctgtaatcccagcactttgatccgccgaggcgggcggatcacgaggtcaggagatccagaccatcctggctaacacagtgaaaccccgtctctactaaaaatacaaaaaaagttagccgggcgtggtggtgggggcctgtagtcccagctactcaggaggctgaggcaggagaacggcatgaacccgggaggcagggcttgcagtgagccaagatcatgccgctgcactccagcctgggagacaaagtgagactccgtc

SEQ ID NO: 740 - DNA, 2354 bp, Homo sapiens
agacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacaaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgcatttgcaacagctacagtctaaaattgcttctttaccaaggatatttacagaaaagactctgaccagagatcgagaccatcctagccaacatcgtgaaaccccatctctactaaaaatacaaaaa

SEQ ID NO: 741 - DNA, 2700 bp, Homo sapiens
aaaagagacagaaatgagaggggaggggatagaggattcctgaacagagaccgcacccatgacccacgtgaccctgggaaatgcttctatccctgagaggaggctcagcacagaaggaggaaggacagcagggccaacagtcacagcagccctgaccagagcattcctggagctcaagctcctctacaaagaggtggacagagaagacagcagagaccatgggacccccctcagcccctccctgcagattgcatgtcccctggaaggaggtcctgctcacagcctcacttctaaccttctggaacccacccaccactgccaagctcactattgaatccacgccgttcaatgtcgcagaggggaaggaggttcttctactcgcccacaacctgccccagaatcgtattggttacagctggtacaaaggcgaaagagtggatggcaacagtctaattgtaggatatgtaataggaactcaacaagctaccccagggcccgcatacagtggtcgagagacaatataccccaatgcatccctgctgatccagaacgtcacccagaatgacacaggattctataccctacaagtcataaagtcagatcttgtgaatgaagaagcaaccggacagttccatgtatacccggagctgcccaagccctccatctccagcaacaactccaaccccgtggaggacaaggatgctgtggccttcacctgtgaacctgaggttcagaacacaacctacctgtggtgggtaaatggtcagagcctcccggtcagtcccaggctgcagctgtccaatggcaacatgaccctcactctactcagcgtcaaaaggaacgatgcaggatcctatgaatgtgaaatacagaacccagcgagtgccaaccgcagtgacccagtcaccctgaatgtcctctatggcccagatggccccaccatttccccctcaaaggccaattaccgtccaggggaaaatctgaacctctcctgccacgcagcctctaacccacctgcacagtactcttggtttatcaatgggacgttccagcaatccacacaagagctctttatccccaacatcactgtgaataatagcggatcctatatgtgccaagcccataactcagccactggcctcaataggaccacagtcacgatgatcacagtctctggaagtgctcctgtcctctcagctgtggccaccgtcggcatcacgattggagtgctggccagggtggctctgatatagcagccctggtgtattttcgatatttcaggaagactggcagattggaccagaccctgaattcttctagctcctccaatcccattttatcccatggaaccactaaaaacaaggtctgctctgctcctgaagccctatatgctggagatggacaactcaatgaaaatttaaagggaaaaccctcaggcctgaggtgtgtgccactcagagacttcacctaactagagacaggcaaactgcaaaccatggtgagaaattgacgacttcacactatggacagcttttcccaagatgtcaaaacaagactcctcatcatgataaggctcttacccccttttaatttgtccttgcttatgcctgcctctttcgcttggcaggatgatgctgtcattagtatttcacaagaagtagcttcagagggtaacttaacagagtatcagatctatcttgtcaatcccaacgttttacataaaataagagatcctttagtgcacccagtgactgacattagcagcatctttaacacagccgtgtgttcaaatgtacagtggtccttttcagagttggacttctagactcacctgttctcactccctgttttaattcaacccagccatgcaatgccaaataatagaattgctccctaccagctgaacagggaggagtctgtgcagtttctgacacttgttgttgaacatggctaaatacaatgggtatcgctgagactaagttgtagaaattaacaaatgtgctgcttggttaaaatggctacactcatctgactcattctttattctattttagttggtttgtatcttgcctaaggtgcgtagtccaactcttggtattaccctcctaatagtcatactagtagtcatactccctggtgtagtgtattctctaaaagctttaaatgtctgcatgcagccagccatcaaatagtgaatggtctctctttggctggaattacaaaactcagagaaatgtgtcatcaggagaacatcataacccatgaaggataaaagccccaaatggtggtaactgataatagcactaatgctttaagatttggtcacactctcacctaggtgagcgcattgagccagtggtgctaaatgctacatactccaactgaaatgttaaggaagaagatagatccaattaaaaaaaattaaaaccaatttaaaaaaaaaaagaacacaggagattccagtctacttgagttagcataatacagaagtcccctctactttaacttttacaaaaaagtaacctgaactaatctgatgttaaccaatgtatttatttctgtggttctgtttccttgttccaatttgacaaaacccactgttcttgtattgtattgcccagggggagctatcactgtacttgtagagtggtgctgctttaattcataaatcacaaataaaagccaattagctctataact

SEQ ID NO: 742 - DNA, 3094 bp, Homo sapiens
ctcatatctagaattttgggaggtactttgaatcattacgatctatctacttcttaggtgaggaaatagaggtttaaaatttagtccacagtctcgcaaggatggagcctggatcaaattttgggttatcagattccaatcacgtttcttagcttttcttttttttttccaactccagtttctgtcttgctccaaaaaaggggaaggagcggctgcggcgctcggtttcccgcctcctagggaagggaagggagacgagcagcgcggaggctggggcccccttccgggcggggcctactagtgggcggggcctgtcagtgagcggcccctgcccggaaggagccagtccggggcggagccgatggccttacaggggccggaagtggcctgcgggcggagaagtgcctcaggagtcctgacgcagtgtcttgggcgctaacggcggcggcggccttgtgtttagactccagaactccccacttgccgcgttctcgccgccgcaggctcccgggacgatggtgccccgcctgctgctgcgcgcctggccccggggccccgcggttggtccgggagcccccagtcggcccctcagcgccggctccgggcccggccagtacctgcagcgcagcatcgtgcccaccatgcactaccaggacagcctgcccaggctgcctattcccaaacttgaagacaccattaggagatacctcagtgcacagaagcctctcttgaatgatggccagttcaggaaaacagaacaattttgcaagagttttgaaaatgggattggaaaagaactgcatgagcagctggttgctctggacaaacagaataaacatacaagctacatttcgggaccctggtttgatatgtacctatctgctcgagactccgttgttctgaactttaatccatttatggctttcaatcctgacccaaaatctgagtataatgaccagctcacccgggcaaccaacatgactgtttctgccatccggtttctgaagacactccgggctggccttctggagccagaagtgttccacttgaaccctgcaaaaagtgacactatcaccttcaagagactcatacgctttgtgccttcctctctgtcctggtatggggcctacctggtcaatgcgtatcccctggatatgtcccagtattttcggcttttcaactcaactcgtttacccaaacccagtcgggatgaactcttcactgatgacaaggccagacacctcctggtcctaaggaaaggaaatttttatatctttgatgtcctggatcaagatgggaacattgtgagcccctcggaaatccaggcacatctgaagtacattctctcagacagcagccccgcccccgagtttcccctggcatacctgaccagtgagaaccgagacatctgggcagagctcaggcagaagctgatgagtagtggcaatgaggagagcctgaggaaagtggactcggcagtgttctgtctctgcctagatgacttccccattaaggaccttgtccacttgtcccacaatatgctgcatggggatggcacaaaccgctggtttgataaatcctttaacctcattatcgccaaggatggctctactgccgtccactttgagcactcttggggtgatggtgtggcagtgctcagattttttaatgaagtatttaaagacagcactcagacccctgccgtcactccacagagccagccagctaccactgactctactgtcacggtgcagaaactcaacttcgagctgactgatgccttaaagactggcatcacagctgctaaggaaaagtttgatgccaccatgaaaaccctcactattgactgcgtccagtttcagagaggaggcaaagaattcctgaagaagcaaaagctgagccctgacgcagttgcccagctggcattccagatggccttcctgcggcagtacgggcagacagtggccacctacgagtcctgtagcactgccgcattcaagcacggccgcactgagaccatccgcccggcctccgtctatacaaagaggtgctctgaggcctttgtcagggagccctccaggcacagtgctggtgagcttcagcagatgatggttgagtgctccaagtaccatggccagctgaccaaagaagcagcaatgggccagggctttgaccgacacttgtttgctctgcggcatctggcagcagccaaagggatcatcttgcctgagctctacctggaccctgcatacgggcagataaaccacaatgtcctgtccacgagcacactgagcagcccagcagtgaaccttgggggctttgcccctgtggtctctgatggctttggtgttgggtatgctgttcatgacaactggataggctgcaatgtctcttcctacccaggccgcaatgcccgggagtttctccaatgtgtggagaaggccttagaagacatgtttgatgccttagaaggcaaatccatcaaaagttaacttctgggcagatgaaaagctaccatcacttcctcatcatgaaaactgggaggccgggcatggtggctcatgcctgtaatcccagcattttgagaggctgaggcgggtggatcacttgaggtcaggagtttgagaccaacctggccaacatggtgaaaccttgtctctactaaaaatacaaaaattagctgggtgtggtggcatgtgcctataatcccagctacttgggaggttgaagcagaattgcttgaacccaggaggtggaggttgcagtgagctgagatcacaccactgcactccggcctgggcgacagagcgagactgtctcaaaaaaacaaaaaagaaaaaaaaactggggcctgtgtagccagtgggtgctattctgtgaaactaatcataagctgcctaggcagccagctacaggcttgagctttaaattcatggttttaaagctaaacgtaatttccacttgggactagatcacaactgaagataacaagagatttaagttttaagggcatttaatcaggaggaaaggtttggaaaactaactcaggtgtatttattgtttaagcagaaataaagtttaatttttgcttgaa

SEQ ID NO: 743 - DNA, 4416 bp, Homo sapiens
gggggtttccgcttccggcagcagcggctgcagcctcgctctggtccctgcggctggcggccgagccgtgtgtctcctcctccatcgccgccatattgtctgtgtgagcagaggggagagcggccgccgccgctgccgcttccaccacagctctatcaaggcttgtcaagcagtgtgctcatcacatggtaaatcatgcagcgtggaacctcataaaatctccaagaaacatcattcacccatactgactagtttcacatctctttgtttgaagaaaacaggtctgaaacaaggtcttacccccagctgcttctgaacacagtgactgccagatctccaaacatcaagtccagctttgtccgccaacctgtctgacatgtcgggacccgtgccaagcagggccagagtttacacagatgttaatacacacagacctcgagaatactgggattacgagtcacatgtggtggaatggggaaatcaagatgactaccagctggttcgaaaattaggccgaggtaaatacagtgaagtatttgaagccatcaacatcacaaataatgaaaaagttgttgttaaaattctcaagccagtaaaaaagaagaaaattaagcgtgaaataaagattttggagaatttgagaggaggtcccaacatcatcacactggcagacattgtaaaagaccctgtgtcacgaacccccgccttggtttttgaacacgtaaacaacacagacttcaagcaattgtaccagacgttaacagactatgatattcgattttacatgtatgagattctgaaggccctggattattgtcacagcatgggaattatgcacagagatgtcaagccccataatgtcatgattgatcatgagcacagaaagctacgactaatagactggggtttggctgagttttatcatcctggccaagaatataatgtccgagttgcttcccgatacttcaaaggtcctgagctacttgtagactatcagatgtacgattatagtttggatatgtggagtttgggttgtatgctggcaagtatgatctttcggaaggagccatttttccatggacatgacaattatgatcagttggtgaggatagccaaggttctggggacagaagatttatatgactatattgacaaatacaacattgaattagatccacgtttcaatgatatcttgggcagacactctcgaaagcgatgggaacgctttgtccacagtgaaaatcagcaccttgtcagccctgaggccttggatttcctggacaaactgctgcgatatgaccaccagtcacggcttactgcaagagaggcaatggagcacccctatttctacactgttgtgaaggaccaggctcgaatgggttcatctagcatgccagggggcagtacgcccgtcagcagcgccaatatgatgtcagggatttcttcagtgccaaccccttcaccccttggacctctggcaggctcaccagtgattgctgctgccaacccccttgggatgcctgttccagctgccgctggcgctcagcagtaacggccctatctgtctcctgatgcctgagcagaggtgggggagtccaccctctccttgatgcagcttgcgcctggcggggaggggtgaaacacttcagaagcaccgtgtctgaaccgttgcttgtggatttatagtagttcagtcataaaaaaaaaattataataggctgattttcttttttctttttttttttaactcgaacttttcataactcaggggattccctgaaaaattacctgcaggtggaatatttcatggacaaatttttttttctcccctcccaaatttagttcctcatcacaaaagaacaaagataaaccagcctcaatcccggctgctgcatttaggtggagacttcttcccattcccaccattgttcctccaccgtcccacactttagggggttggtatctcgtgctcttctccagagattacaaaaatgtagcttctcaggggaggcaggaagaaaggaaggaaggaaagaaggaagggaggacccaatctataggagcagtggactgcttgctggtcgcttacatcactttactccataagcgcttcagtggggttatcctagtggctcttgtggaagtgtgtcttagttacatcaagatgttgaaaatctacccaaaatgcagacagatactaaaaacttctgttcagtaagaatcatgtcttactgatctaaccctaaatccaactcatttatacttttatttttagttcagtttaaaatgttgataccttccctcccaggctccttaccttggtcttttccctgttcatctcccaacatgctgtgctccatagctggtaggagagggaaggcaaaatctttcttagttttctttgtcttggccattttgaattcatttagttactgggcataacttactgctttttacaaaagaaacaaacattgtctgtacaggtttcatgctagagctaatgggagatgtggccacactgacttccattttaagctttctaccttcttttcctccgaccgtccccttccctcacatgccatccagtgagaagacctgctcctcagtcttgtaaatgtatcttgagaggtaggagcagagccactatctccattgaagctgaaatggtagacctgtaattgtgggaaaactataaactctcttgttacagccccgccaccccttgctgtgtgtatatatataatactttgtccttcatatgtgaaagatccagtgttggaattctttggtgtaaataaacgtttggttttatttatcaaggttagatttaagttccctgtgtaaaggtcttgctgggtgggtgtctcatgttcacatctgaggggcctgcagccctgtaccgtggaggcttcccaaggcccccattttatacacccctcgttcgacccatggtaccgggcagagcagagaggccttaaaaaaaaagcaccacaagccaaagcgtctctggggattaaggatcctttgccataaaactcattttgtgtctcagcagtgcagggattggggatggaaaaagtcgccagtttttgtgtgtttgtgtgtgtgtgtaaagtggactttccactgtaatccaaccacctaagtttatcaggtgcttcactgaggaagcctagttttttaagcacaatagcaaaaccatcagctctgtattttctcctgttatttcattacagtagctgcttgtgggaactaggaaaaattcttccaacatattttaaggcctaaaatcttagttccccattctcctaccttatagattcacaggcctttctcgcctaggcatcatagataaacgtaattgtttggggagttgaatttaatgaacttatctaactttgtaacccatcttggctttagtaactttatcaaggtggtggctttagtgaatataatggtaaactttagaggacgctaaagcctccttttatagcgcttctcaacggtagggagagctgaagggaaaacattctgactgtgtggcagggtgattttcttccttatgaccacttacagtggatatttattgtacttgacccttttatgccctagaatgctgtgagggttaccatgttgaatttgtgcagaagctaaaagcaccagatgtgccagagatgcaatttgtgattatgtttgcactggattgtgatttgaacaggacacttataactaatgagttctttcttttgaggtggggagagggttgtaaatcaagacttcataccctatccttgtagctcggaaattgaggtgtagcttaggctgatgcggagagctgcagacagctggacctccttacacccatcagaccttggaataaaccgaaggtgaatgcagaggactctgaggtgccacccaagagccttttaaaataaatagaagtttttaaaaatgctacttaagagtcactgcagaagcatggagagagagaaaaaaaaaaaagacccaattgggtggggggtgggggggaggcaagggtttacagagtaacaacttacgtgttgttgtaaattacctcatctgtataccttgtattgggacactatttctcagcactacctgtgtctgcattgcttagatggcaggaaatggaatggccaacatgaaaggttatgttggcaattactctgaaagattttttaaagtatttttaaactttgtttgaagtggtccctcccctcttcctctgcttttttttaagtttgaagccagaaggccctccccaccttgctttattggttgtaattgtattgtaattggtatgactaaaccataactgtgctgggaagaagttgtgccatgaaggtctttaattttttttaataaaaacatttaaataaatgaaatgtccctgca

SEQ ID NO: 744 - DNA, 4299 bp, Homo sapiens
gggggtttccgcttccggcagcagcggctgcagcctcgctctggtccctgcggctggcggccgagccgtgtgtctcctcctccatcgccgccatattgtctgtgtgagcagaggggagagcggccgccgccgctgccgcttccaccacagtttgaagaaaacaggtctgaaacaaggtcttacccccagctgcttctgaacacagtgactgccagatctccaaacatcaagtccagctttgtccgccaacctgtctgacatgtcgggacccgtgccaagcagggccagagtttacacagatgttaatacacacagacctcgagaatactgggattacgagtcacatgtggtggaatggggaaatcaagatgactaccagctggttcgaaaattaggccgaggtaaatacagtgaagtatttgaagccatcaacatcacaaataatgaaaaagttgttgttaaaattctcaagccagtaaaaaagaagaaaattaagcgtgaaataaagattttggagaatttgagaggaggtcccaacatcatcacactggcagacattgtaaaagaccctgtgtcacgaacccccgccttggtttttgaacacgtaaacaacacagacttcaagcaattgtaccagacgttaacagactatgatattcgattttacatgtatgagattctgaaggccctggattattgtcacagcatgggaattatgcacagagatgtcaagccccataatgtcatgattgatcatgagcacagaaagctacgactaatagactggggtttggctgagttttatcatcctggccaagaatataatgtccgagttgcttcccgatacttcaaaggtcctgagctacttgtagactatcagatgtacgattatagtttggatatgtggagtttgggttgtatgctggcaagtatgatctttcggaaggagccatttttccatggacatgacaattatgatcagttggtgaggatagccaaggttctggggacagaagatttatatgactatattgacaaatacaacattgaattagatccacgtttcaatgatatcttgggcagacactctcgaaagcgatgggaacgctttgtccacagtgaaaatcagcaccttgtcagccctgaggccttggatttcctggacaaactgctgcgatatgaccaccagtcacggcttactgcaagagaggcaatggagcacccctatttctacactgttgtgaaggaccaggctcgaatgggttcatctagcatgccagggggcagtacgcccgtcagcagcgccaatatgatgtcagggatttcttcagtgccaaccccttcaccccttggacctctggcaggctcaccagtgattgctgctgccaacccccttgggatgcctgttccagctgccgctggcgctcagcagtaacggccctatctgtctcctgatgcctgagcagaggtgggggagtccaccctctccttgatgcagcttgcgcctggcggggaggggtgaaacacttcagaagcaccgtgtctgaaccgttgcttgtggatttatagtagttcagtcataaaaaaaaaattataataggctgattttcttttttctttttttttttaactcgaacttttcataactcaggggattccctgaaaaattacctgcaggtggaatatttcatggacaaatttttttttctcccctcccaaatttagttcctcatcacaaaagaacaaagataaaccagcctcaatcccggctgctgcatttaggtggagacttcttcccattcccaccattgttcctccaccgtcccacactttagggggttggtatctcgtgctcttctccagagattacaaaaatgtagcttctcaggggaggcaggaagaaaggaaggaaggaaagaaggaagggaggacccaatctataggagcagtggactgcttgctggtcgcttacatcactttactccataagcgcttcagtggggttatcctagtggctcttgtggaagtgtgtcttagttacatcaagatgttgaaaatctacccaaaatgcagacagatactaaaaacttctgttcagtaagaatcatgtcttactgatctaaccctaaatccaactcatttatacttttatttttagttcagtttaaaatgttgataccttccctcccaggctccttaccttggtcttttccctgttcatctcccaacatgctgtgctccatagctggtaggagagggaaggcaaaatctttcttagttttctttgtcttggccattttgaattcatttagttactgggcataacttactgctttttacaaaagaaacaaacattgtctgtacaggtttcatgctagagctaatgggagatgtggccacactgacttccattttaagctttctaccttcttttcctccgaccgtccccttccctcacatgccatccagtgagaagacctgctcctcagtcttgtaaatgtatcttgagaggtaggagcagagccactatctccattgaagctgaaatggtagacctgtaattgtgggaaaactataaactctcttgttacagccccgccaccccttgctgtgtgtatatatataatactttgtccttcatatgtgaaagatccagtgttggaattctttggtgtaaataaacgtttggttttatttatcaaggttagatttaagttccctgtgtaaaggtcttgctgggtgggtgtctcatgttcacatctgaggggcctgcagccctgtaccgtggaggcttcccaaggcccccattttatacacccctcgttcgacccatggtaccgggcagagcagagaggccttaaaaaaaaagcaccacaagccaaagcgtctctggggattaaggatcctttgccataaaactcattttgtgtctcagcagtgcagggattggggatggaaaaagtcgccagtttttgtgtgtttgtgtgtgtgtgtaaagtggactttccactgtaatccaaccacctaagtttatcaggtgcttcactgaggaagcctagttttttaagcacaatagcaaaaccatcagctctgtattttctcctgttatttcattacagtagctgcttgtgggaactaggaaaaattcttccaacatattttaaggcctaaaatcttagttccccattctcctaccttatagattcacaggcctttctcgcctaggcatcatagataaacgtaattgtttggggagttgaatttaatgaacttatctaactttgtaacccatcttggctttagtaactttatcaaggtggtggctttagtgaatataatggtaaactttagaggacgctaaagcctccttttatagcgcttctcaacggtagggagagctgaagggaaaacattctgactgtgtggcagggtgattttcttccttatgaccacttacagtggatatttattgtacttgacccttttatgccctagaatgctgtgagggttaccatgttgaatttgtgcagaagctaaaagcaccagatgtgccagagatgcaatttgtgattatgtttgcactggattgtgatttgaacaggacacttataactaatgagttctttcttttgaggtggggagagggttgtaaatcaagacttcataccctatccttgtagctcggaaattgaggtgtagcttaggctgatgcggagagctgcagacagctggacctccttacacccatcagaccttggaataaaccgaaggtgaatgcagaggactctgaggtgccacccaagagccttttaaaataaatagaagtttttaaaaatgctacttaagagtcactgcagaagcatggagagagagaaaaaaaaaaaagacccaattgggtggggggtgggggggaggcaagggtttacagagtaacaacttacgtgttgttgtaaattacctcatctgtataccttgtattgggacactatttctcagcactacctgtgtctgcattgcttagatggcaggaaatggaatggccaacatgaaaggttatgttggcaattactctgaaagattttttaaagtatttttaaactttgtttgaagtggtccctcccctcttcctctgcttttttttaagtttgaagccagaaggccctccccaccttgctttattggttgtaattgtattgtaattggtatgactaaaccataactgtgctgggaagaagttgtgccatgaaggtctttaattttttttaataaaaacatttaaataaatgaaatgtccctgca

SEQ ID NO: 745 - DNA, 2606 bp, Homo sapiens
atattgtctgtgtgagcagaggggagagcggccgccgccgctgccgcttccaccacagtttgaagaaaacaggtctgaaacaaggtcttacccccagctgcttctgaacacagtgactgccagatctccaaacatcaagtccagctttgtccgccaacctgtctgacatgtcgggacccgtgccaagcagggccagagtttacacagatgttaatacacacagacctcgagaatactgggattacgagtcacatgtggtggaatggggaaatcaagatgactaccagctggttcgaaaattaggccgaggtaaatacagtgaagtatttgaagccatcaacatcacaaataatgaaaaagttgttgttaaaattctcaagccagtaaaaaagaagaaaattaagcgtgaaataaagattttggagaatttgagaggaggtcccaacatcatcacactggcagacattgtaaaagaccctgtgtcacgaacccccgccttggtttttgaacacgtaaacaacacagacttcaagcaattgtaccagacgttaacagactatgatattcgattttacatgtatgagattctgaaggccctggattattgtcacagcatgggaattatgcacagagatgtcaagccccataatgtcatgattgatcatgagcacagaaagctacgactaatagactggggtttggctgagttttatcatcctggccaagaatataatgtccgagttgcttcccgatacttcaaaggtcctgagctacttgtagactatcagatgtacgattatagtttggatatgtggagtttgggttgtatgctggcaagtatgatctttcggaaggagccatttttccatggacatgacaattatgatcagttggtgaggatagccaaggttctggggacagaagatttatatgactatattgacaaatacaacattgaattagatccacgtttcaatgatatcttgggcagacactctcgaaagcgatgggaacgctttgtccacagtgaaaatcagcaccttgtcagccctgaggccttggatttcctggacaaactgctgcgatatgaccaccagtcacggcttactgcaagagaggcaatggagcacccctatttctacactgttgtgaaggaccaggctcgaatgggttcatctagcatgccagggggcagtacgcccgtcagcagcgccaatatgatgtcagggatttcttcagtgccaaccccttcaccccttggacctctggcaggctcaccagtgattgctgctgccaacccccttggatgcctgttccagctgccgctgcgctcagcagtaacggccctatctgtctcctgatgcctgagcagaggtgggggagtccaccctctccttgatgcagcttgcgcctggcggggaggggtgaaacacttcagaagcaccgtgtctgaaccgttgcttgtggatttatagtagttcagtcataaaaaaaaaattataataggctgattttcttttttctttttttttttaactcgaacttttcataactcaggggattccctgaaaaattacctgcaggtggaatatttcatggacaaatttttttttctcccctcccaaatttagttcctcatcacaaaagaacaaagataaaccagcctcaatcccggctgctgcatttaggtggagacttcttcccattcccaccattgttcctccaccgtcccacactttagggggttggtatctcgtgctcttctccagagattacaaaaatgtagcttctcaggggaggcaggaagaaaggaaggaaggaaagaaggaagggaggacccaatctataggagcagtggactgcttgctggtcgcttacatcactttactccataagcgcttcagtggggttatcctagtggctcttgtggaagtgtgtcttagttacatcaagatgttgaaaatctacccaaaatgcagacagatactaaaaacttctgttcagtaagaatcatgtcttactgatctaaccctaaatccaactcatttatacttttatttttagttcagtttaaaatgttgataccttccctcccaggctccttaccttggtcttttccctgttcatctcccaacatgctgtgctccatagctggtaggagagggaaggcaaaatctttcttagttttctttgtcttggccattttgaattcatttagttactgggcataacttactgctttttacaaaagaaacaaacattgtctgtacaggtttcatgctagagctaatgggagatgtggccacactgacttccattttaagctttctaccttcttttcctccgaccgtccccttccctcacatgccatccagtgagaagacctgctcctcagtcttgtaaatgtatcttgagaggtaggagcagagccactatctccattgaagctgaaatggtagacctgtaattgtgggaaaactataaactctcttgttacagccccgccaccccttgctgtgtgtatatatataatactttgtccttcatatgtgaaagatccagtgttggaattctttggtgtaaataaacgtttggttttatttatc

SEQ ID NO: 746 - DNA, 2507 bp, Homo sapiens
cccgcctcctggtaggagggggtttccgcttccggcagcagcggctgcagcctcgctctggtccctgcggctggcggccgagccgtgtgtctcctcctccatcgccgccatattgtctgtgtgagcagaggggagagcggccgccgccgctgccgcttccaccacagaaatcaagatgactaccagctggttcgaaaattaggccgaggtaaatacagtgaagtatttgaagccatcaacatcacaaataatgaaaaagttgttgttaaaattctcaagccagtaaaaaagaagaaaattaagcgtgaaataaagattttggagaatttgagaggaggtcccaacatcatcacactggcagacattgtaaaagaccctgtgtcacgaacccccgccttggtttttgaacacgtaaacaacacagacttcaagcaattgtaccagacgttaacagactatgatattcgattttacatgtatgagattctgaaggccctggattattgtcacagcatgggaattatgcacagagatgtcaagccccataatgtcatgattgatcatgagcacagaaagctacgactaatagactggggtttggctgagttttatcatcctggccaagaatataatgtccgagttgcttcccgatacttcaaaggtcctgagctacttgtagactatcagatgtacgattatagtttggatatgtggagtttgggttgtatgctggcaagtatgatctttcggaaggagccatttttccatggacatgacaattatgatcagttggtgaggatagccaaggttctggggacagaagatttatatgactatattgacaaatacaacattgaattagatccacgtttcaatgatatcttgggcagacactctcgaaagcgatgggaacgctttgtccacagtgaaaatcagcaccttgtcagccctgaggccttggatttcctggacaaactgctgcgatatgaccaccagtcacggcttactgcaagagaggcaatggagcacccctatttctacactgttgtgaaggaccaggctcgaatgggttcatctagcatgccagggggcagtacgcccgtcagcagcgccaatatgatgtcagggatttcttcagtgccaaccccttcaccccttggacctctggcaggctcaccagtgattgctgctgccaacccccttgggatgcctgttccagctgccgctggcgctcagcagtaacggccctatctgtctcctgatgcctgagcagaggtgggggagtccaccctctccttgatgcagcttgcgcctggcggggaggggtgaaacacttcagaagcaccgtgtctgaaccgttgcttgtggatttatagtagttcagtcataaaaaaaaaattataataggctgattttcttttttctttttttttttaactcgaacttttcataactcaggggattccctgaaaaattacctgcaggtggaatatttcatggacaaatttttttttctcccctcccaaatttagttcctcatcacaaaagaacaaagataaaccagcctcaatcccggctgctgcatttaggtggagacttcttcccattcccaccattgttcctccaccgtcccacactttagggggttggtatctcgtgctcttctccagagattacaaaaatgtagcttctcaggggaggcaggaagaaaggaaggaaggaaagaaggaagggaggacccaatctataggagcagtggactgcttgctggtcgcttacatcactttactccataagcgcttcagtggggttatcctagtggctcttgtggaagtgtgtcttagttacatcaagatgttgaaaatctacccaaaatgcagacagatactaaaaacttctgttcagtaagaatcatgtcttactgatctaaccctaaatccaactcatttatacttttatttttagttcagtttaaaatgttgataccttccctcccaggctccttaccttggtcttttccctgttcatctcccaacatgctgtgctccatagctggtaggagagggaaggcaaaatctttcttagttttctttgtcttggccattttgaattcatttagttactgggcataacttactgctttttacaaaagaaacaaacattgtctgtacaggtttcatgctagagctaatgggagatgtggccacactgacttccattttaagctttctaccttcttttcctccgaccgtccccttccctcacatgccatccagtgagaagacctgctcctcagtcttgtaaatgtatcttgagaggtaggagcagagccactatctccattgaagctgaaatggtagacctgtaattgtgggaaaactataaactctcttgttacagccccgccaccccttgctgtgtgtatatatataatactttgtccttcatatgtgaaagatccagtgttggaattctttggtgtaaataaacgtttggttttatttatc

SEQ ID NO: 747 - DNA, 1483 bp, Homo sapiens
gccgccgctgccgcttccaccacagtttgaagaaaacaggtctgaaacaaggtcttacccccagctgcttctgaacacagtgactgccagatctccaaacatcaagtccagctttgtccgccaacctgtctgacatgtcgggacccgtgccaagcagggccagagtttacacagatgttaatacacacagacctcgagaatactgggattacgagtcacatgtggtggaatggggaaatcaagatgactaccagctggttcgaaaattaggccgaggtaaatacagtgaagtatttgaagccatcaacatcacaaataatgaaaaagttgttgttaaaattctcaagccagtaaaaaagaagaaaattaagcgtgaaataaagattttggagaatttgagaggaggtcccaacatcatcacactggcagacattgtaaaagaccctgtgtcacgaacccccgccttggtttttgaacacgtaaacaacacagacttcaagcaattgtaccagacgttaacagactatgatattcgattttacatgtatgagattctgaaggccctggattattgtcacagcatgggaattatgcacagagatgtcaagccccataatgtcatgattgatcatgagcacagaaagctacgactaatagactggggtttggctgagttttatcatcctggccaagaatataatgtccgagttgcttcccgatacttcaaaggtcctgagctacttgtagactatcagatgtacgattatagtttggatatgtggagtttgggttgtatgctggcaagtatgatctttcggaaggagccatttttccatggacatgacaattatgatcagttggtgaggatagccaaggttctggggacagaagatttatatgactatattgacaaatacaacattgaattagatccacgtttcaatgatatcttgggcagacactctcgaaagcgatgggaacgctttgtccacagtgaaaatcagcaccttgtcagccctgaggccttggatttcctggacaaactgctgcgatatgaccaccagtcacggcttactgcaagagaggcaatggagcacccctatttctacactgttgtgaaggaccaggctcgaatgggttcatctagcatgccagggggcagtacgcccgtcagcagcgccaatatgatgtcagagatgaagttttgccgtgttgcccaggctggtcttgaactcctgagctcaacagtctacccgccttggcctcccaaagtgctgagattagaggcatgagccaccacacctggcccactagggattcttattggcctcaatgtgagaagcccttccccaggtacctccagatggaagcttacaggatggtcagtccatttcttagagaagttcctggggggattgagtatttctgagtcagcttcactcttgcatcatctgctttgacagttttcttggctcctgtaatg

SEQ ID NO: 748 - DNA, 1659 bp, Homo sapiens
gcggccgcccgccgccgcgctcctcctcctcctcctccagcgcccggcggcccgctgcctcctccgcccgacgccccgcgtcccccgccgcgccgccgccgccaccctctgcgccccgcgccgccccccggtcccgcccgccatgcccggcccggccgcgggcagcagggcccgggtctacgccgaggtgaacagtctgaggagccgcgagtactgggactacgaggctcacgtcccgagctggggtaatcaagatgattaccaactggttcgaaaacttggtcggggaaaatatagtgaagtatttgaggccattaatatcaccaacaatgagagagtggttgtaaaaatcctgaagccagtgaagaaaaagaagataaaacgagaggttaagattctggagaaccttcgtggtggaacaaatatcattaagctgattgacactgtaaaggaccccgtgtcaaagacaccagctttggtatttgaatatatcaataatacagattttaagcaactctaccagatcctgacagactttgatatccggttttatatgtatgaactacttaaagctctggattactgccacagcaagggaatcatgcacagggatgtgaaacctcacaatgtcatgatagatcaccaacagaaaaagctgcgactgatagattggggtctggcagaattctatcatcctgctcaggagtacaatgttcgtgtagcctcaaggtacttcaagggaccagagctcctcgtggactatcagatgtatgattatagcttggacatgtggagtttgggctgtatgttagcaagcatgatctttcgaagggaaccattcttccatggacaggacaactatgaccagcttgttcgcattgccaaggttctgggtacagaagaactgtatgggtatctgaagaagtatcacatagacctagatccacacttcaacgatatcctgggacaacattcacggaaacgctgggaaaactttatccatagtgagaacagacaccttgtcagccctgaggccctagatcttctggacaaacttctgcgatacgaccatcaacagagactgactgccaaagaggccatggagcacccatacttctaccctgtggtgaaggagcagtcccagccttgtgcagacaatgctgtgctttccagtggtctcacggcagcacgatgaagactggaaagcgacgggtctgttgcggttctcccacttttccataagcagaacaagaaccaaatcaaacgtcttaacgcgtatagagagatcacgttccgtgagcagacacaaaacggtggcaggtttggcgagcacgaactagaccaagcgaagggcagcccaccaccgtatatcaaacctcacttccgaatgtaaaaggctcacttgcctttggcttcctgttgacttcttcccgacccagaaagcatggggaatgtgaagggtatgcagaatgttgttggttactgttgctccccgagcccctcgactcgtcccgtggccgcctgtttttccagcaaaccacgctaactagctgaccacagactccacagtggggggacgggcgcagtatgtggcatggcggcagttacatattattattttaaaagtatatattattgaataaaaggttttaaaagaaa

SEQ ID NO: 749 - DNA, 1169 bp, Homo sapiens
gccattaacaaagatggtgcttatggggcaggttccctaacagtcaggattccggttgcagtttttctcccccgccccaaagatacgtggttgcagacggagaaatggaggccagagacaaacaagtactccgctcacttcgcctggagctgggtgcagaggtattggtggagggactggttcttcagtacctctaccaggaaggaatcttgacggaaaaccatattcaagaaatcaatgctcaaaccacaggcctccggaaaacaatgctcctgctggatatcctaccttccaggggccctaaagcatttgatacattcctagattccctacaggagtttccctgggtcagggagaagctgaagaaggcaagggaagaggccatgaccgacctgcctgcaggtgacagattgactgggatcccctcgcacatcctcaacagctccccatcagaccggcagattaaccagctggcccagaggctgggccctgagtgggagcccatggtgctgtctctgggactgtcccagacggatatctaccgctgtaaggccaaccacccccacaacgtgcagtcgcaggtggtggaggccttcatccgttggcggcagcgcttcgggaagcaggccaccttccagagcctgcacaacgggctgcgggctgtggaggtggacccctcgctgctcctgcacatgttggagtgatggtgcctccagcaaccgctggggagtgtgtccctgagtcatgtgggctgaatcctgactttcactcagagcaggtggttttttgtgtaggtttgttttttatttttgatgatcttcagatggaaggagaaaacagggtttccactagacattacttgaaaggccagattactcagcagatctcccatgttggctcaacaattctttgtttttaattgcttgaagattgcattgttgtaattgttcagtttttaaatgtgtaatggcattttaatagactagtaaatcacagtggttcaaaatatatatccatatatatatatatccatatatatatctcatgtcatcacattacaggcaggtgtctcatatgtaaaacatttacctgaatgttgtctgaggactgaactgtggactttactattcataatgataaaataataaaatgcgaattactatatataa

SEQ ID NO: 750 - DNA, 366 bp, Homo sapiens
atggaggccagagacaaacaagtactccgctcacttcgcctggagctgggtgcagaggtattggtggagggactggttcttcagtacctctaccaggaaggaatcttgacggaaaaccatattcaagaaatcaatgctcaaaccacaggcctccggaaaacaatgctcctgctggatatcctaccttccaggggccctaaagcatttgatacattcctagattccctacaggagtttccctgggtcagggagaagctgaagaaggcaagggaagaggccatgaccgacctgcctgcagagatgaggaaactgaggccaaaggattctgttacttgcctggcttcacagctcacctggagattctga

SEQ ID NO: 751 - DNA, 1403 bp, Homo sapiens
aagggtttcagcggccgaagcagagcctttttaaatagttcccaatgggcgctcacggccaaacgtgaacacctcccctcctcacctgtcacctcctgaactttacagggttgcgagggggagtgtgggatcgggtgtcgcctagccgtggtcgtactgcccgggtgtgtctgaagccccatctgtcatccctgcctgccttcccggtcacttaaccttcactgccttacacacaaccaagccacagcacactggtgcaggggtggtggaactgcaccttcaaatcgtgcctggctactgaccagtgctgggggagaaatggaggccagagacaaacaagtactccgctcacttcgcctggagctgggtgcagaggtattggtggagggactggttcttcagtacctctaccaggaaggaatcttgacggaaaaccatattcaagaaatcaatgctcaaaccacaggcctccggaaaacaatgctcctgctggatatcctaccttccaggggccctaaagcatttgatacattcctagattccctacaggagtttccctgggtcagggagaagctgaagaaggcaagggaagaggccatgaccgacctgcctgcaggtgacagattgactgggatcccctcgcacatcctcaacagctccccatcagaccggcagattaaccagctggcccagaggctgggccctgagtgggagcccatggtgctgtctctgggactgtcccagacggatatctaccgctgtaaggccaaccacccccacaacgtgcagtcgcaggtggtggaggccttcatccgttggcggcagcgcttcgggaagcaggccaccttccagagcctgcacaacgggctgcgggctgtggaggtggacccctcgctgctcctgcacatgttggagtgatggtgcctccagcaaccgctggggagtgtgtccctgagtcatgtgggctgaatcctgactttcactcagagcaggtggttttttgtgtaggtttgttttttatttttgatgatcttcagatggaaggagaaaacagggtttccactagacattacttgaaaggccagattactcagcagatctcccatgttggctcaacaattctttgtttttaattgcttgaagattgcattgttgtaattgttcagtttttaaatgtgtaatggcattttaatagactagtaaatcacagtggttcaaaatatatatccatatatatatatatccatatatatatctcatgtcatcacattacaggcaggtgtctcatatgtaaaacatttacctgaatgttgtctgaggactgaactgtggactttactattcataatgataaaataataaaatgcgaattactatatataatgtgcctcactcatgagaaa

SEQ ID NO: 752 - DNA, 1293 bp, Homo sapiens
ggggcaggttccctaacagtcaggattccggttgcagtttttctcccccgccccaaagatacgtggttgcagacggagaaatggaggccagagacaaacaagtactccgctcacttcgcctggagctgggtgcagaggtattggtggagggactggttcttcagtacctctaccaggaaggaatcttgacggaaaaccatattcaagaaatcaatgctcaaaccacaggcctccggaaaacaatgctcctgctggatatcctaccttccaggggccctaaagcatttgatacattcctagattccctacaggagtttccctgggtcagggagaagctgaagaaggcaagggaagaggccatgaccgacctgcctgcagggtgttggccatgatccttatgatggggaggaagggaatcaccaattttctaccccatcccactgagcaacttagagatgacctaaggcctcgttacctgtgtggagtaactgggaattggaagagatgaggaaactgaggccaaaggattctgttacttgcctggcttcacagctcacctggagattctgaactggcatcttcctctctctgccatcaccccagaccctaccctctttcctctacaccagtggttctcaatcaagggcgattttgccttccaggggacatttgacaatgtctggaggcgtttttggttgtcacaattctgtgtatgtgtgtgggtgggcggggggcaggggattatgttggcatctagtgagtagataacagagatgctgctaaacctacaatgctcagatggcccctaacaaagaagtatgttgtccaaaatgtcaatggtgcagagggtgagaagccctggtctatacagagctcagcagtccagagcaattgcaacctctgggagttgccaagagctcctctgcccagcaacaggcttggcctctctcctgtggctgccacaagagttaaagccactgtctggaatgccctttggcagtggccaagtgtcccctgcagaactgactgcgggacatgcggtgcatcagccggagctgatgtgttttgtaatttatagtcacagggcgcctgtcttcatttagcagtaggcctgctggcagcttccctgccagggaggaagcaagttccacagaggcccacagcccccgccagctgccggcccgtggtatttggggacggctgttgctcagagacacctgggaataggccggggccgagatggcgctgagcactcggtctccccttcagacccatccatcagcagcggtccct

SEQ ID NO: 753 - DNA, 2295 bp, Homo sapiens
tttactcctaacgcgtggaacttgtgtcgacatccacccccggttactgcatactcagtcacacaagccatagcaggaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaattagctgggtgtgggtgtgggtacctgtattcccagttacttgggaggctgaggtgggaggatcttttgaacccaggagttcagggtcatagcatgctgtgattgtgcctacgaatagccactgcataccaacctgggcaatatagcaagatcccatctctttaaaaaaaaaaaaaaaggacaggaactatctta

SEQ ID NO: 754 - DNA, 1841 bp, Homo sapiens
caagccatagcaggaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagggggacaattcccggaagtggaattacagagtcaaaggacatgcatttttcaagcctcggatgcatcttactagatgtcctatag

SEQ ID NO: 755 - DNA, 1787 bp, Homo sapiens
caagccatagcaggaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcagggaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagggggacaattcccggaagtggaattacagagtcaaaggacatgcatttttcaagcctcggatgcatcttactagatgtcctatag

SEQ ID NO: 756 - DNA, 1689 bp, Homo sapiens
caagccatagcaggaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaattagctgggtgtgggtgtgggtacctgtattcccagttacttgggaggctgaggtgggaggatcttttgaacccaggagttcagggtcatagcatgctgtgattgtgcctacgaatagccactgcataccaacctgggcaatatagcaagatcccatctcttt

SEQ ID NO: 757 - DNA, 4415 bp, Homo sapiens
gggtgcgccttcccggcgtctaggggagcgaaggctgaggtggcagcggcaggagagtccggccgcgacaggacgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctggtggatggaatggaacctggatgaccaaagcctcctttagcttgtggctagaaatcgcgtccctttatattcttcatatcccagatctgccaactccattgccctgtatattcatgatctctgcaaaatgctgccaagcagttcttaacatttcagtcttcaagaaagaatctgggatctgcacaggctggcagagctatggacattcaggggttttgcatgtatgctgaaccctactgccttgctctggtatttggcctcacaaccactgtccaacttcgggtgatgtcacttgggtctcataccttccttgcatgtgtcccaagtttcacaaaacctccttatggaaaagagcacattcgatttcttccttgataaaagggaccagattcacattggccttctgctttacttgcattcctcattgtcttttagactcagcctcagcttgggctttgttagcaagttcactgccaccatagcatcacagcctaaagggcatggctgagactcattgatctatagagcactcttttaccccaacatactctaaatgactgatcaaagatcaaaaacagaagagcatttatactccattcttgttttttgagacctgcttgatttattccgattatttaacacacagggacgcaacagtgatcccaaagtgtgtaaagttaaagccttcaactgcagctgaggagagggcaggaatggggacggtggtgagtcaggaatgacaggcaggcagccatgaccagggcagcctcctccccagggccagggactggggagtggcctaaggagcaggacctaagggtagcccagagctggggaagggggcagagacctccccttggcctaggtctggagctcagaagtgccacatgcctgagggggcagcggcctgggaagggccagaggcagggtcaggagagcaccatttcctggggggctggggacagggaggtgccctataggagaagccaggaggggccgtctgcccctgaggtgggggctgggctggagcaggctgcagcaagaaagacctgaggcaggcacagggcctgagagcccagctgcctgggttcaggggggctcccagggcagcctggcccagggagcagtcctgactctgcaggggatgcccagcaaggggggctgcagacccctcagagcctcccctcctctctccctggaaaggagctggggaacccatagtgcaaatctgtggaccactcagttatggagggaggctgtgcctgaaggtggacactggggtgcactccctccaccatctcgccctgcaccgctgtcctcagtacagccacttctcgtaagagtgcaggccatggatgccaccgtcgatctgggctgacatggtctgcttctcaaacttgagctcccctgagtacatcatggaccgaaggacagacaggctgtgggccccgatatcctggcagccatgctggatgcccactatgaggtagggcacgaacttctgaatggaccctttgtcctggatggagcccaagacatcctgcgtgatcttcgccttatccccgtcgttgaagtattgtttctggctgctgctgctcttctccatggcatccagtgagcccatgccctggtacttcttgagctgcattccgtctgagaagaagcactcgccgggggcctccatggtggcggccagcagggagcccatcatcactgtggaggctcctagggccagggccttgaccacatgccccatggtctggatgccaccatcggctatgatgggcacaccaaagttctgggtatgcttggccaccttgtacacagcagtgccctggggctgactgcaggctatcacttcctggttgatgtagatggagccgcgcagtccatgcccctgcccagcccatccacaccagcgtcaatcaggttgttggcctgggctgctgtcaccacgttccccccaatcacctggaggtggggttacttttgtttgatgtaatgcaccatggcgatctgatacaccgagttcccttgggacgagtccaagcctatgacattgacgcctacctgggtgagcaggtccaggtggtatttgtcatcctcatgggtacccacagctgccccgcccagcagctgctcatgggaatccttggaggccacagggtagtctcggttcttcagcgcggtgcaggtgataatggccaccagctcatcgcgatcattgacgataggcagcttcctttcttactaagctgcaggatctcatttgcctctttcaacctcacactgctggagccaccactagcttgatccttggcatcatcacctcactgaggagggtggtgtggtccttctcagcaagaaagtcgatgtctcgggaggtgacgatgcccaccagcttgctgcccatggtacccgtctcagtgatggggatgccagagaagccatgacgcatcttggcctccaacacatcacccacagtgtgcaaggggctcagcaccacggggtgtgtgataaagcccggttcaaacttcttgaccttctgcacctcactggcctggaactctggggtgcagttgtggtgaatgaaaccagtacctcccatcagagccatcacgatggccaggtcggcctctgtcacagtgtccatgggggaggagatcagcggcgtcttcagagtgaccattgggtcagggctgaggtcaggtccacctcatcagctatgaagtctatgaatcctgggagaatcaagaagtcgttgtaggtgagtccctggtcactggcgaagagctgctgcacggtgtggggaaaagaaagagagatcagattgttactgtgtctgtgtagaaagaagtagacataggagactccattttgttctgtactaagaaaaattcttctgcctcgagatgctgttaatctgtaaccttacccccaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccaggtattgtccaaggtttctccccatgtgatagtctgaaatatggcctcatgggaagggaaagacctgaccgtcccccagcccgacacccataaagggtctgtgctgaggaggattagtaaaagaggaaggaacgcctgtttgcagttgagagaagaggaaggcatctgtctcctgccagtccctgggcaatggaatgtctcggtgtaaaacctgattgtatgttccatctgctgagataggggaaaaccgccttagggctggaggtgggacatgcgggcagcactactgctctttaagtcattgagatgtttatgtgtatgcatatctgaagcacagcacttaattctttaccttgttcttgatgcagagacctttgttcacgtgtttatctgctgaccttctctccactattattctatgaccctgccacacccccctctccgagaaacacctaaaaatgatcaataaatactaagggaactaagaggccggcgggatcctccgtatgctgaacgccggtcccctgggcccccttttttctttctct

SEQ ID NO: 758 - DNA, 684 bp, Homo sapiens
agtcaggctgtctgtcgttgggcttttcccacttccttctactacgtacttcttccctattcctcctactgaggccattaaacccttagttgtaattttccctgaacatgctttacattctgatgaattctgaaaaagaatgtggggtttccttgcagatgagttcatctgttgtttcatttcctttacaataactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggatt

SEQ ID NO: 759 - DNA, 2128 bp, Homo sapiens
cactcagtcctggtggggtcgcacgtaacggtcctgagctatgcataagccgtttgaccacgcatggagaattttaccacccagagacacgcgagtggccctgtgcaagtttcaactgcgcggggggcggggaattccgcagacaggattctagaatttatgtcttgtgtggtaacatttcagccggtgggtggcggggattaggcgtgaagcggttcagcaggcagaggttctcggacgccctccggcgaagccacctgttgatgcttttgactttctgtccttgttcctcgtcccatctggagcatttccaattctggttttgcggagcagcaggtctgagcttgtccggcgagggtgggagttggtcccggcggagatccagtgggaagagccggcggctgcccgggcaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatac

SEQ ID NO: 760 - DNA, 596 bp, Homo sapiens
caatgatgaccagtctgttcaagacccaagagggctgagattggcagccctggccattgtttaccacagcctaatgaagatgagtaaaagcctatctatccccaaggacctccacatatgacagtactcaactgagtctcacataggatagaataagataaaatgctggaagagaacacaaatagtgctacaaagcaggaagagagacttgatttggggatcaagacaagcttatagaagagacatcttgagagagaagatataatttcagaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgag

SEQ ID NO: 761 - DNA, 435 bp, Homo sapiens
cctttcgaaagttgttgggaacgtggactttcccaacaattgtgtatgcgctcgatctcactcagtgggagccgccgccctggagggaatttcacaatagcctgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatt

SEQ ID NO: 762 - DNA, 655 bp, Homo sapiens
cacagcggtacaagctgcaccccgatggacctgagagaccggaagtaacccttggccaactctggccgccccctgcagccgcagccccagaggcccacccgcgagcttcagtggcgggccctcagcgtcgtaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaag

SEQ ID NO: 763 - DNA, 1679 bp, Homo sapiens
atactcagtcacacaagccatagcaggaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaattagctgggtgtgggtgtgggtacctgtattcccagttacttgggag

SEQ ID NO: 764 - DNA, 1283 bp, Homo sapiens
caagccatagcaggaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggatgataacaccctatgcccattgtcctgatctgaaaattcttggaaattgttccatgtgattaacatggaactgcctctacttaatcattctgaatgattaaatcgtttcattttctaaatgtgttataatgtgtttagccctttcttgttgctgtatgtttagatgctttccaatcttttgttactactaataatgctataaaataaatatccttgtacttctt

SEQ ID NO: 765 - DNA, 2056 bp, Homo sapiens
cgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaattagctgggtgtgggtgtgggtacctgtattcccagttacttgggaggctgaggtgggaggatcttttgaacccaggagttcagggtcatagcatgctgtgattgtgcctacgaatagccactgcataccaacctgggcaatatagcaagatcccatctcttta

SEQ ID NO: 766 - DNA, 1281 bp, Homo sapiens
gggaggagagaaaagccatggccgacaaggtcctgaaggagaagagaaagctgtttatccgttccatgggtgaaggtacaataaatggcttactggatgaattattacagacaagggtgctgaacaaggaagagatggagaaagtaaaacgtgaaaatgctacagttatggataagacccgagctttgattgactccgttattccgaaaggggcacaggcatgccaaatttgcatcacatacatttgtgaagaagacagttacctggcagggacgctgggactctcagcagctcctcaggcagtgcaggacaacccagctatgcccacatcctcaggctcagaagggaatgtcaagctttgctccctagaagaagctcaaaggatatggaaacaaaagtcggcagagatttatccaataatggacaagtcaagccgcacacgtcttgctctcattatctgcaatgaagaatttgacagtattcctagaagaactggagctgaggttgacatcacaggcatgacaatgctgctacaaaatctggggtacagcgtagatgtgaaaaaaaatctcactgcttcggacatgactacagagctggaggcatttgcacaccgcccagagcacaagacctctgacagcacgttcctggtgttcatgtctcatggtattcgggaaggcatttgtgggaagaaacactctgagcaagtcccagatatactacaactcaatgcaatctttaacatgttgaataccaagaactgcccaagtttgaaggacaaaccgaaggtgatcatcatccaggcctgccgtggtgacagccctggtgtggtgtggtttaaagattcagtaggagtttctggaaacctatctttaccaactacagaagagtttgaggatgatgctattaagaaagcccacatagagaaggattttatcgctttctgctcttccacaccagataatgtttcttggagacatcccacaatgggctctgtttttattggaagactcattgaacatatgcaagaatatgcctgttcctgtgatgtggaggaaattttccgcaaggttcgattttcatttgagcagccagatggtagagcgcagatgcccaccactgaaagagtgactttgacaagatgtttctacctcttcccaggacattaaaataaggaaactgtatgaatgtctgtgggcaggaagtgaagagatccttctgtaaaggtttttggaattatgtctgctgaataataaacttttttgaaataataaatctggt

SEQ ID NO: 767 - DNA, 921 bp, Homo sapiens
gggaggagagaaaagccatggccgacaaggtcctgaaggagaagagaaagctgtttatccgttccatgggtgaagctcctcaggcagtgcaggacaacccagctatgcccacatcctcaggctcagaagggaatgtcaagctttgctccctagaagaagctcaaaggatatggaaacaaaagtcggcagagatttatccaataatggacaagtcaagccgcacacgtcttgctctcattatctgcaatgaagaatttgacagtattcctagaagaactggagctgaggttgacatcacaggcatgacaatgctgctacaaaatctggggtacagcgtagatgtgaaaaaaaatctcactgcttcggacatgactacagagctggaggcatttgcacaccgcccagagcacaagacctctgacagcacgttcctggtgttcatgtctcatggtattcgggaaggcatttgtgggaagaaacactctgagcaagtcccagatatactacaactcaatgcaatctttaacatgttgaataccaagaactgcccaagtttgaaggacaaaccgaaggtgatcatcatccaggcctgccgtggtgataatgtttcttggagacatcccacaatgggctctgtttttattggaagactcattgaacatatgcaagaatatgcctgttcctgtgatgtggaggaaattttccgcaaggttcgattttcatttgagcagccagatggtagagcgcagatgcccaccactgaaagagtgactttgacaagatgtttctacctcttcccaggacattaaaataaggaaactgtatgaatgtctgtgggcaggaagtgaagagatccttctgtaaaggtttttggaattatgtctgctgaataataaacttttttgaaataataaatctggt

SEQ ID NO: 768 - DNA, 396 bp, Homo sapiens
gggaggagagaaaagccatggccgacaaggtcctgaaggagaagagaaagctgtttatccgttccatgggtgaagataatgtttcttggagacatcccacaatgggctctgtttttattggaagactcattgaacatatgcaagaatatgcctgttcctgtgatgtggaggaaattttccgcaaggttcgattttcatttgagcagccagatggtagagcgcagatgcccaccactgaaagagtgactttgacaagatgtttctacctcttcccaggacattaaaataaggaaactgtatgaatgtctgtgggcaggaagtgaagagatccttctgtaaaggtttttggaattatgtctgctgaataataaacttttttgaaataataaatctggt

SEQ ID NO: 769 - DNA, 1264 bp, Homo sapiens
atggccgacaaggtcctgaaggagaagagaaagctgtttatccgttccatgggtgaaggtacaataaatggcttactggatgaattattacagacaagggtgctgaacaaggaagagatggagaaagtaaaacgtgaaaatgctacagttatggataagacccgagctttgattgactccgttattccgaaaggggcacaggcatgccaaatttgcatcacatacatttgtgaagaagacagttacctggcagggacgctgggactctcagcagctcctcaggcagtgcaggacaacccagctatgcccacatcctcaggctcagaagggaatgtcaagctttgctccctagaagaagctcaaaggatatggaaacaaaagtcggcagagatttatccaataatggacaagtcaagccgcacacgtcttgctctcattatctgcaatgaagaatttgacagtattcctagaagaactggagctgaggttgacatcacaggcatgacaatgctgctacaaaatctggggtacagcgtagatgtgaaaaaaaatctcactgcttcggacatgactacagagctggaggcatttgcacaccgcccagagcacaagacctctgacagcacgttcctggtgttcatgtctcatggtattcgggaaggcatttgtgggaagaaacactctgagcaagtcccagatatactacaactcaatgcaatctttaacatgttgaataccaagaactgcccaagtttgaaggacaaaccgaaggtgatcatcatccaggcctgccgtggtgacagccctggtgtggtgtggtttaaagattcagtaggagtttctggaaacctatctttaccaactacagaagagtttgaggatgatgctattaagaaagcccacatagagaaggattttatcgctttctgctcttccacaccagataatgtttcttggagacatcccacaatgggctctgtttttattggaagactcattgaacatatgcaagaatatgcctgttcctgtgatgtggaggaaattttccgcaaggttcgattttcatttgagcagccagatggtagagcgcagatgcccaccactgaaagagtgactttgacaagatgtttctacctcttcccaggacattaaaataaggaaactgtatgaatgtctgtgggcaggaagtgaagagatccttctgtaaaggtttttggaattatgtctgctgaataataaacttttttgaaataataaatctggt

SEQ ID NO: 770 - DNA, 396 bp, Homo sapiens; identical to SEQ ID NO: 768

SEQ ID NO: 771 - DNA, 1477 bp, Homo sapiens
ctttaatgggaagaaaaataaagacatgcatatgcatgcacagtgagtatttcccaatacatgtacaggccctgccaaaaaggaaggcgaagcatactttcagtttcagtcacacaagaagggaggagagaaaagccatggccgacaaggtcctgaaggagaagagaaagctgtttatccgttccatgggtgaaggtacaataaatggcttactggatgaattattacagacaagggtgctgaacaaggaagagatggagaaagtaaaacgtgaaaatgctacagttatggataagacccgagctttgattgactccgttattccgaaaggggcacaggcatgccaaatttgcatcacatacatttgtgaagaagacagttacctggcagggacgctgggactctcagcagatcaaacatctggaaattaccttaatatgcaagactctcaaggagtactttcttcctttccagctcctcaggcagtgcaggacaacccagctatgcccacatcctcaggctcagaagggaatgtcaagctttgctccctagaagaagctcaaaggatatggaaacaaaagtcggcagagatttatccaataatggacaagtcaagccgcacacgtcttgctctcattatctgcaatgaagaatttgacagtattcctagaagaactggagctgaggttgacatcacaggcatgacaatgctgctacaaaatctggggtacagcgtagatgtgaaaaaaaatctcactgcttcggacatgactacagagctggaggcatttgcacaccgcccagagcacaagacctctgacagcacgttcctggtgttcatgtctcatggtattcgggaaggcatttgtgggaagaaacactctgagcaagtcccagatatactacaactcaatgcaatctttaacatgttgaataccaagaactgcccaagtttgaaggacaaaccgaaggtgatcatcatccaggcctgccgtggtgacagccctggtgtggtgtggtttaaagattcagtaggagtttctggaaacctatctttaccaactacagaagagtttgaggatgatgctattaagaaagcccacatagagaaggattttatcgctttctgctcttccacaccagataatgtttcttggagacatcccacaatgggctctgtttttattggaagactcattgaacatatgcaagaatatgcctgttcctgtgatgtggaggaaattttccgcaaggttcgattttcatttgagcagccagatggtagagcgcagatgcccaccactgaaagagtgactttgacaagatgtttctacctcttcccaggacattaaaataaggaaactgtatgaatgtctgtgggcaggaagtgaagagatccttctgtaaaggtttttggaattatgtctgctgaataataaacttttttgaaataataaatctggtagaaaaatgaaaa

SEQ ID NO: 772 - DNA, 921 bp, Homo sapiens; identical to SEQ ID NO: 767

SEQ ID NO: 773 - DNA, 1237 bp, Homo sapiens
agtttcagtcacacaagaagggaggagagaaaagccatggccgacaaggtcctgaaggagaagagaaagctgtttatccgttccatgggtgaaggtacaataaatggcttactggatgaattattacagacaagggtgctgaacaaggaagagatggagaaagtaaaacgtgaaaatgctacagttatggataagacccgagctttgattgactccgttattccgaaaggggcacaggcatgccaaatttgcatcacatacatttgtgaagaagacagttacctggcagggacgctgggactctcagcagctcctcaggcagtgcaggacaacccagctatgcccacatcctcaggctcagaagggaatgtcaagctttgctccctagaagaagctcaaaggatatggaaacaaaagtcggcagagatttatccaataatggacaagtcaagccgcacacgtcttgctctcattatctgcaatgaagaatttgacagtattcctagaagaactggagctgaggttgacatcacaggcatgacaatgctgctacaaaatctggggtacagcgtagatgtgaaaaaaaatctcactgcttcggacatgactacagagctggaggcatttgcacaccgcccagagcacaagacctctgacagcacgttcctggtgttcatgtctcatggtattcgggaaggcatttgtgggaagaaacactctgagcaagtcccagatatactacaactcaatgcaatctttaacatgttgaataccaagaactgcccaagtttgaaggacaaaccgaaggtgatcatcatccaggcctgccgtggtgacagccctggtgtggtgtggtttaaagattcagtaggagtttctggaaacctatctttaccaactacagaagagtttgaggatgatgctattaagaaagcccacatagagaaggattttatcgctttctgctcttccacaccagataatgtttcttggagacatcccacaatgggctctgtttttattggaagactcattgaacatatgcaagaatatgcctgttcctgtgatgtggaggaaattttccgcaaggttcgattttcatttgagcagccagatggtagagcgcagatgcccaccactgaaagagtgactttgacaagatgtttctacctcttcccaggacattaaaataaggaaactgtatgaatgtctgtgggcaggtacatgtgtatggtcg

SEQ ID NO: 774 - DNA, 1061 bp, Homo sapiens
atggccgacaaggtcctgaaggagaagagaaagctgtttatccgttccatgggtgaagctcctcaggcagtgcaggacaacccagctatgcccacatcctcaggctcagaagggaatgtcaagctttgctccctagaagaagctcaaaggatatggaaacaaaagtcggcagagatttatccaataatggacaagtcaagccgcacacgtcttgctctcattatctgcaatgaagaatttgacagtattcctagaagaactggagctgaggttgacatcacaggcatgacaatgctgctacaaaatctggggtacagcgtagatgtgaaaaaaaatctcactgcttcggacatgactacagagctggaggcatttgcacaccgcccagagcacaagacctctgacagcacgttcctggtgttcatgtctcatggtattcgggaaggcatttgtgggaagaaacactctgagcaagtcccagatatactacaactcaatgcaatctttaacatgttgaataccaagaactgcccaagtttgaaggacaaaccgaaggtgatcatcatccaggcctgccgtggtgacagccctggtgtggtgtggtttaaagattcagtaggagtttctggaaacctatctttaccaactacagaagagtttgaggatgatgctattaagaaagcccacatagagaaggattttatcgctttctgctcttccacaccagataatgtttcttggagacatcccacaatgggctctgtttttattggaagactcattgaacatatgcaagaatatgcctgttcctgtgatgtggaggaaattttccgcaaggttcgattttcatttgagcagccagatggtagagcgcagatgcccaccactgaaagagtgactttgacaagatgtttctacctcttcccaggacattaaaataaggaaactgtatgaatgtctgtgggcaggaagtgaagagatccttctgtaaaggtttttggaattatgtctgctgaataataaacttttttgaaataataaatctggtagaaaaatgaaaa

SEQ ID NO: 775 - DNA, 1402 bp, Homo sapiens
tttcagtcacacaagaagggaggagagaaaagccatggccgacaagggtgctgaacaaggaagagatggagaaagtaaaacgtgaaaatgctacagttatggataagacccgagctttgattgactccgttattccgaaaggggcacaggcatgccaaatttgcatcacatacatttgtgaagaagacagttacctggcagggacgctgggactctcagcagatcaaacatctggaaattaccttaatatgcaagactctcaaggagtactttcttcctttccagctcctcaggcagtgcaggacaacccagctatgcccacatcctcaggctcagaagggaatgtcaagctttgctccctagaagaagctcaaaggatatggaaacaaaagtcggcagagatttatccaataatggacaagtcaagccgcacacgtcttgctctcattatctgcaatgaagaatttgacagtattcctagaagaactggagctgaggttgacatcacaggcatgacaatgctgctacaaaatctggggtacagcgtagatgtgaaaaaaaatctcactgcttcggacatgactacagagctggaggcatttgcacaccgcccagagcacaagacctctgacagcacgttcctggtgttcatgtctcatggtattcgggaaggcatttgtgggaagaaacactctgagcaagtcccagatatactacaactcaatgcaatctttaacatgttgaataccaagaactgcccaagtttgaaggacaaaccgaaggtgatcatcatccaggcctgccgtggtgacagccctggtgtggtgtggtttaaagattcagtaggagtttctggaaacctatctttaccaactacagaagagtttgaggatgatgctattaagaaagcccacatagagaaggattttatcgctttctgctcttccacaccaggcaagagccagtcttgagatttgaaatgtgctttatccatagataatgtttcttggagacatcccacaatgggctctgtttttattggaagactcattgaacatatgcaagaatatgcctgttcctgtgatgtggaggaaattttccgcaaggtaagatgctagtggatgctattttcactctacttccctgaatgcttggctattgcaattggaagcatagaaagcagatccagacaagtttatcttccaataatgctcttctttccaaaagagttttggagttctttggagagtggacaaacccaggagcctaatccaatctattaagacccacagccttgagaaaacaatcatttagtttcaccccgctcctgccctgcagagacaaatgaatggactctaatttacctgtgtctctcatggctattagatccagcagcagattt

SEQ ID NO: 776 - DNA, 1392 bp, Homo sapiens
tttcagtcacacaagaagggaggagagaaaagccatggccgacaaggtcctgaaggagaagagaaagctgtttatccgttccatgggtgaaggtacaataaatggcttactggatgaattattacagacaagggtgctgaacaaggaagagatggagaaagtaaaacgtgaaaatgctacagttatggataagacccgagctttgattgactccgttattccgaaaggggcacaggcatgccaaatttgcatcacatacatttgtgaagaagacagttacctggcagggacgctgggactctcagcagatttatccaataatggacaagtcaagccgcacacgtcttgctctcattatctgcaatgaagaatttgacagtattcctagaagaactggagctgaggttgacatcacaggcatgacaatgctgctacaaaatctggggtacagcgtagatgtgaaaaaaaatctcactgcttcggacatgactacagagctggaggcatttgcacaccgcccagagcacaagacctctgacagcacgttcctggtgttcatgtctcatggtattcgggaaggcatttgtgggaagaaacactctgagcaagtcccagatatactacaactcaatgcaatctttaacatgttgaataccaagaactgcccaagtttgaaggacaaaccgaaggtgatcatcatccaggcctgccgtggtgacagccctggtgtggtgtggtttaaagattcagtaggagtttctggaaacctatctttaccaactacagaagagtttgaggatgatgctattaagaaagcccacatagagaaggattttatcgctttctgctcttccacaccagataatgtttcttggagacatcccacaatgggctctgtttttattggaagactcattgaacatatgcaagaatatgcctgttcctgtgatgtggaggaaattttccgcaaggtaagatgctagtggatgctattttcactctacttccctgaatgcttggctattgcaattggaagcatagaaagcagatccagacaagtttatcttccaataatgctcttctttccaaaagagttttggagttctttggagagtggacaaacccaggagcctaatccaatctattaagacccacagccttgagaaaacaatcatttagtttcaccccgctcctgccctgcagagacaaatgaatggactctaatttacctgtgtctctcatggctattagatccagcagcagatttaaaatgccctgaggagggtcattcaatgcttacatacatatatggttatacttgttgcagatggaagtactttttgtttttgtcacttattttgctatatttgttgtagttttttggcataactc

SEQ ID NO: 777 - DNA, 300 bp, Homo sapiens
atggccgacaaggtcctgaaggagaagagaaagctgtttatccgttccatgggtgaagataatgtttcttggagacatcccacaatgggctctgtttttattggaagactcattgaacatatgcaagaatatgcctgttcctgtgatgtggaggaaattttccgcaaggttcgattttcatttgagcagccagatggtagagcgcagatgcccaccactgaaagagtgactttgacaagatgtttctacctcttcccaggacattaaaataaggaaactgtatgaatgtctgtgggcagg

SEQ ID NO: 778 - DNA, 2001 bp, Homo sapiens
agtttcagtcacacaagaagggaggagagaaaagccatggccgacaaggtcctgaaggagaagagaaagctgtttatccgttccatgggtgaaggtacaataaatggcttactggatgaattattacagacaagggtgctgaacaaggaagagatggagaaagtaaaacgtgaaaatgctacagttatggataagacccgagctttgattgactccgttattccgaaaggggcacaggcatgccaaatttgcatcacatacatttgtgaagaagacagttacctggcagggacgctgggactctcagcagatcaaacatctggaaattaccttaatatgcaagactctcaaggagtactttcttcctttccagctcctcaggcagtgcaggacaacccagctatgcccacatcctcaggctcagaagggaatgtcaagctttgctccctagaagaagctcaaaggatatggaaacaaaagtcggcagagatttatccaataatggacaagtcaagccgcacacgtcttgctctcattatctgcaatgaagaatttgacagtattcctagaagaactggagctgaggttgacatcacaggcatgacaatgctgctacaaaatctggggtacagcgtagatgtgaaaaaaaatctcactgcttcggacatgactacagagctggaggcatttgcacaccgcccagagcacaagacctctgacagcacgttcctggtgttcatgtctcatggtattcgggaaggcatttgtgggaagaaacactctgagcaagtcccagatatactacaactcaatgcaatctttaacatgttgaataccaagaactgcccaagtttgaaggacaaaccgaaggtgatcatcatccaggcctgccgtggtgacagccctggtgtggtgtggtttaaagattcagtaggagtttctggaaacctatctttaccaactacagaagagtttgaggatgatgctattaagaaagcccacatagagaaggattttatcgctttctgctcttccacaccagataatgtttcttggagacatcccacaatgggctctgtttttattggaagactcattgaacatatgcaagaatatgcctgttcctgtgatgtggaggaaattttccgcaaggttcgattttcatttgagcagccagatggtagagcgcagatgcccaccactgaaagagtgactttgacaagatgtttctacctcttcccaggacattaaaataaggaaactgtatgaatgtctgtgggcaggtacatgtgtatggtcgggagtgtgggaaggttgaggaaagggtactgaaagtccatttgagtcaagaactctaggtttacaggctgagaatccttaatccaaaaatttgaattttgaaatgctctaaaatccaacactgtgtgagcgcccacatgatattcaaaggaaatgtttattgaaacatttcaaattataggtttttggattagggatgctaaaccagtaagtatacagctgaattccaatatacaaaaatatctgaaatttgaaatacttctggtagcatgcattttggataagggataatcaagccatatacagaaaatactgaagtaatgcctttcttctggtcagtgcagagcacgttgctcttctcccaaagtttttcatttagaccccttttgagattcatctgatattggcctagaagtggccgtaagactacaaaccctcacttttggatgtttctctccttcacctcagcagggtatatttaaacatagcatgtggtctttccttttaaaattgtgtatgttcccattggtggtataactttataacttgcatgtctttaaccaaattctttcctatgtttttttttttaattatttctttttctcataggaagtgaagagatccttctgtaaaggtttttggaattatgtctgctgaataataaacttttttgaaataataaatctggtagaaaaatgaaaa

SEQ ID NO: 779 - DNA, 825 bp, Homo sapiens
atggccgacaaggtcctgaaggagaagagaaagctgtttatccgttccatgggtgaagctcctcaggcagtgcaggacaacccagctatgcccacatcctcaggctcagaagggaatgtcaagctttgctccctagaagaagctcaaaggatatggaaacaaaagtcggcagagatttatccaataatggacaagtcaagccgcacacgtcttgctctcattatctgcaatgaagaatttgacagtattcctagaagaactggagctgaggttgacatcacaggcatgacaatgctgctacaaaatctggggtacagcgtagatgtgaaaaaaaatctcactgcttcggacatgactacagagctggaggcatttgcacaccgcccagagcacaagacctctgacagcacgttcctggtgttcatgtctcatggtattcgggaaggcatttgtgggaagaaacactctgagcaagtcccagatatactacaactcaatgcaatctttaacatgttgaataccaagaactgcccaagtttgaaggacaaaccgaaggtgatcatcatccaggcctgccgtggtgataatgtttcttggagacatcccacaatgggctctgtttttattggaagactcattgaacatatgcaagaatatgcctgttcctgtgatgtggaggaaattttccgcaaggttcgattttcatttgagcagccagatggtagagcgcagatgcccaccactgaaagagtgactttgacaagatgtttctacctcttcccaggacattaaaataaggaaactgtatgaatgtctgtgggcagg

SEQ ID NO: 780 - DNA, 1521 bp, Homo sapiens
ggagcttctttggaccttggagcacacagaggattctactttctttaaaactttgttttcaggcaatttccctgagaaccgtttacttccagaagattggtggagcttgatctgaaggctggccatgaaatctcaaggtcaacattggtattccagttcagataaaaactgtaaagtgagctttcgtgagaagcttctgattattgattcaaacctgggggtccaagatgtggagaacctcaagtttctctgcataggattggtccccaacaagaagctggagaagtccagctcagcctcagatgtttttgaacatctcttggcagaggatctgctgagtgaggaagaccctttcttcctggcagaactcctctatatcatacggcagaagaagctgctgcagcacctcaactgtaccaaagaggaagtggagcgactgctgcccacccgacaaagggtttctctgtttagaaacctgctctacgaactgtcagaaggcattgactcagagaacttaaaggacatgatcttccttctgaaagactcgcttcccaaaactgaaatgacctccctaagtttcctggcatttctagagaaacaaggtaaaatagatgaagataatctgacatgcctggaggacctctgcaaaacagttgtacctaaacttttgagaaacatagagaaatacaaaagagagaaagctatccagatagtgacacctcctgtagacaaggaagccgagtcgtatcaaggagaggaagaactagtttcccaaacagatgttaagacattcttggaagccttaccgcaggagtcctggcaaaataagcatgcaggtagtaatgagatcctgagtcatgtgttccagtggcttgggttcacagtgcatatacacaataatgtgacgaaagtggaaatggagatggtcctgcagaagcagaagtgcaatccagcccatgccgacggggactgcttcgtgttctgtattctgacccatgggagatttggagctgtctactcttcggatgaggccctcattcccattcgggagatcatgtctcacttcacagccctgcagtgccctagactggctgaaaaacctaaactctttttcatccaggcctgccaaggtgaagagatacagccttccgtatccatcgaagcagatgctctgaaccctgagcaggcacccacttccctgcaggacagtattcctgccgaggctgacttcctacttggtctggccactgtcccaggctatgtatcctttcggcatgtggaggaaggcagctggtatattcagtctctgtgtaatcatctgaagaaattggtcccaagacatgaagacatcttatccatcctcactgctgtcaacgatgatgtgagtcgaagagtggacaaacagggaacaaagaaacagatgccccagcctgctttcacactaaggaaaaaactagtattccctgtgcccctggatgcactttcattatagcagagagtttttgttggttcttagacctc

SEQ ID NO: 781 - DNA, 1603 bp, Homo sapiens
gcttctttggaccttggagcacacagaggattctactttctttaaaactttgttttcaggcaatttccctgagaaccgtttacttccagaagattggtggagcttgatctgaaggctggccatgaaatctcaaggtcaacattggtattccagttcagataaaaactgtaaagtgagctttcgtgagaagcttctgattattgattcaaacctgggggtccaagatgtggagaacctcaagtttctctgcataggattggtccccaacaagaagctggagaagtccagctcagcctcagatgtttttgaacatctcttggcagaggatctgctgagtgaggaagaccctttcttcctggcagaactcctctatatcatacggcagaagaagctgctgcagcacctcaactgtaccaaagaggaagtggagcgactgctgcccacccgacaaagggtttctctgtttagaaacctgctctacgaactgtcagaaggcattgactcagagaacttaaaggacatgatcttccttctgaaagactcgcttcccaaaactgaaatgacctccctaagtttcctggcatttctagagaaacaaggtaaaatagatgaagataatctgacatgcctggaggacctctgcaaaacagttgtacctaaacttttgagaaacatagagaaatacaaaagagagaaagctatccagatagtgacacctcctgtagacaaggaagccgagtcgtatcaaggagaggaagaactagtttcccaaacagatgttaagacattcttggaagccttaccgagggcagctgtgtacaggatgaatcggaaccacagaggcctctgtgtcattgtcaacaaccacagctttacctccctgaaggacagacaaggaacccataaagatgctgagatcctgagtcatgtgttccagtggcttgggttcacagtgcatatacacaataatgtgacgaaagtggaaatggagatggtcctgcagaagcagaagtgcaatccagcccatgccgacggggactgcttcgtgttctgtattctgacccatgggagatttggagctgtctactcttcggatgaggccctcattcccattcgggagatcatgtctcacttcacagccctgcagtgccctagactggctgaaaaacctaaactctttttcatccaggcctgccaaggtgaagagatacagccttccgtatccatcgaagcagatgctctgaaccctgagcaggcacccacttccctgcaggacagtattcctgccgaggctgacttcctacttggtctggccactgtcccaggctatgtatcctttcggcatgtggaggaaggcagctggtatattcagtctctgtgtaatcatctgaagaaattggtcccaaggatgctgaaatttctggaaaagacaatggaaatcaggggcaggaagagaacagtgtggggtgctaaacagatctcagcaacctccctgcccacggccatctctgcgcagacacctcgaccccccatgcgcaggtggagcagcgtttcctagttctttccagaggcttccttctgcctgccttccagccacatcgcc

SEQ ID NO: 782 - DNA, 2073 bp, Homo sapiens
tgaagattcagttttcacttaaacaaccagcaagtcttgaagtctcttcccaagcaaatgggagcttctttggaccttggagcacacagaggattctactttctttaaaactttgttttcaggcaatttccctgagaaccgtttacttccagaagattggtggagcttgatctgaaggctggccatgaaatctcaaggtcaacattggtattccagttcagataaaaactgtaaagtgagctttcgtgagaagcttctgattattgattcaaacctgggggtccaagatgtggagaacctcaagtttctctgcataggattggtccccaacaagaagctggagaagtccagctcagcctcagatgtttttgaacatctcttggcagaggatctgctgagtgaggaagaccctttcttcctggcagaactcctctatatcatacggcagaagaagctgctgcagcacctcaactgtaccaaagaggaagtggagcgactgctgcccacccgacaaagggtttctctgtttagaaacctgctctacgaactgtcagaaggcattgactcagagaacttaaaggacatgatcttccttctgaaagactcgcttcccaaaactgaaatgacctccctaagtttcctggcatttctagagaaacaaggtaaaatagatgaagataatctgacatgcctggaggacctctgcaaaacagttgtacctaaacttttgagaaacatagagaaatacaaaagagagaaagctatccagatagtgacacctcctgtagacaaggaagccgagtcgtatcaaggagaggaagaactagtttcccaaacagatgttaagacattcttggaagccttaccgcaggagtcctggcaaaataagcatgcaggtagtaatggtaacagagccacaaatggtgcaccaagcctggtctccagggggatgcaaggagcatctgctaacactctaaactctgaaaccagcacaaagagggcagctgtgtacaggatgaatcggaaccacagaggcctctgtgtcattgtcaacaaccacagctttacctccctgaaggacagacaaggaacccataaagatgctgagatcctgagtcatgtgttccagtggcttgggttcacagtgcatatacacaataatgtgacgaaagtggaaatggagatggtcctgcagaagcagaagtgcaatccagcccatgccgacggggactgcttcgtgttctgtattctgacccatgggagatttggagctgtctactcttcggatgaggccctcattcccattcgggagatcatgtctcacttcacagccctgcagtgccctagactggctgaaaaacctaaactctttttcatccaggcctgccaaggtgaagagatacagccttccgtatccatcgaagcagatgctctgaaccctgagcaggcacccacttccctgcaggacagtattcctgccgaggctgacttcctacttggtctggccactgtcccaggctatgtatcctttcggcatgtggaggaaggcagctggtatattcagtctctgtgtaatcatctgaagaaattggtcccaaggatgctgaaatttctggaaaagacaatggaaatcaggggcaggaagagaacagtgtggggtgctaaacagatctcagcaacctccctgcccacggccatctctgcgcagacacctcgaccccccatgcgcaggtggagcagcgtttcctagttctttccagaggcttccttctgcctgccttccagccacatcgcctgagattgacaacgccctacagcaagacggaaacctccctttacagcaccaccttgcgattctgcagccacaaagttgagacttctgaacgtggcactcttctgttcccttactgtttcacgtgtacctgtgtcatctttcttgtttcatcgtaaacatacttctaaaattcccattttctttatttagaaatagaactacaagcggatggttaaacaatttaaacaaatggtccatggggaaaagtgaatttcacactgtcccccaaactttcagtg

SEQ ID NO: 783 - DNA, 5928 bp, Homo sapiens
tccctttttgacttaccaaggaaatggagatccaaaggaaagcctgaagcactttgtggcttccacgggttcgtttctaggaagcttttgctttacctggggaaaccccaagctctacagtgagaaagttgtaaattagcctttaggagacgctgtttgtcaaagttatcttaaccctggaaaaggggagggaaaaaggcagataagcagtgatgacatcagcaggaaactagtatcaggctacccagtcctgaagattcagttttcacttaaacaaccagcaagtcttgaagtctcttcccaagcaaatgggagcttctttggaccttggagcacacagaggattctactttctttaaaactttgttttcaggcaatttccctgagaaccgtttacttccagaagattggtggagcttgatctgaaggctggccatgaaatctcaaggtcaacattggtattccagttcagataaaaactgtaaagtgagctttcgtgagaagcttctgattattgattcaaacctgggggtccaagatgtggagaacctcaagtttctctgcataggattggtccccaacaagaagctggagaagtccagctcagcctcagatgtttttgaacatctcttggcagaggatctgctgagtgaggaagaccctttcttcctggcagaactcctctatatcatacggcagaagaagctgctgcagcacctcaactgtaccaaagaggaagtggagcgactgctgcccacccgacaaagggtttctctgtttagaaacctgctctacgaactgtcagaaggcattgactcagagaacttaaaggacatgatcttccttctgaaagactcgcttcccaaaactgaaatgacctccctaagtttcctggcatttctagagaaacaaggtaaaatagatgaagataatctgacatgcctggaggacctctgcaaaacagttgtacctaaacttttgagaaacatagagaaatacaaaagagagaaagctatccagatagtgacacctcctgtagacaaggaagccgagtcgtatcaaggagaggaagaactagtttcccaaacagatgttaagacattcttggaagccttaccgcaggagtcctggcaaaataagcatgcaggtagtaatggtaacagagccacaaatggtgcaccaagcctggtctccagggggatgcaaggagcatctgctaacactctaaactctgaaaccagcacaaagagggcagctgtgtacaggatgaatcggaaccacagaggcctctgtgtcattgtcaacaaccacagctttacctccctgaaggacagacaaggaacccataaagatgctgagatcctgagtcatgtgttccagtggcttgggttcacagtgcatatacacaataatgtgacgaaagtggaaatggagatggtcctgcagaagcagaagtgcaatccagcccatgccgacggggactgcttcgtgttctgtattctgacccatgggagatttggagctgtctactcttcggatgaggccctcattcccattcgggagatcatgtctcacttcacagccctgcagtgccctagactggctgaaaaacctaaactctttttcatccaggcctgccaaggtgaagagatacagccttccgtatccatcgaagcagatgctctgaaccctgagcaggcacccacttccctgcaggacagtattcctgccgaggctgacttcctacttggtctggccactgtcccaggctatgtatcctttcggcatgtggaggaaggcagctggtatattcagtctctgtgtaatcatctgaagaaattggtcccaagacatgaagacatcttatccatcctcactgctgtcaacgatgatgtgagtcgaagagtggacaaacagggaacaaagaaacagatgccccagcctgctttcacactaaggaaaaaactagtattccctgtgcccctggatgcactttcattatagcagagagtttttgttggttcttagacctcaaacgaatcattggctataacctccagcctcctgcccagcacaggaatcggtggtctccacctgtcattctagaaacaggaaacaccgtgttttctgacacagtcaattctgattttctttttcttttgcaagtctaaatgttagaaaactttcttttttttggagatagtctcattctgtcacccagactggagtgcaggggggcaatcacggctcactgtagtctcgacctcccaggctcaagctgtcctcccgcctcagcttcccaagtagctgggaccacaggtgtgtaccaccgtgcccggattttttttattctttattttttgtagagatggagggatctcactttgttgcacaggctggtttcaaactcctaggcccaagtgatcctcccacctctgtccccaaaatactgggattataggcacgagccaccacacctggccagaaaactttcattattgaagacttggattgtagccttggttttggatgtctattctgaagacagagtaattggctttggtttgtgcaggtactttttctttgagacagagtcactccgtcacctgggctggagtgcagtggtgggatcactgttcactgcagccttgacctcccaggttcaagcgatcctcccacctcagcctcccaagtagctgagactacaggtgtgtgtccatgcacagctaactttttattttttttgtggagatggggtttcactatgttgcctaagctggtctcaaactcctgggctcaagcgatcctcccacctcagcttctcaaagttctgggactacaggcatgaaatactgtgcctggcctggggaccaggtgcattttaaggttccttggtgttcaaaaaccacgttcttagcctagattgagcttagattgcctctctagacaactaccccttagttataattctgtgtcccctctgcatgcccttaaacattggacagtgaggtcacagtccacccaccctctctctgatctcccccttcctaagacttctcttttgcacatctagtgaggtgaaaatttggtctatgccaggcccatttcctgcttttgtgtaaggaaggtgctcacataggaagtttttatttggttagagacaggtttccctgtaggaagatgatggctcatttacactcagctgctctgcaagcagaaactttacaacctgatgtcatattccattttggactgggtgcggtgactcatgcctgtaatcccagtactctgggaagccaaggcaggcagatcacttgaggtcaggagttcgagaccagcctggccaatacggcaaaacctcatcattactaaaaacacaaaaattagccaggtgtggcggcgagcacctgtaatcccagctactcgggaggctgagacaggagaatctcttgaatccaggaggcagaggctgtggtgagccaagatgacacaactgcactccagcttgggcaacagggcgagaccttgtttaaaaaaaaaattcaatattggggttggaacatttcagttgccattgacagaacacccaattcaaattgactgaagcaaagaagggaatttattgcctctttcacattgaaacccaggagtggataacactggcttcaggcaaagcttgaatcaggactcaatctacaggccagcacctttctcttggccggatgtcctcagggctggcagatgcagtagactgcagtggacagtccccaccttgttactgctactacactttgctcctctggcccaaggcatgaggagagaggctgtgtcagaaactgaagctgttctcaggatcactgggctcttcttggcagaggggatgtctggcttgcctgaagggagtggctctgtaaggacgccttgatgctttcttcattaagattttgagcatttttacgtacttgagcttttttttttttttttttcaatttctagaggaactttttctctgttaattcctggaactgtattttgaatccttaaaggtgagccctcatagggagatccaaagtcctgtggttaacgccttcatttatagatgaggcagctgaggcctggggatgtgaacaacctgctcacagtcctcatttactggatttgacttcagccaggtgaactggaatgccttggggcgtggaagggcattaggagtgtttcatttgatatgtgaatgctcataaaaaaatgtcaaggaatgaagaacaacaactctcagtggtgcctgcatttataattatttatgtgaaagtcaaattcatgtacagtaaatttgttataagaatattcacaagaacactgttctgatatctctgattgtcatgtggatttgaatgtagcttgacagagggaatgtctaatctatattgacagggcaggaacaccgtcatcttagacaaacaccgccactttaagttccagttccctttctagcctcatgcatttcaaggaaatcacttcttttctaacagcgagcagccagaaagagaagagagtaaaatacagataagacagctctggcatagagggaggtgggggggtgggggaagtctcttgggtaactgccaaactttgccttcatacaatgggttccaggaaaacaatgagccttaataagcacattcctttcccttcaggtgcactaagtggggaagctaaaagcagactggaggggggtggggtgtacctacagctgcagaaatattgtatgggaacggacacacaactctccctcccagataagcacagcaaagagacatagaagcaatccaagcctctgataaactctcccaccctaaatccttaaaaactcttagtctgtaagtgagtgggctctgacctaactcggccagaagcccctttcaaatttgttttctctaaaataaacctgtccttggctgtcaagccacctttcatgtttctttcctctttctttaattcttacacatgtgtcaggatgatctcccaaaaccgtgttcataacagtcagggccaaaagctagtggtcacagtccttgtccagttggcagaactgacatgtgaaggcaagtgaaggatggtgagatactgaggaaagagcaaaggatctggagatcaaagccctgcatttccattttgtcctgattcctttgctcagagacactaactaaatcaagctagcttttttcagccttgtctgtaaagtagagaaaacattagctgttgggaagacgaaaaagaatgtgtcctatgtgtgcatctatttaaatctaactgtgctgaggtgcatataaatgcctttaggtggtagggtcttccggttgtaactgcaacagaaatagcaggacttaagttcctttgtgcgtaattccagctgactttattagcggcaactcagcactagcattacccctgacatactctgagtaagatctaattcttccctcactggttcgtgatgtctaccgcagcagaaggccagctcttgactctgagttcagttggacaaaatgctgttgataaaacctcctgtcaggcctctgagcccaagctaagccatcatatcccttgtgacctgcacatatatatccagatggcctgaagtaactgaagaatcacaaaagaagtgaaaatggcctgttcctgccttaactgatgacattaccttgtgaaattccttctcctggctcatcctggctcaaaagctcccccagtgagcaccttgtgacccccatccctgccagccagagaacaaccccctttgactgtaattttccactacttacccaaatcctataaaacggccccacccctatctcccttcactgactttcttttcggactcagcccacctgcacccaggtgattaaaaagctttattgctcacacaaa

SEQ ID NO: 784 - DNA, 3926 bp, Homo sapiens
tgaagtctcttcccaagcaaatgggagcttctttggaccttggagcacacagaggattctactttctttaaaactttgttttcaggcaatttccctgagaaccgtttacttccagaagattggtggagcttgatctgaaggctggccatgaaatctcaaggtcaacattggtattccagttcagataaaaactgtaaagtgagctttcgtgagaagcttctgattattgattcaaacctgggggtccaagatgtggagaacctcaagtttctctgcataggattggtccccaacaagaagctggagaagtccagctcagcctcagatgtttttgaacatctcttggcagaggatctgctgagtgaggaagaccctttcttcctggcagaactcctctatatcatacggcagaagaagctgctgcagcacctcaactgtaccaaagaggaagtggagcgactgctgcccacccgacaaagggtttctctgtttagaaacctgctctacgaactgtcagaaggcattgactcagagaacttaaaggacatgatcttccttctgaaagactcgcttcccaaaactgaaatgacctccctaagtttcctggcatttctagagaaacaaggtaaaatagatgaagataatctgacatgcctggaggacctctgcaaaacagttgtacctaaacttttgagaaacatagagaaatacaaaagagagaaagctatccagatagtgacacctcctgtagacaaggaagccgagtcgtatcaaggagaggaagaactagtttcccaaacagatgttaagacattcttggaagccttaccgagggcagctgtgtacaggatgaatcggaaccacagaggcctctgtgtcattgtcaacaaccacagctttacctccctgaaggacagacaaggaacccataaagatgctgagatcctgagtcatgtgttccagtggcttgggttcacagtgcatatacacaataatgtgacgaaagtggaaatggagatggtcctgcagaagcagaagtgcaatccagcccatgccgacggggactgcttcgtgttctgtattctgacccatgggagatttggagctgtctactcttcggatgaggccctcattcccattcgggagatcatgtctcacttcacagccctgcagtgccctagactggctgaaaaacctaaactctttttcatccaggcctgccaaggtgaagagatacagccttccgtatccatcgaagcagatgctctgaaccctgagcaggcacccacttccctgcaggacagtattcctgccgaggctgacttcctacttggtctggccactgtcccaggctatgtatcctttcggcatgtggaggaaggcagctggtatattcagtctctgtgtaatcatctgaagaaattggtcccaagacatgaagacatcttatccatcctcactgctgtcaacgatgatgtgagtcgaagagtggacaaacagggaacaaagaaacagatgccccagcctgctttcacactaaggaaaaaactagtattccctgtgcccctggatgcactttcattatagcagagagtttttgttggttcttagacctcaaacgaatcattggctataacctccagcctcctgcccagcacaggaatcggtggtctccacctgtcattctagaaacaggaaacaccgtgttttctgacacagtcaattctgattttctttttcttttgcaagtctaaatgttagaaaactttcttttttttggagatagtctcattctgtcacccagactggagtgcaggggggcaatcacggctcactgtagtctcgacctcccaggctcaagctgtcctcccgcctcagcttcccaagtagctgggaccacaggtgtgtaccaccgtgcccggattttttttattctttattttttgtagagatggagggatctcactttgttgcacaggctggtttcaaactcctaggcccaagtgatcctcccacctctgtccccaaaatactgggattataggcacgagccaccacacctggccagaaaactttcattattgaagacttggattgtagccttggttttggatgtctattctgaagacagagtaattggctttggtttgtgcaggtactttttctttgagacagagtcactccgtcacctgggctggagtgcagtggtgggatcactgttcactgcagccttgacctcccaggttcaagcgatcctcccacctcagcctcccaagtagctgagactacaggtgtgtgtccatgcacagctaactttttattttttttgtggagatggggtttcactatgttgcctaagctggtctcaaactcctgggctcaagcgatcctcccacctcagcttctcaaagttctgggactacaggcatgaaatactgtgcctggcctggggaccaggtgcattttaaggttccttggtgttcaaaaaccacgttcttagcctagattgagcttagattgcctctctagacaactaccccttagttataattctgtgtcccctctgcatgcccttaaacattggacagtgaggtcacagtccacccaccctctctctgatctcccccttcctaagacttctcttttgcacatctagtgaggtgaaaatttggtctatgccaggcccatttcctgcttttgtgtaaggaaggtgctcacataggaagtttttatttggttagagacaggtttccctgtaggaagatgatggctcatttacactcagctgctctgcaagcagaaactttacaacctgatgtcatattccattttggactgggtgcggtgactcatgcctgtaatcccagtactctgggaagccaaggcaggcagatcacttgaggtcaggagttcgagaccagcctggccaatacggcaaaacctcatcattactaaaaacacaaaaattagccaggtgtggcggcgagcacctgtaatcccagctactcgggaggctgagacaggagaatctcttgaatccaggaggcagaggctgtggtgagccaagatgacacaactgcactccagcttgggcaacagggcgagaccttgtttaaaaaaaaaattcaatattggggttggaacatttcagttgccattgacagaacacccaattcaaattgactgaagcaaagaagggaatttattgcctctttcacattgaaacccaggagtggataacactggcttcaggcaaagcttgaatcaggactcaatctacaggccagcacctttctcttggccggatgtcctcagggctggcagatgcagtagactgcagtggacagtccccaccttgttactgctactacactttgctcctctggcccaaggcatgaggagagaggctgtgtcagaaactgaagctgttctcaggatcactgggctcttcttggcagaggggatgtctggcttgcctgaagggagtggctctgtaaggacgccttgatgctttcttcattaagattttgagcatttttacgtacttgagcttttttttttttttttttcaatttctagaggaactttttctctgttaattcctggaactgtattttgaatccttaaaggtgagccctcatagggagatccaaagtcctgtggttaacgccttcatttatagatgaggcagctgaggcctggggatgtgaacaacctgctcacagtcctcatttactggatttgacttcagccaggtgaactggaatgccttggggcgtggaagggcattaggagtgtttcatttgatatgtgaatgctcataaaaaaatgtcaaggaatgaagaacaacaactctcagtggtgcctgcatttataattatttatgtgaaagtcaaattcatgtacagtaaatttgttataagaat

SEQ ID NO: 785 - DNA, 5814 bp, Homo sapiens
aaggaaatggagatccaaaggaaagcctgaagcactttgtggcttccacgggttcgtttctaggaagcttttgctttacctggggaaaccccaagctctacagtgagaaagttgtaaattagcctttaggagacgctgtttgtcaaagttatcttaaccctggaaaaggggagggaaaaaggcagataagcagtgatgacatcagcaggaaactagtatcaggctacccagtcctgaagattcagttttcacttaaacaaccagcaagtcttgaagtctcttcccaagcaaatgggagcttctttggaccttggagcacacagaggattctactttctttaaaactttgttttcaggcaatttccctgagaaccgtttacttccagaagattggtggagcttgatctgaaggctggccatgaaatctcaaggtcaacattggtattccagttcagataaaaactgtaaagtgagctttcgtgagaagcttctgattattgattcaaacctgggggtccaagatgtggagaacctcaagtttctctgcataggattggtccccaacaagaagctggagaagtccagctcagcctcagatgtttttgaacatctcttggcagaggatctgctgagtgaggaagaccctttcttcctggcagaactcctctatatcatacggcagaagaagctgctgcagcacctcaactgtaccaaagaggaagtggagcgactgctgcccacccgacaaagggtttctctgtttagaaacctgctctacgaactgtcagaaggcattgactcagagaacttaaaggacatgatcttccttctgaaagactcgcttcccaaaactgaaatgacctccctaagtttcctggcatttctagagaaacaaggtaaaatagatgaagataatctgacatgcctggaggacctctgcaaaacagttgtacctaaacttttgagaaacatagagaaatacaaaagagagaaagctatccagatagtgacacctcctgtagacaaggaagccgagtcgtatcaaggagaggaagaactagtttcccaaacagatgttaagacattcttggaagccttaccgcaggagtcctggcaaaataagcatgcaggtagtaatgagggcagctgtgtacaggatgaatcggaaccacagaggcctctgtgtcattgtcaacaaccacagctttacctccctgaaggacagacaaggaacccataaagatgctgagatcctgagtcatgtgttccagtggcttgggttcacagtgcatatacacaataatgtgacgaaagtggaaatggagatggtcctgcagaagcagaagtgcaatccagcccatgccgacggggactgcttcgtgttctgtattctgacccatgggagatttggagctgtctactcttcggatgaggccctcattcccattcgggagatcatgtctcacttcacagccctgcagtgccctagactggctgaaaaacctaaactctttttcatccaggcctgccaaggtgaagagatacagccttccgtatccatcgaagcagatgctctgaaccctgagcaggcacccacttccctgcaggacagtattcctgccgaggctgacttcctacttggtctggccactgtcccaggctatgtatcctttcggcatgtggaggaaggcagctggtatattcagtctctgtgtaatcatctgaagaaattggtcccaagacatgaagacatcttatccatcctcactgctgtcaacgatgatgtgagtcgaagagtggacaaacagggaacaaagaaacagatgccccagcctgctttcacactaaggaaaaaactagtattccctgtgcccctggatgcactttcattatagcagagagtttttgttggttcttagacctcaaacgaatcattggctataacctccagcctcctgcccagcacaggaatcggtggtctccacctgtcattctagaaacaggaaacaccgtgttttctgacacagtcaattctgattttctttttcttttgcaagtctaaatgttagaaaactttcttttttttggagatagtctcattctgtcacccagactggagtgcaggggggcaatcacggctcactgtagtctcgacctcccaggctcaagctgtcctcccgcctcagcttcccaagtagctgggaccacaggtgtgtaccaccgtgcccggattttttttattctttattttttgtagagatggagggatctcactttgttgcacaggctggtttcaaactcctaggcccaagtgatcctcccacctctgtccccaaaatactgggattataggcacgagccaccacacctggccagaaaactttcattattgaagacttggattgtagccttggttttggatgtctattctgaagacagagtaattggctttggtttgtgcaggtactttttctttgagacagagtcactccgtcacctgggctggagtgcagtggtgggatcactgttcactgcagccttgacctcccaggttcaagcgatcctcccacctcagcctcccaagtagctgagactacaggtgtgtgtccatgcacagctaactttttattttttttgtggagatggggtttcactatgttgcctaagctggtctcaaactcctgggctcaagcgatcctcccacctcagcttctcaaagttctgggactacaggcatgaaatactgtgcctggcctggggaccaggtgcattttaaggttccttggtgttcaaaaaccacgttcttagcctagattgagcttagattgcctctctagacaactaccccttagttataattctgtgtcccctctgcatgcccttaaacattggacagtgaggtcacagtccacccaccctctctctgatctcccccttcctaagacttctcttttgcacatctagtgaggtgaaaatttggtctatgccaggcccatttcctgcttttgtgtaaggaaggtgctcacataggaagtttttatttggttagagacaggtttccctgtaggaagatgatggctcatttacactcagctgctctgcaagcagaaactttacaacctgatgtcatattccattttggactgggtgcggtgactcatgcctgtaatcccagtactctgggaagccaaggcaggcagatcacttgaggtcaggagttcgagaccagcctggccaatacggcaaaacctcatcattactaaaaacacaaaaattagccaggtgtggcggcgagcacctgtaatcccagctactcgggaggctgagacaggagaatctcttgaatccaggaggcagaggctgtggtgagccaagatgacacaactgcactccagcttgggcaacagggcgagaccttgtttaaaaaaaaaattcaatattggggttggaacatttcagttgccattgacagaacacccaattcaaattgactgaagcaaagaagggaatttattgcctctttcacattgaaacccaggagtggataacactggcttcaggcaaagcttgaatcaggactcaatctacaggccagcacctttctcttggccggatgtcctcagggctggcagatgcagtagactgcagtggacagtccccaccttgttactgctactacactttgctcctctggcccaaggcatgaggagagaggctgtgtcagaaactgaagctgttctcaggatcactgggctcttcttggcagaggggatgtctggcttgcctgaagggagtggctctgtaaggacgccttgatgctttcttcattaagattttgagcatttttacgtacttgagcttttttttttttttttttcaatttctagaggaactttttctctgttaattcctggaactgtattttgaatccttaaaggtgagccctcatagggagatccaaagtcctgtggttaacgccttcatttatagatgaggcagctgaggcctggggatgtgaacaacctgctcacagtcctcatttactggatttgacttcagccaggtgaactggaatgccttggggcgtggaagggcattaggagtgtttcatttgatatgtgaatgctcataaaaaaatgtcaaggaatgaagaacaacaactctcagtggtgcctgcatttataattatttatgtgaaagtcaaattcatgtacagtaaatttgttataagaatattcacaagaacactgttctgatatctctgattgtcatgtggatttgaatgtagcttgacagagggaatgtctaatctatattgacagggcaggaacaccgtcatcttagacaaacaccgccactttaagttccagttccctttctagcctcatgcatttcaaggaaatcacttcttttctaacagcgagcagccagaaagagaagagagtaaaatacagataagacagctctggcatagagggaggtgggggggtgggggaagtctcttgggtaactgccaaactttgccttcatacaatgggttccaggaaaacaatgagccttaataagcacattcctttcccttcaggtgcactaagtggggaagctaaaagcagactggaggggggtggggtgtacctacagctgcagaaatattgtatgggaacggacacacaactctccctcccagataagcacagcaaagagacatagaagcaatccaagcctctgataaactctcccaccctaaatccttaaaaactcttagtctgtaagtgagtgggctctgacctaactcggccagaagcccctttcaaatttgttttctctaaaataaacctgtccttggctgtcaagccacctttcatgtttctttcctctttctttaattcttacacatgtgtcaggatgatctcccaaaaccgtgttcataacagtcagggccaaaagctagtggtcacagtccttgtccagttggcagaactgacatgtgaaggcaagtgaaggatggtgagatactgaggaaagagcaaaggatctggagatcaaagccctgcatttccattttgtcctgattcctttgctcagagacactaactaaatcaagctagcttttttcagccttgtctgtaaagtagagaaaacattagctgttgggaagacgaaaaagaatgtgtcctatgtgtgcatctatttaaatctaactgtgctgaggtgcatataaatgcctttaggtggtagggtcttccggttgtaactgcaacagaaatagcaggacttaagttcctttgtgcgtaattccagctgactttattagcggcaactcagcactagcattacccctgacatactctgagtaagatctaattcttccctcactggttcgtgatgtctaccgcagcagaaggccagctcttgactctgagttcagttggacaaaatgctgttgataaaacctcctgtcaggcctctgagcccaagctaagccatcatatcccttgtgacctgcacatatatatccagatggcctgaagtaactgaagaatcacaaaagaagtgaaaatggcctgttcctgccttaactgatgacattaccttgtgaaattccttctcctggctcatcctggctcaaaagctcccccagtgagcaccttgtgacccccatccctgccagccagagaacaaccccctttgactgtaattttccactacttacccaaatcctataaaacggccccacccctatctcccttcactgactttcttttcggactcagcccacctgcacccaggtgattaaaaagctttattgctcac

SEQ ID NO: 786 - DNA, 777 bp, Homo sapiens
aggatcagacaagggtgctgagagccgggactcacaaccaaaggagaaatgagcaatccgcggtctttggaagaggagaaatatgatatgtcaggtgcccgcctggccctaatactgtgtgtcaccaaagcccgggaaggttccgaagaagacctggatgctctggaacacatgtttcggcagctgagattcgaaagcaccatgaaaagagaccccactgccgagcaattccaggaagagctggaaaaattccagcaggccatcgattcccgggaagatcccgtcagttgtgccttcgtggtactcatggctcacgggagggaaggcttcctcaagggagaagatggggagatggtcaagctggagaatctcttcgaggccctgaacaacaagaactgccaggccctgcgagctaagcccaaggtgtacatcatacaggcctgtcgaggagaacaaagggaccccggtgaaacagtaggtggagatgagattgtgatggtcatcaaagacagcccacaaaccatcccaacatacacagatgccttgcacgtttattccacggtagagggatacatcgcctaccgacatgatcagaaaggctcatgctttatccagaccctggtggatgtgttcacgaagaggaaaggacatatcttggaacttctgacagaggtgacccggcggatggcagaagcagagctggttcaagaaggaaaagcaaggaaaacgaaccctgaaatccaaagcaccctccggaaacggctgtatctgcagtag

SEQ ID NO: 787 - DNA, 941 bp, Homo sapiens
atagaccaggcttctcaggagaaaccccgggagattccacactgtcagccccttctccaagatcagtacgtgggcctgactcctcctcggtgcccagctcagtattggcaactaggagagtagtgagattgaacttggccttgaggaacagctgcctctagagttggatcagacaagggtgctgagagccgggactcacaaccaaaggagaaatgagcaatccgcggtctttggaagaggagaaatatgatatgtcaggtgcccgcctggccctaatactgtgtgtcaccaaagcccgggaaggttccgaagaagacctggatgctctggaacacatgtttcggcagctgagattcgaaagcaccatgaaaagagaccccactgccgagcaattccaggaagagctggaaaaattccagcaggccatcgattcccgggaagatcccgtcagttgtgccttcgtggtactcatggctcacgggagggaaggcttcctcaagggagaagatggggagatggtcaagctggagaatctcttcgaggccctgaacaacaagaactgccaggccctgcgagctaagcccaaggtgtacatcatacaggcctgtcgaggagaacaaagggaccccggtgaaacagtaggtggagatgagattgtgatggtcatcaaagacagcccacaaaccatcccaacatacacagatgccttgcacgtttattccacggtagagggatacatcgcctaccgacatgatcagaaaggctcatgctttatccagaccctggtggatgtgttcacgaagaggaaaggacatatcttggaacttctgacagaggtgacccggcggatggcagaagcagagctggttcaagaaggaaaagcaaggaaaacgaaccctgaaatccaaagcaccctccggaaacggctgtatctgcagtag

SEQ ID NO: 788 - DNA, 4225 bp, Homo sapiens
cttttgtctgtccgccgagcaccccacttcaccccattggaccgcgcggccgccgctagagctctgcgcctgcgcacgcaccgggccggggactgggtggcctggtgtgtgggcgcggcagggcgcaggcgcaggcgcagtgtgcgtccgcgtctgaggggagggatgtgggggaagcgacggcccccggtttgtttgggctgtgggcggtgcgcagcggagagcccgggaaaagcgggaaatggcggcgccgagcgcggggtcttggtccaccttccagcacaaggagctgatggccgctgacaggggacgcaggatattgggagtgtgtggcatgcatcctcatcatcaggaaactctaaaaaagaaccgagtggtgctagccaaacagctgttgttgagcgaattgttagaacatcttctggagaaggacatcatcaccttggaaatgagggagctcatccaggccaaagtgggcagtttcagccagaatgtggaactcctcaacttgctgcctaagaggggtccccaagcttttgatgccttctgtgaagcactgagggagaccaagcaaggccacctggaggatatgttgctcaccaccctttctgggcttcagcatgtactcccaccgttgagctgtgactacgacttgagtctcccttttccggtgtgtgagtcctgtcccctttacaagaagctccgcctgtcgacagatactgtggaacactccctagacaataaagatggtcctgtctgccttcaggtgaagccttgcactcctgaattttatcaaacacacttccagctggcatataggttgcagtctcggcctcgtggcctagcactggtgttgagcaatgtgcacttcactggagagaaagaactggaatttcgctctggaggggatgtggaccacagtactctagtcaccctcttcaagcttttgggctatgacgtccatgttctatgtgaccagactgcacaggaaatgcaagagaaactgcagaattttgcacagttacctgcacaccgagtcacggactcctgcatcgtggcactcctctcgcatggtgtggagggcgccatctatggtgtggatgggaaactgctccagctccaagaggtttttcagctctttgacaacgccaactgcccaagcctacagaacaaaccaaaaatgttcttcatccaggcctgccgtggagatgagactgatcgtggggttgaccaacaagatggaaagaaccacgcaggatcccctgggtgcgaggagagtgatgccggtaaagaaaagttgccgaagatgagactgcccacgcgctcagacatgatatgcggctatgcctgcctcaaagggactgccgccatgcggaacaccaaacgaggttcctggtacatcgaggctcttgctcaagtgttttctgagcgggcttgtgatatgcacgtggccgacatgctggttaaggtgaacgcacttatcaaggatcgggaaggttatgctcctggcacagaattccaccggtgcaaggagatgtctgaatactgcagcactctgtgccgccacctctacctgttcccaggacaccctcccacatgatgtcacctccccatcatccacgccaagtggaagccactggaccacaggaggtgtgatagagcctttgatcttcaggatgcacggtttctgttctgccccctcagggatgtgggaatctcccagacttgtttcctgtgcccatcatctctgcctttgagtgtgggactccaggccagctccttttctgtgaagccctttgcctgtagagccagccttggttggacctattgccaggaatgtttcagctgcagttgaagagcctgacaagtgaagttgtaaacacagtgtggttatggggagagggcatataaattccccatatttgtgttcagttccagcttttgtagatggcactttagtgattgcttttattacattagttaagatgtctgagagaccatctcctatcttttatttcattcatatcctccgccctttttgtcctagagtgagagtttggaaggtgtccaaatttaatgtagacattatcttttggctctgaagaagcaaacatgactagagacgcaccttgctgcagtgtccagaagcggcctgtgcgttcccttcagtactgcagcgccacccagtggaaggacactcttggctcgtttgggctcaaggcaccgcagcctgtcagccaacattgccttgcatttgtaccttattgatctttgcccatggaagtctcaaagatctttcgttggttgtttctctgagctttgttactgaaatgagcctcgtggggagcatcagagaaggccaggaagaatggtgtgtttccctagactctgtaaccacctctctgtctttttccttcctgagaaacgtccatctctctcccttactattcccactttcattcaatcaacctgcacttcatatctagatttctagaaaagcttcctagcttatctccctgcttcatatctctcccttctttaccttcatttcatcctgttggctgctgccaccaaatctgtctagaatcctgctttacaggatcatgtaaatgctcaaagatgtaatgtagttctttgttcctgctttctctttcagtattaaactctcctttgatattatgtggcttttatttcagtgccatacatgttattgttttcaacctagaaacctttatccctgcttatctgaaacttcccaacttccctgttctttaagactttttttttttttttttttttttttgagacagagtctcgctctgtcgcccaggctggagggcagtggcacgatctcagctcactgcaagctccaactcccgggttcacgccattctcctgcctcagccttccaagtagctgggactacaggtgcccgccaccgtgcccggctaatttttttgtatttttagtagagacagggtttcaccatgttagccgggatggtcttgatctcctgacctcatgatccacccacctcagcctcccaaagtgttgggattacaggcgtgagccactgcgcccgggcaagacctttttttaaaaaaaaaaaaaaaaaaacttccattctttcttcctccagtctgttctcacataacagagtagttttggtttttaattttttttggttgtttgctgttttttgttttttaaggtgagttctcactatgtttctcagactggtctcgaactcctggcctcaagccatcttcccgcctcagcctctcaaatagctgggcttacaggcatgagccaccacacctggccaggatttggttgtttaaatataaatctgatcacccccctgcttagaacccttctgctttctattacccctcatttaaaatgtaaactcttcaccttggtttatgagaactggttcttgccttccccttgaacctcattaaatggtgatttcttgctaagctccagcccgagtggtctcctctcagcttctaattttgtgctctttcctgcccttttcctgggccttctcagctctccacccccaccactcttgactcaggtggtgtccttcttcctcaagtcttgacaattcccgggcccttcagtccctgagcagtctacttctgtgtctgtcaccacatcttgtcttttcccctcattgcatttattgcagtttatatatatgctacttttacttgttcatttctgtctcccctaccaggctgtaaatgagggcagaaaccttgtttgttttattcaccatcatgtaccaagtgcttggcacatagtgggccttcattaaatgtttgttgaataaaagagggaagaaggcaagccaaccttagctacaatcctaccttttgataaaatgttccttttgacaatatacacggattattatttgtactttgtttttccatgtgttttgcttttatccactggcatttttagctccttgaagacatatcatgtgtgagataacttccttcacatctcccatggtccctagcaaaatgctaggcctgtagtagtcaaggtgctcaataaatatttgtttgggtggtttgtgagccttgctgccaagtcctgcctttgggtcgacatagtatggaagtatttgagagagagaacctttccactcccactgccaggattttgtattgccatcgggtgccaaataaatgctcatatttattactga

SEQ ID NO: 789 - DNA, 1146 bp, Homo sapiens
gggaaatggcggcgccgagcgcggggtcttggtccaccttccagcacaaggagctgatggccgctgacaggggacgcaggatattgggagtgtgtggcatgcatcctcatcatcaggaaactctaaaaaagaaccgagtggtgctagccaaacagctgttgttgagcgaattgttagaacatcttctggagaaggacatcatcaccttggaaatgagggagctcatccaggccaaagtgggcagtttcagccagaatgtggaactcctcaacttgctgcctaagaggggtccccaagcttttgatgccttctgtgaagccttgcactcctgaattttatcaaacacacttccagctggcatataggttgcagtctcggcctcgtggcctagcactggtgttgagcaatgtgcacttcactggagagaaagaactggaatttcgctctggaggggatgtggaccacagtactctagtcaccctcttcaagcttttgggctatgacgtccatgttctatgtgaccagactgcacaggaaatgcaagagaaactgcagaattttgcacagttacctgcacaccgagtcacggactcctgcatcgtggcactcctctcgcatggtgtggagggcgccatctatggtgtggatgggaaactgctccagctccaagaggtttttcagctctttgacaacgccaactgcccaagcctacagaacaaaccaaaaatgttcttcatccaggcctgccgtggagatgagactgatcgtggggttgaccaacaagatggaaagaaccacgcaggatcccctgggtgcgaggagagtgatgccggtaaagaaaagttgccgaagatgagactgcccacgcgctcagacatgatatgcggctatgcctgcctcaaagggactgccgccatgcggaacaccaaacgaggttcctggtacatcgaggctcttgctcaagtgttttctgagcgggcttgtgatatgcacgtggccgacatgctggttaaggtgaacgcacttatcaaggatcgggaaggttatgctcctggcacagaattccaccggtgcaaggagatgtctgaatactgcagcactctgtgccgccacctctacctgttcccaggacaccctcccacatga

SEQ ID NO: 790 - DNA, 1048 bp, Homo sapiens
ggaaaagcgggaaatggcggcgccgagcgcggggtcttggtccaccttccagcacaaggagctgatggccgctgacaggggacgcaggatattgggagtgtgtggcatgcatcctcatcatcaggaaactctaaaaaagaaccgagtggtgctagccaaacagctgttgttgagcgaattgttagaacatcttctggagaaggacatcatcaccttggaaatgagggagctcatccaggccaaagtgggcagtttcagccagaatgtggaactcctcaacttgctgcctaagaggggtccccaagcttttgatgccttctgtgaagcactgagggagaccaagcaaggccacctggaggatatgttgctcaccaccctttctgggcttcagcatgtactcccaccgttgagctgtgactacgacttgagtctcccttttccggtgtgtgagtcctgtcccctttacaagaagctccgcctgtcgacagatactgtggaacactccctagacaataaagatggtcctgtctgccttcaggtgaagccttgcactcctgaattttatcaaacacacttccagctggcatataggttgcagtctcggcctcgtggcctagcactggtgttgagcaatgtgcacttcactggagagaaagaactggaatttcgctctggaggggatgtggaccacagtactctagtcaccctcttcaagcttttgggctatgacgtccatgttctatgtgaccagactgcacaggaaatgcaagagaaactgcagaattttgcacagttacctgcacaccgagtcacggactcctgcatcgtggcactcctctcgcatggtgtggagggcgccatctatggtgtggatgggaaactgctccagctccaagaggtttttcagctctttgacaacgccaactgcccaagcctacagaacaaaccaaaaatgttcttcatccaggcctgccgtggagcaggtgctattggatcccttgggcacctccttctgttcactgctgccaccgcctctcttgctctgtaa

SEQ ID NO: 791 - DNA, 1338 bp, Homo sapiens
cagaagcctttgtgatctcacctgttggaatgcactaatgttttctgagccccttaaatatcttgtctacattcttttaagaagctcttcaccaactgtcagaaggcaaccacagaaaaaagccacttaaggtgttggaatccctgggcaaagatttcctcactggtgttttggataacttggtggaacaaaatgtactgaactggaaggaagaggaaaaaaagaaatattacgatgctaaaactgaagacaaagttcgggtcatggcagactctatgcaagagaagcaacgtatggcaggacaaatgcttcttcaaaccttttaacatagaccaaatatcccccaataaaaaagctcatccgaatatggaggctggaccacctgagtcaggagaatctacagatgccctcaagctttgtcctcatgaagaattcctgagactatgtaaagaaagagctgaagagatctatccaataaaggagagaaacaaccgcacacgcctggctctcatcatatgcaatacagagtttgaccatctgcctccgaggaatggagctgactttgacatcacagggatgaaggagctacttgagggtctggactatagtgtagatgtagaagagaatctgacagccagggatatggagtcagcgctgagggcatttgctaccagaccagagcacaagtcctctgacagcacattcttggtactcatgtctcatggcatcctggagggaatctgcggaactgtgcatgatgagaaaaaaccagatgtgctgctttatgacaccatcttccagatattcaacaaccgcaactgcctcagtctgaaggacaaacccaaggtcatcattgtccaggcctgcagaggtgcaaaccgtggggaactgtgggtcagagactctccagcatccttggaagtggcctcttcacagtcatctgagaacctagaggaagatgctgtttacaagacccacgtggagaaggacttcattgctttctgctcttcaacgccacacaacgtgtcctggagagacagcacaatgggctctatcttcatcacacaactcatcacatgcttccagaaatattcttggtgctgccacctagaggaagtatttcggaaggtacagcaatcatttgaaactccaagggccaaagctcaaatgcccaccatagaacgactgtccatgacaagatatttctacctctttcctggcaattgaaaatggaagccacaagcagcccagccctccttaatcaacttcaaggagcaccttcattagtacagcttgcatatttaacattttgtatttcaataaaagtgaagacaaacg

SEQ ID NO: 792 - DNA, 763 bp, Homo sapiens
ggagggatggatcccggtcccacctaaagaagcagtctggccatgatctgccacagcggctgtgctgcactgtgaagactgctgcccagtccaatctgcccagcctccctagcactgtcagaaactaaattccagtaattggatgccaatttgctgatgacaaggcacttcctgataatgagtctggaattctgagcagcagtttcacaatctgtaattacacgtttccgccctttgcaataaggaaatacatagtttactttcatttttgactctgaggctctttccaacgctgtaaaaaaggacagaggctgttccctatggcagaaggcaaccacagaaaaaagccacttaaggtgttggaatccctgggcaaagatttcctcactggtgttttggataacttggtggaacaaaatgtactgaactggaaggaagaggaaaaaaagaaatattacgatgctaaaactgaagacaaagttcgggtcatggcagactctatgcaagagaagcaacgtatggcaggacaaatgcttcttcaaaccttttttaacatagaccaaatatcccccaataaaaaagctcatccgaatatggaggctggaccacctgagtcaggagaatctacagatgccctcaagctttgtcctcatgaagaattcctgagactatgtaaagaaagagctgaagagatctatccaataaaggagagaaacaaccgcacacgcctggctctcatcatatgcaatacagagtttgacca

SEQ ID NO: 793 - DNA, 2158 bp, Homo sapiens
aaatgagagctctgtctgtaaactctaggtggagttgctgaaattcctgcaagcatttcttgccgggagaggagggatggatcccggtcccacctaaagaagcagtctggccatgatctgccacagcggctgtgctgcactgtgaagactgctgcccagtccaatctgcccagcctccctagcactggtagggaaaaaccgctgactagagctgcagtaatggcagtcgcccctcccctggggaactcggtcatctctggcgtactccaggctgctatgctggctagtggggattctaatccagcggatctaagcttgcaggcttctgtgagaatggacctgctgcaaggccattttgctccctggcttcagccccctttccatgggagtggacgggactcctgcctcactagagttccgggagctgctggactatgtaaaaactcctgcagctcagtgcctgcccaaaaagctggaaatatgaactattgggttaattcttatcaggaaatgaaaaagagttgttagattaaacttcttcagtcattgtcgttctttgtaatcagagaaagaaaaactgagagatcaggaagagaagagacagatggatagaagaagtttgggtggccacaggaaacaagaaaagaaacaagctgaggtgtcaacccacaggataatattttgtcattttcatttttttcccccaagtcagaaactaaattccagtaattggatgccaatttgctgatgacaaggcacttcctgataatgagtctggaattctgagcagcagtttcacaatctgtaattacacgtttccgccctttgcaataaggaaatacatagtttactttcatttttgactctgaggctctttccaacgctgtaaaaaaggacagaggctgttccctatggcagaaggcaaccacagaaaaaagccacttaaggtgttggaatccctgggcaaagatttcctcactggtgttttggataacttggtggaacaaaatgtactgaactggaaggaagaggaaaaaaagaaatattacgatgctaaaactgaagacaaagttcgggtcatggcagactctatgcaagagaagcaacgtatggcaggacaaatgcttcttcaaaccttttttaacatagaccaaatatcccccaataaaaaagctcatccgaatatggaggctggaccacctgagtcaggagaatctacagatgccctcaagctttgtcctcatgaagaattcctgagactatgtaaagaaagagctgaagagatctatccaataaaggagagaaacaaccgcacacgcctggctctcatcatatgcaatacagagtttgaccatctgcctccgaggaatggagctgactttgacatcacagggatgaaggagctacttgagggtctggactatagtgtagatgtagaagagaatctgacagccagggatatggagtcagcgctgagggcatttgctaccagaccagagcacaagtcctctgacagcacattcttggtactcatgtctcatggcatcctggagggaatctgcggaactgtgcatgatgagaaaaaaccagatgtgctgctttatgacaccatcttccagatattcaacaaccgcaactgcctcagtctgaaggacaaacccaaggtcatcattgtccaggcctgcagaggtgcaaaccgtggggaactgtgggtcagagactctccagcatccttggaagtggcctcttcacagtcatctgagaacctagaggaagatgctgtttacaagacccacgtggagaaggacttcattgctttctgctcttcaacgccacacaacgtgtcctggagagacagcacaatgggctctatcttcatcacacaactcatcacatgcttccagaaatattcttggtgctgccacctagaggaagtatttcggaaggtacagcaatcatttgaaactccaagggccaaagctcaaatgcccaccatagaacgactgtccatgacaagatatttctacctctttcctggcaattgaaaatggaagccacaagcagcccagccctccttaatcaacttcaaggagcaccttcattagtacagcttgcatatttaacattttgtatttcaataaaagtgaagacaaacgaa

SEQ ID NO: 794 - DNA, 1414 bp, Homo sapiens
atggctgaagacagtggcaaaaaaaaaaggcgtaagaattttgaagctatgttcaaaggtatccttcagagtggattggataacttcgtgataaaccacatgctaaagaacaacgtggctggacaaacatctatccagaccctagtacctaatacggatcaaaagtcgaccagtgtaaaaaaagacaaccacaaaaaaaaaacagttaagatgttggaatacctgggcaaagatgttcttcatggtgtttttaattatttggcaaaacacgatgttctgacattgaaggaagaggaaaagaaaaaatattatgataccaaaattgaagacaaggccctgatcttggtagactctttgcgaaagaatcgcgtggctcatcaaatgtttacccaaacacttctcaatatggaccaaaagatcaccagtgtaaaacctcttctgcaaatcgaggctggaccacctgagtcagcagaatctacaaatatactcaaactttgtcctcgtgaagaattcctgagactgtgtaaaaaaaatcatgatgagatctatccaataaaaaagagagaggaccgcagacgcctggctctcatcatatgcaatacaaagtttgatcacctgcctgcaaggaatggggctcactatgacatcgtggggatgaaaaggctgcttcaaggcctgggctacactgtggttgacgaaaagaatctcacagccagggatatggagtcagtgctgagggcatttgctgccagaccagagcacaagtcctctgacagcacgttcttggtactcatgtctcatggcatcctagagggaatctgcggaactgcgcataaaaagaaaaaaccggatgtgctgctttatgacaccatcttccagatattcaacaaccgcaactgcctcagtctaaaggacaaacccaaggtcatcattgtccaggcctgcagaggtgaaaaacatggggaactctgggtcagagactctccagcatccttggcactcatctcttcacagtcatctgagaacctggaggcagattctgtttgcaagatccacgaggagaaggacttcattgctttctgttcttcaacaccacataacgtgtcctggagagaccgcacaaggggctccatcttcattacggaactcatcacatgcttccagaaatattcttgctgctgccacctaatggaaatatttcggaaggtacagaaatcatttgaagttccacaggctaaagcccagatgcccaccatagaacgagcaaccttgacaagagatttctacctctttcctggcaattgaaaatgaaaccacaggcagcccagccctcctctgtcaacatcaaagagcacatttaccagtatagcttgcatagtcaatatttggtatttcaataaaagtaaagactgta

SEQ ID NO: 795 - DNA, 1378 bp, Homo sapiens
agtgctgtacaaagagacagaggctgttagctatggctgctgtgcccagagttgaaggagtctttatatttctgatagaagacagtggcaaaaaaaaaaggcgtaagaattttgaagctatgttcaaaggtatccttcagagtggattggataacttcgtgataaaccacatgctaaagaacaacgtggctggacaaacatctatccagaccctagtacctaatacggatcaaaagtcgaccagtgtaaaaaaagacaaccacaaaaaaaaaacagttaagatgttggaatacctgggcaaagatgttcttcatggtgtttttaattatttggcaaaacacgatgttctgacattgaaggaagaggaaaagaaaaaatattatgataccaaaattgaagacaaggccctgatcttggtagactctttgcgaaagaatcgcgtggctcatcaaatgtttacccaaacacttctcaatatggaccaaaagatcaccagtgtaaaacatctatccaataaaaaagagagaggaccgcagacgcctggctctcatcatatgcaatacaaagtttgatcacctgcctgcaaggaatggggctcactatgacatcgtggggatgaaaaggctgcttcaaggcctgggctacactgtggttgacgaaaagaatctcacagccagggatatggagtcagtgctgagggcatttgctgccagaccagagcacaagtcctctgacagcacgttcttggtactcatgtctcatggcatcctagagggaatctgcggaactgcgcataaaaagaaaaaaccggatgtgctgctttatgacaccatcttccagatattcaacaaccgcaactgcctcagtctaaaggacaaacccaaggtcatcattgtccaggcctgcagaggtgaaaaacatggggaactctgggtcagagactctccagcatccttggcactcatctcttcacagtcatctgagaacctggaggcagattctgtttgcaagatccacgaggagaaggacttcattgctttctgttcttcaacaccacataacgtgtcctggagagaccgcacaaggggctccatcttcattacggaactcatcacatgcttccagaaatattcttgctgctgccacctaatggaaatatttcggaaggtacagaaatcatttgaagttccacaggctaaagcccagatgcccaccatagaacgagcaaccttgacaagagatttctacctctttcctggcaattgaaaatgaaaccacaggcagcccagccctcctctgtcaacatcaaagagcacatttaccagtatagcttgcatagtcaatatttggtatttcaataaaagtaaagactgtatct

SEQ ID NO: 796 - DNA, 1488 bp, Homo sapiens
agtgctgtacaaagagacagaggctgttagctatggctgctgtgcccagagttgaaggagtctttatatttctgatagaagacagtggcaaaaaaaaaaggcgtaagaattttgaagctatgttcaaaggtatccttcagagtggattggataacttcgtgataaaccacatgctaaagaacaacgtggctggacaaacatctatccagaccctagtacctaatacggatcaaaagtcgaccagtgtaaaaaaagacaaccacaaaaaaaaaacagttaagatgttggaatacctgggcaaagatgttcttcatggtgtttttaattatttggcaaaacacgatgttctgacattgaaggaagaggaaaagaaaaaatattatgataccaaaattgaagacaaggccctgatcttggtagactctttgcgaaagaatcgcgtggctcatcaaatgtttacccaaacacttctcaatatggaccaaaagatcaccagtgtaaaacctcttctgcaaatcgaggctggaccacctgagtcagcagaatctacaaatatactcaaactttgtcctcgtgaagaattcctgagactgtgtaaaaaaaatcatgatgagatctatccaataaaaaagagagaggaccgcagacgcctggctctcatcatatgcaatacaaagtttgatcacctgcctgcaaggaatggggctcactatgacatcgtggggatgaaaaggctgcttcaaggcctgggctacactgtggttgacgaaaagaatctcacagccagggatatggagtcagtgctgagggcatttgctgccagaccagagcacaagtcctctgacagcacgttcttggtactcatgtctcatggcatcctagagggaatctgcggaactgcgcataaaaagaaaaaaccggatgtgctgctttatgacaccatcttccagatattcaacaaccgcaactgcctcagtctaaaggacaaacccaaggtcatcattgtccaggcctgcagaggtgaaaaacatggggaactctgggtcagagactctccagcatccttggcactcatctcttcacagtcatctgagaacctggaggcagattctgtttgcaagatccacgaggagaaggacttcattgctttctgttcttcaacaccacataacgtgtcctggagagaccgcacaaggggctccatcttcattacggaactcatcacatgcttccagaaatattcttgctgctgccacctaatggaaatatttcggaaggtacagaaatcatttgaagttccacaggctaaagcccagatgcccaccatagaacgagcaaccttgacaagagatttctacctctttcctggcaattgaaaatgaaaccacaggcagcccagccctcctctgtcaacatcaaagagcacatttaccagtatagcttgcatagtcaatatttggtatttcaataaaagtaaagactgtatct

SEQ ID NO: 797 - DNA, 1023 bp, Homo sapiens
agtgctgtacaaagagacagaggctgttagctatggctgctcttctgcaaatcgaggctggaccacctgagtcagcagaatctacaaatatactcaaactttgtcctcgtgaagaattcctgagactgtgtaaaaaaaatcatgatgagatctatccaataaaaaagagagaggaccgcagacgcctggctctcatcatatgcaatacaaagtttgatcacctgcctgcaaggaatggggctcactatgacatcgtggggatgaaaaggctgcttcaaggcctgggctacactgtggttgacgaaaagaatctcacagccagggatatggagtcagtgctgagggcatttgctgccagaccagagcacaagtcctctgacagcacgttcttggtactcatgtctcatggcatcctagagggaatctgcggaactgcgcataaaaagaaaaaaccggatgtgctgctttatgacaccatcttccagatattcaacaaccgcaactgcctcagtctaaaggacaaacccaaggtcatcattgtccaggcctgcagaggtgaaaaacatggggaactctgggtcagagactctccagcatccttggcactcatctcttcacagtcatctgagaacctggaggcagattctgtttgcaagatccacgaggagaaggacttcattgctttctgttcttcaacaccacataacgtgtcctggagagaccgcacaaggggctccatcttcattacggaactcatcacatgcttccagaaatattcttgctgctgccacctaatggaaatatttcggaaggtacagaaatcatttgaagttccacaggctaaagcccagatgcccaccatagaacgagcaaccttgacaagagatttctacctctttcctggcaattgaaaatgaaaccacaggcagcccagccctcctctgtcaacatcaaagagcacatttaccagtatagcttgcatagtcaatatttggtatttcaataaaagtaaagactgtatct

SEQ ID NO: 798 - DNA, 1237 bp, Homo sapiens
gtgctgtacaaagagacagaggctgttagctatggctgaagacaaccacaaaaaaaaaacagttaagatgttggaatacctgggcaaagatgttcttcatggtgtttttaattatttggcaaaacacgatgttctgacattgaaggaagaggaaaagaaaaaatattatgataccaaaattgaagacaaggccctgatcttggtagactctttgcgaaagaatcgcgtggctcatcaaatgtttacccaaacacttctcaatatggaccaaaagatcaccagtgtaaaacctcttctgcaaatcgaggctggaccacctgagtcagcagaatctacaaatatactcaaactttgtcctcgtgaagaattcctgagactgtgtaaaaaaaatcatgatgagatctatccaataaaaaagagagaggaccgcagacgcctggctctcatcatatgcaatacaaagtttgatcacctgcctgcaaggaatggggctcactatgacatcgtggggatgaaaaggctgcttcaaggcctgggctacactgtggttgacgaaaagaatctcacagccagggatatggagtcagtgctgagggcatttgctgccagaccagagcacaagtcctctgacagcacgttcttggtactcatgtctcatggcatcctagagggaatctgcggaactgcgcataaaaagaaaaaaccggatgtgctgctttatgacaccatcttccagatattcaacaaccgcaactgcctcagtctaaaggacaaacccaaggtcatcattgtccaggcctgcagaggtgaaaaacatggggaactctgggtcagagactctccagcatccttggcactcatctcttcacagtcatctgagaacctggaggcagattctgtttgcaagatccacgaggagaaggacttcattgctttctgttcttcaacaccacataacgtgtcctggagagaccgcacaaggggctccatcttcattacggaactcatcacatgcttccagaaatattcttgctgctgccacctaatggaaatatttcggaaggtacagaaatcatttgaagttccacaggctaaagcccagatgcccaccatagaacgagcaaccttgacaagagatttctacctctttcctggcaattgaaaatgaaaccacaggcagcccagccctcctctgtcaacatcaaagagcacatttaccagtatagcttgcatagtc

SEQ ID NO: 799 - DNA, 1344 bp, Homo sapiens
atggctgctgtgcccagagttgaaggagtctttatatttctgatagaagacagtggcaaaaaaaaaaggcgtaagaattttgaagctatgttcaaaggtatccttcagagtggattggataacttcgtgataaaccacatgctaaagaacaacgtggctggacaaacatctatccagaccctagtacctaatacggatcaaaagtcgaccagtgtaaaaaaagacaaccacaaaaaaaaaacagttaagatgttggaatacctgggcaaagatgttcttcatggtgtttttaattatttggcaaaacacgatgttctgacattgaaggaagaggaaaagaaaaaatattatgataccaaaattgaagacaaggccctgatcttggtagactctttgcgaaagaatcgcgtggctcatcaaatgtttacccaaacacttctcaatatggaccaaaagatcaccagtgtaaaacctcttctgcaaatcgaggctggaccacctgagtcagcagaatctacaaatatactcaaactttgtcctcgtgaagaattcctgagactgtgtaaaaaaaatcatgatgagatctatccaataaaaaagagagaggaccgcagacgcctggctctcatcatatgcaatacaaagtttgatcacctgcctgcaaggaatggggctcactatgacatcgtggggatgaaaaggctgcttcaaggcctgggctacactgtggttgacgaaaagaatctcacagccagggatatggagtcagtgctgagggcatttgctgccagaccagagcacaagtcctctgacagcacgttcttggtactcatgtctcatggcatcctagagggaatctgcggaactgcgcataaaaagaaaaaaccggatgtgctgctttatgacaccatcttccagatattcaacaaccgcaactgcctcagtctaaaggacaaacccaaggtcatcattgtccaggcctgcagaggtgaaaaacatggggaactctgggtcagagactctccagcatccttggcactcatctcttcacagtcatctgagaacctggaggcagattctgtttgcaagatccacgaggagaaggacttcattgctttctgttcttcaacaccacataacgtgtcctggagagaccgcacaaggggctccatcttcattacggaactcatcacatgcttccagaaatattcttgctgctgccacctaatggaaatatttcggaaggtacagaaatcatttgaagttccacaggctaaagcccagatgcccaccatagaacgagcaaccttgacaagagatttctacctctttcctggcaattga

SEQ ID NO: 800 - DNA, 879 bp, Homo sapiens
atggctgctcttctgcaaatcgaggctggaccacctgagtcagcagaatctacaaatatactcaaactttgtcctcgtgaagaattcctgagactgtgtaaaaaaaatcatgatgagatctatccaataaaaaagagagaggaccgcagacgcctggctctcatcatatgcaatacaaagtttgatcacctgcctgcaaggaatggggctcactatgacatcgtggggatgaaaaggctgcttcaaggcctgggctacactgtggttgacgaaaagaatctcacagccagggatatggagtcagtgctgagggcatttgctgccagaccagagcacaagtcctctgacagcacgttcttggtactcatgtctcatggcatcctagagggaatctgcggaactgcgcataaaaagaaaaaaccggatgtgctgctttatgacaccatcttccagatattcaacaaccgcaactgcctcagtctaaaggacaaacccaaggtcatcattgtccaggcctgcagaggtgaaaaacatggggaactctgggtcagagactctccagcatccttggcactcatctcttcacagtcatctgagaacctggaggcagattctgtttgcaagatccacgaggagaaggacttcattgctttctgttcttcaacaccacataacgtgtcctggagagaccgcacaaggggctccatcttcattacggaactcatcacatgcttccagaaatattcttgctgctgccacctaatggaaatatttcggaaggtacagaaatcatttgaagttccacaggctaaagcccagatgcccaccatagaacgagcaaccttgacaagagatttctacctctttcctggcaattga

SEQ ID NO: 801 - DNA, 1548 bp, Homo sapiens
ccgagggcggggccgggcccgggagcctgtggcttcaggaagaggagggcaaggtgtctggctgcgcgtttggctgcaatgagctcggcctcggggctccgcagggggcacccggcaggtggggaagaaaacatgacagaaacagatgccttctataaaagagaaatgtttgatccggcagaaaagtacaaaatggaccacaggaggagaggaattgctttaatcttcaatcatgagaggttcttttggcacttaacactgccagaaaggcggggcacctgcgcagatagagacaatcttacccgcaggttttcagatctaggatttgaagtgaaatgctttaatgatcttaaagcagaagaactactgctcaaaattcatgaggtgtcaactgttagccacgcagatgccgattgctttgtgtgtgtcttcctgagccatggcgaaggcaatcacatttatgcatatgatgctaaaatcgaaattcagacattaactggcttgttcaaaggagacaagtgtcacagcctggttggaaaacccaagatatttatcattcaggcatgtcggggaaaccagcacgatgtgccagtcattcctttggatgtagtagataatcagacagagaagttggacaccaacataactgaggtggatgcagcctccgtttacacgctgcctgctggagctgacttcctcatgtgttactctgttgcagaaggatattattctcaccgggaaactgtgaacggctcatggtacattcaagatttgtgtgagatgttgggaaaatatggctcctccttagagttcacagaactcctcacactggtgaacaggaaagtttctcagcgccgagtggacttttgcaaagacccaagtgcaattggaaagaagcaggttccctgttttgcctcaatgctaactaaaaagctgcatttctttccaaaatctaattaattaatagaggctatctaattttacactctgtattgaaaatggctttctcagccaggcgtggttactcacacctgtaatcccagcactttgggagtccaaggtgggcggatcacctgaggtcgggagttcgagaccagcctgaccaacatggagaagccccgtctctactaaaaatgcaaaaaaaaatttagctaggcatggcggcgcatgcctgcaatcccagctacttggaaggctgaggcaggagaatcacttgaacccaggaggtggaggctgcggtgagccgagattgcgccattgcactccagcctgggcaacgagtgaaactccgtctcaaaaaaaagaaaatgtctttctcttccttttatataaatatcgttagggtgaagcattatggtctaatgattcaaatgttttaaagtttaatgcctagcagagaactgccttaaaaaaaaaaaaaaaaagttcatgttggccatggtgaaagggtttgatatggagaaacaaaatcctcaggaaattagataaataaaaatttataagcatttgtattattttttaataaactgcagggttacacaaaaatct

SEQ ID NO: 802 - DNA, 1340 bp, Homo sapiens
tgtctggctgcgcgtttggctgcaatgagctcggcctcggggctccgcagggggcacccggcagtgtcaactgttagccacgcagatgccgattgctttgtgtgtgtcttcctgagccatggcgaaggcaatcacatttatgcatatgatgctaaaatcgaaattcagacattaactggcttgttcaaaggagacaagtgtcacagcctggttggaaaacccaagatatttatcattcaggcatgtcggggaaaccagcacgatgtgccagtcattcctttggatgtagtagataatcagacagagaagttggacaccaacataactgaggtggatgcagcctccgtttacacgctgcctgctggagctgacttcctcatgtgttactctgttgcagaaggatattattctcaccgggaaactgtgaacggctcatggtacattcaagatttgtgtgagatgttgggaaaatatggctcctccttagagttcacagaactcctcacactggtgaacaggaaagtttctcagcgccgagtggacttttgcaaagacccaagtgcaattggaaagaagcaggttccctgttttgcctcaatgctaactaaaaagctgcatttctttccaaaatctaattaattaatagaggctatctaattttacactctgtattgaaaatggctttctcagccaggcgtggttactcacacctgtaatcccagcactttgggagtccaaggtgggcggatcacctgaggtcgggagttcgagaccagcctgaccaacatggagaagccccgtctctactaaaaatgcaaaaaaaaatttagctaggcatggcggcgcatgcctgcaatcccagctacttggaaggctgaggcaggagaatcacttgaacccaggaggtggaggctgcggtgagccgagattgcgccattgcactccagcctgggcaacgagtgaaactccgtctcaaaaaaaagaaaatgtctttctcttccttttatataaatatcgttagggtgaagcattatggtctaatgattcaaatgttttaaagtttaatgcctagcagagaactgccttaaaaaaaaaaaaaaaaagttcatgttggccatggtgaaagggtttgatatggagaaacaaaatcctcaggaaattagataaataaaaatttataagcatttgtattattttttaataaactgcagggttacacaaaaatctagctgatttaacttgtattttgtcacttttttataaaagtttattgtttgatgtttttaaaggtttttgaaatccaggaattaaatcatcccttaataaaatattcgaaattc

SEQ ID NO: 803 - DNA, 2659 bp, Homo sapiens
cccgcgcgcgggctcaactttgtagagcgaggggccaacttggcagagcgcgcggccagctttgcagagagcgccctccagggactatgcgtgcggggacacgggtcgctttgggctcttccacccctgcggagcgcactaccccgagccaggggcggtgcaagccccgcccggccctacccagggcggctcctccctccgcagcgccgagacttttagtttcgctttcgctaaaggggccccagacccttgctgcggagcgacggagagagactgtgccagtcccagccgccctaccgccgtgggaacggcaggaagtggcacttggaaaagaacaccagctgcggtggtagcagtgggatttgtgcttcttatgttacccagatggcagatgatcagggctgtattgaagagcagggggttgaggattcagcaaatgaagattcagtggatgctaagccagaccggtcctcgtttgtaccgtccctcttcagtaagaagaagaaaaatgtcaccatgcgatccatcaagaccacccgggaccgagtgcctacatatcagtacaacatgaattttgaaaagctgggcaaatgcatcataataaacaacaagaactttgataaagtgacaggtatgggcgttcgaaacggaacagacaaagatgccgaggcgctcttcaagtgcttccgaagcctgggttttgacgtgattgtctataatgactgctcttgtgccaagatgcaagatctgcttaaaaaagcttctgaagaggaccatacaaatgccgcctgcttcgcctgcatcctcttaagccatggagaagaaaatgtaatttatgggaaagatggtgtcacaccaataaaggatttgacagcccactttaggggggatagatgcaaaacccttttagagaaacccaaactcttcttcattcaggcttgccgagggaccgagcttgatgatggcatccaggccgactcggggcccatcaatgacacagatgctaatcctcgatacaagatcccagtggaagctgacttcctcttcgcctattccacggttccaggctattactcgtggaggagcccaggaagaggctcctggtttgtgcaagccctctgctccatcctggaggagcacggaaaagacctggaaatcatgcagatcctcaccagggtgaatgacagagttgccaggcactttgagtctcagtctgatgacccacacttccatgagaagaagcagatcccctgtgtggtctccatgctcaccaaggaactctacttcagtcaatagccatatcaggggtacattctagctgagaagcaatgggtcactcattaatgaatcacatttttttatgctcttgaaatattcagaaattctccaggattttaatttcaggaaaatgtattgattcaacagggaagaaactttctggtgctgtcttttgttctctgaattttcagagactttttttataatgttattcatttggtgactgtgtaactttctcttaagattaattttctctttgtatgtctgttaccttgttaatagacttaatacatgcaacagaagtgacttctggagaaagctcatggctgtgtccactgcaattggtggtaacagtggtagagtcatgtttgcacttggcaaaaagaatcccaatgtttgacaaaacacagccaaggggatatttactgctctttattgcagaatgtgggtattgagtgtgatttgaatgatttttcattggcttagggcagattttcatgcaaaagttctcatatgagttagaggagaaaaagcttaatgattctgatatgtatccatcaggatccagtctggaaaacagaaaccattctaggtgtttcaacagagggagtttaatacaggaaattgacttacatagatgataaaagagaagccaaacagcaagaagctgttaccacacccagggctatgaggataatgggaagaggtttggtttcctgtgtccagtagtgggatcatccagaggagctggaaccatggtgggggctgcctagtgggagttaggaccaccaatggattgtggaaaatggagccatgacaagaacaaagccactgactgagatggagtgagctgagacagataagagaataccttggtctcacctatcctgccctcacatcttccaccagcaccttactgcccaggcctatctggaagccacctcaccaaggaccttggaagagcaagggacagtgaggcaggagaagaacaagaaatggatgtaagcctggcccataatgtgaacataagtaatcactaatgctcaacaatttatccattcaatcatttattcattgggttgtcagatagtctatgtatgtgtaaaacaatctgttttggctttatgtgcaaaatctgttatagctttaaaatatatctggaactttttagattattccaagccttattttgagtaaatatttgttacttttagttctataagtgaggaagagtttatggcaaagatttttggcactttgttttcaagatggtgttatcttttgaattcttgataaatgactgtttttttctgcctaatagtaactggttaaaaaacaaatgttcatatttattgattaaaaatgtggttgcttaattcct

SEQ ID NO: 804 - DNA, 2421 bp, Homo sapiens
gactgtgccagtcccagccgccctaccgccgtgggaacgatgctgtaatggactgtgttggttggcctccaggcaggaagtggcacttggaaaagaacaccagctgcggtggtagcagtgggatttgtgcttcttatgttacccagatggcagatgatcagggctgtattgaagagcagggggttgaggattcagcaaatgaagattcagtggatgctaagccagaccggtcctcgtttgtaccgtccctcttcagtaagaagaagaaaaatgtcaccatgcgatccatcaagaccacccgggaccgagtgcctacatatcagtacaacatgaattttgaaaagctgggcaaatgcatcataataaacaacaagaactttgataaagtgacaggtatgggcgttcgaaacggaacagacaaagatgccgaggcgctcttcaagtgcttccgaagcctgggttttgacgtgattgtctataatgactgctcttgtgccaagatgcaagatctgcttaaaaaagcttctgaagaggaccatacaaatgccgcctgcttcgcctgcatcctcttaagccatggagaagaaaatgtaatttatgggaaagatggtgtcacaccaataaaggatttgacagcccactttaggggggatagatgcaaaacccttttagagaaacccaaactcttcttcattcaggcttgccgagggaccgagcttgatgatggcatccaggccgactcggggcccatcaatgacacagatgctaatcctcgatacaagatcccagtggaagctgacttcctcttcgcctattccacggttccaggctattactcgtggaggagcccaggaagaggctcctggtttgtgcaagccctctgctccatcctggaggagcacggaaaagacctggaaatcatgcagatcctcaccagggtgaatgacagagttgccaggcactttgagtctcagtctgatgacccacacttccatgagaagaagcagatcccctgtgtggtctccatgctcaccaaggaactctacttcagtcaatagccatatcaggggtacattctagctgagaagcaatgggtcactcattaatgaatcacatttttttatgctcttgaaatattcagaaattctccaggattttaatttcaggaaaatgtattgattcaacagggaagaaactttctggtgctgtcttttgttctctgaattttcagagactttttttataatgttattcatttggtgactgtgtaactttctcttaagattaattttctctttgtatgtctgttaccttgttaatagacttaatacatgcaacagaagtgacttctggagaaagctcatggctgtgtccactgcaattggtggtaacagtggtagagtcatgtttgcacttggcaaaaagaatcccaatgtttgacaaaacacagccaaggggatatttactgctctttattgcagaatgtgggtattgagtgtgatttgaatgatttttcattggcttagggcagattttcatgcaaaagttctcatatgagttagaggagaaaaagcttaatgattctgatatgtatccatcaggatccagtctggaaaacagaaaccattctaggtgtttcaacagagggagtttaatacaggaaattgacttacatagatgataaaagagaagccaaacagcaagaagctgttaccacacccagggctatgaggataatgggaagaggtttggtttcctgtgtccagtagtgggatcatccagaggagctggaaccatggtgggggctgcctagtgggagttaggaccaccaatggattgtggaaaatggagccatgacaagaacaaagccactgactgagatggagtgagctgagacagataagagaataccttggtctcacctatcctgccctcacatcttccaccagcaccttactgcccaggcctatctggaagccacctcaccaaggaccttggaagagcaagggacagtgaggcaggagaagaacaagaaatggatgtaagcctggcccataatgtgaacataagtaatcactaatgctcaacaatttatccattcaatcatttattcattgggttgtcagatagtctatgtatgtgtaaaacaatctgttttggctttatgtgcaaaatctgttatagctttaaaatatatctggaactttttagattattccaagccttattttgagtaaatatttgttacttttagttctataagtgaggaagagtttatggcaaagatttttggcactttgttttcaagatggtgttatcttttgaattcttgataaatgactgtttttttctgcctaatagtaactggttaaaaaacaaatgttcatatttattgattaaaaatgtggttgcttaattcct

SEQ ID NO: 805 - DNA, 777 bp, Homo sapiens
agacccttgctgcggagcgacggagagagactgtgccagtcccagccgccctaccgccgtgggaacgatggcagatgatcagggctgtattgaagagcagggggttgaggattcagcaaatgaagattcagtggatgctaagccagaccggtcctcgtttgtaccgtccctcttcagtaagaagaagaaaaatgtcaccatgcgatccatcaagaccacccgggaccgagtgcctacatatcagtacaacatgaattttgaaaagctgggcaaatgcatcataataaacaacaagaactttgataaagtgacaggtatgggcgttcgaaacggaacagacaaagatgccgaggcgctcttcaagtgcttccgaagcctgggttttgacgtgattgtctataatgactgctctgtcacccaggctggagtgcagcggcgtgatctcggaagactgcaacctccacctcccaggttcaagcaatactcctgcctcagcctcctgagtagctgggattacaggcacgcaccaccacgcctggctaatttttgtatttttagaagagaggggtttcgccatgttggccaggctggtctcaaactcctggcgtcaagtgatccacccacctcaggctcccaaagtgctgggattacaggtgtgagcctccacacccagccacaaattatgaaggtttctttaagacattgcaatacttttatttgctttgcttagtcatttgaaacacattcattcatttatcttttcatcaaattatcatt

SEQ ID NO: 806 - DNA, 2377 bp, Homo sapiens
gagacttttagtttcgctttcgctaaaggggccccagacccttgctgcggagcgacggagagagactgtgccagtcccagccgccctaccgccgtgggaacgatggcagatgatcagggctgtattgaagagcagggggttgaggattcagcaaatgaagattcagtggatgctaagccagaccggtcctcgtttgtaccgtccctcttcagtaagaagaagaaaaatgtcaccatgcgatccatcaagaccacccgggaccgagtgcctacatatcagtacaacatgaattttgaaaagctgggcaaatgcatcataataaacaacaagaactttgataaagtgacaggtatgggcgttcgaaacggaacagacaaagatgccgaggcgctcttcaagtgcttccgaagcctgggttttgacgtgattgtctataatgactgctcttgtgccaagatgcaagatctgcttaaaaaagcttctgaagaggaccatacaaatgccgcctgcttcgcctgcatcctcttaagccatggagaagaaaatgtaatttatgggaaagatggtgtcacaccaataaaggatttgacagcccactttaggggggatagatgcaaaacccttttagagaaacccaaactcttcttcattcaggcttgccgagggaccgagcttgatgatggcatccaggccgactcggggcccatcaatgacacagatgctaatcctcgatacaagatcccagtggaagctgacttcctcttcgcctattccacggttccaggctattactcgtggaggagcccaggaagaggctcctggtttgtgcaagccctctgctccatcctggaggagcacggaaaagacctggaaatcatgcagatcctcaccagggtgaatgacagagttgccaggcactttgagtctcagtctgatgacccacacttccatgagaagaagcagatcccctgtgtggtctccatgctcaccaaggaactctacttcagtcaatagccatatcaggggtacattctagctgagaagcaatgggtcactcattaatgaatcacatttttttatgctcttgaaatattcagaaattctccaggattttaatttcaggaaaatgtattgattcaacagggaagaaactttctggtgctgtcttttgttctctgaattttcagagactttttttataatgttattcatttggtgactgtgtaactttctcttaagattaattttctctttgtatgtctgttaccttgttaatagacttaatacatgcaacagaagtgacttctggagaaagctcatggctgtgtccactgcaattggtggtaacagtggtagagtcatgtttgcacttggcaaaaagaatcccaatgtttgacaaaacacagccaaggggatatttactgctctttattgcagaatgtgggtattgagtgtgatttgaatgatttttcattggcttagggcagattttcatgcaaaagttctcatatgagttagaggagaaaaagcttaatgattctgatatgtatccatcaggatccagtctggaaaacagaaaccattctaggtgtttcaacagagggagtttaatacaggaaattgacttacatagatgataaaagagaagccaaacagcaagaagctgttaccacacccagggctatgaggataatgggaagaggtttggtttcctgtgtccagtagtgggatcatccagaggagctggaaccatggtgggggctgcctagtgggagttaggaccaccaatggattgtggaaaatggagccatgacaagaacaaagccactgactgagatggagtgagctgagacagataagagaataccttggtctcacctatcctgccctcacatcttccaccagcaccttactgcccaggcctatctggaagccacctcaccaaggaccttggaagagcaagggacagtgaggcaggagaagaacaagaaatggatgtaagcctggcccataatgtgaacataagtaatcactaatgctcaacaatttatccattcaatcatttattcattgggttgtcagatagtctatgtatgtgtaaaacaatctgttttggctttatgtgcaaaatctgttatagctttaaaatatatctggaactttttagattattccaagccttattttgagtaaatatttgttacttttagttctataagtgaggaagagtttatggcaaagatttttggcactttgttttcaagatggtgttatcttttgaattcttgataaatgactgtttttttctgcctaatagtaactggttaaaaaacaaatgttcatatttattgattaaaaatgtggttgcttaattcct

SEQ ID NO: 807 - DNA, 741 bp, Homo sapiens
aaaggggccccagacccttgctgcggagcgacggagagagactgtgccagtcccagccgccctaccgccgtgggaacgatggcagatgatcagggctgtattgaagagcagggggttgaggattcagcaaatgaagattcagtggatgctaagccagaccggtcctcgtttgtaccgtccctcttcagtaagaagaagaaaaatgtcaccatgcgatccatcaagaccacccgggaccgagtgcctacatatcagtacaacatgaattttgaaaagctgggcaaatgcatcataataaacaacaagaactttgataaagtgacaggtatgggcgttcgaaacggaacagacaaagatgccgaggcgctcttcaagtgcttccgaagcctgggttttgacgtgattgtctataatgactgctctttcacccaggctggagtgcagcggcgtgatctcggaagactgcaacctccacctcccaggttcaagcaatactcctgcctcagcctcctgagtagctgggattacaggcacgcaccaccacgcctggctaatttttgtatttttagaagagaggggtttcgccatgttggccaggctggtctcaaactcctggcgtcaagtgatccacccacctcaggctcccaaagtgctgggattacaggtgtgagcctccacacccagccacaaattatgaaggtttctttaagacattgcaatacttttatttgctttgcttag

SEQ ID NO: 808 - DNA, 2694 bp, Homo sapiens
ctcccgcgcgcgggctcaactttgtagagcgaggggccaacttggcagagcgcgcggccagctttgcagagagcgccctccagggactatgcgtgcggggacacgggtcgctttgggctcttccacccctgcggagcgcactaccccgagccaggggcggtgcaagccccgcccggccctacccagggcggctcctccctccgcagcgccgagacttttagtttcgctttcgctaaaggggccccagacccttgctgcggagcgacggagagagactgtgccagtcccagccgccctaccgccgtgggaacgatgctgtaatggactgtgttggttggcctccaggcaggaagtggcacttggaaaagaacaccagctgcggtggtagcagtgggatttgtgcttcttatgttacccagatggcagatgatcagggctgtattgaagagcagggggttgaggattcagcaaatgaagattcagtggatgctaagccagaccggtcctcgtttgtaccgtccctcttcagtaagaagaagaaaaatgtcaccatgcgatccatcaagaccacccgggaccgagtgcctacatatcagtacaacatgaattttgaaaagctgggcaaatgcatcataataaacaacaagaactttgataaagtgacaggtatgggcgttcgaaacggaacagacaaagatgccgaggcgctcttcaagtgcttccgaagcctgggttttgacgtgattgtctataatgactgctcttgtgccaagatgcaagatctgcttaaaaaagcttctgaagaggaccatacaaatgccgcctgcttcgcctgcatcctcttaagccatggagaagaaaatgtaatttatgggaaagatggtgtcacaccaataaaggatttgacagcccactttaggggggatagatgcaaaacccttttagagaaacccaaactcttcttcattcaggcttgccgagggaccgagcttgatgatggcatccaggccgactcggggcccatcaatgacacagatgctaatcctcgatacaagatcccagtggaagctgacttcctcttcgcctattccacggttccaggctattactcgtggaggagcccaggaagaggctcctggtttgtgcaagccctctgctccatcctggaggagcacggaaaagacctggaaatcatgcagatcctcaccagggtgaatgacagagttgccaggcactttgagtctcagtctgatgacccacacttccatgagaagaagcagatcccctgtgtggtctccatgctcaccaaggaactctacttcagtcaatagccatatcaggggtacattctagctgagaagcaatgggtcactcattaatgaatcacatttttttatgctcttgaaatattcagaaattctccaggattttaatttcaggaaaatgtattgattcaacagggaagaaactttctggtgctgtcttttgttctctgaattttcagagactttttttataatgttattcatttggtgactgtgtaactttctcttaagattaattttctctttgtatgtctgttaccttgttaatagacttaatacatgcaacagaagtgacttctggagaaagctcatggctgtgtccactgcaattggtggtaacagtggtagagtcatgtttgcacttggcaaaaagaatcccaatgtttgacaaaacacagccaaggggatatttactgctctttattgcagaatgtgggtattgagtgtgatttgaatgatttttcattggcttagggcagattttcatgcaaaagttctcatatgagttagaggagaaaaagcttaatgattctgatatgtatccatcaggatccagtctggaaaacagaaaccattctaggtgtttcaacagagggagtttaatacaggaaattgacttacatagatgataaaagagaagccaaacagcaagaagctgttaccacacccagggctatgaggataatgggaagaggtttggtttcctgtgtccagtagtgggatcatccagaggagctggaaccatggtgggggctgcctagtgggagttaggaccaccaatggattgtggaaaatggagccatgacaagaacaaagccactgactgagatggagtgagctgagacagataagagaataccttggtctcacctatcctgccctcacatcttccaccagcaccttactgcccaggcctatctggaagccacctcaccaaggaccttggaagagcaagggacagtgaggcaggagaagaacaagaaatggatgtaagcctggcccataatgtgaacataagtaatcactaatgctcaacaatttatccattcaatcatttattcattgggttgtcagatagtctatgtatgtgtaaaacaatctgttttggctttatgtgcaaaatctgttatagctttaaaatatatctggaactttttagattattccaagccttattttgagtaaatatttgttacttttagttctataagtgaggaagagtttatggcaaagatttttggcactttgttttcaagatggtgttatcttttgaattcttgataaatgactgtttttttctgcctaatagtaactggttaaaaaacaaatgttcatatttattgattaaaaatgtggttgcttaattcct

SEQ ID NO: 809 - DNA, 2387 bp, Homo sapiens
gcaagctgggctgctgggtgggtacttccttcaaagctgagggagcgtcctacgcccacgcgcgcaggagggcgccccccgcaaagcaacgtctaggagaccacagtggatgccacagcgggcccgaagcggatcagccttgtgggatggcagatgatcagggctgtattgaagagcagggggttgaggattcagcaaatgaagattcagtggatgctaagccagaccggtcctcgtttgtaccgtccctcttcagtaagaagaagaaaaatgtcaccatgcgatccatcaagaccacccgggaccgagtgcctacatatcagtacaacatgaattttgaaaagctgggcaaatgcatcataataaacaacaagaactttgataaagtgacaggtatgggcgttcgaaacggaacagacaaagatgccgaggcgctcttcaagtgcttccgaagcctgggttttgacgtgattgtctataatgactgctcttgtgccaagatgcaagatctgcttaaaaaagcttctgaagaggaccatacaaatgccgcctgcttcgcctgcatcctcttaagccatggagaagaaaatatggaatcttgctctgtcacccaggctggagtgcagcggcgtgatctcggaagactgcaacctccacctcccaggcttgccgagggaccgagcttgatgatggcatccaggccgactcggggcccatcaatgacacagatgctaatcctcgatacaagatcccagtggaagctgacttcctcttcgcctattccacggttccaggctattactcgtggaggagcccaggaagaggctcctggtttgtgcaagccctctgctccatcctggaggagcacggaaaagacctggaaatcatgcagatcctcaccagggtgaatgacagagttgccaggcactttgagtctcagtctgatgacccacacttccatgagaagaagcagatcccctgtgtggtctccatgctcaccaaggaactctacttcagtcaatagccatatcaggggtacattctagctgagaagcaatgggtcactcattaatgaatcacatttttttatgctcttgaaatattcagaaattctccaggattttaatttcaggaaaatgtattgattcaacagggaagaaactttctggtgctgtcttttgttctctgaattttcagagactttttttataatgttattcatttggtgactgtgtaactttctcttaagattaattttctctttgtatgtctgttaccttgttaatagacttaatacatgcaacagaagtgacttctggagaaagctcatggctgtgtccactgcaattggtggtaacagtggtagagtcatgtttgcacttggcaaaaagaatcccaatgtttgacaaaacacagccaaggggatatttactgctctttattgcagaatgtgggtattgagtgtgatttgaatgatttttcattggcttagggcagattttcatgcaaaagttctcatatgagttagaggagaaaaagcttaatgattctgatatgtatccatcaggatccagtctggaaaacagaaaccattctaggtgtttcaacagagggagtttaatacaggaaattgacttacatagatgataaaagagaagccaaacagcaagaagctgttaccacacccagggctatgaggataatgggaagaggtttggtttcctgtgtccagtagtgggatcatccagaggagctggaaccatggtgggggctgcctagtgggagttaggaccaccaatggattgtggaaaatggagccatgacaagaacaaagccactgactgagatggagtgagctgagacagataagagaataccttggtctcacctatcctgccctcacatcttccaccagcaccttactgcccaggcctatctggaagccacctcaccaaggaccttggaagagcaagggacagtgaggcaggagaagaacaagaaatggatgtaagcctggcccataatgtgaacataagtaatcactaatgctcaacaatttatccattcaatcatttattcattgggttgtcagatagtctatgtatgtgtaaaacaatctgttttggctttatgtgcaaaatctgttatagctttaaaatatatctggaactttttagattattccaagccttattttgagtaaatatttgttacttttagttctataagtgaggaagagtttatggcaaagatttttggcactttgttttcaagatggtgttatcttttgaattcttgataaatgactgtttttttctgcctaatagtaactggttaaaaaacaaatgttcatatttattgattaaaaatgtggttgcttaattcct

SEQ ID NO: 810 - DNA, 834 bp, Homo sapiens
ccaggagcagcatctccaccagcaagctgggctgctgggtgggtacttccttcaaagctgagggagcgtcctacgcccacgcgcgcaggagggcgccccccgcaaagcaacgtctaggagaccacagtggatgccacagcgggcccgaagcggatcagccttgtgggatggcagatgatcagggctgtattgaagagcagggggttgaggattcagcaaatgaagattcagtggatgctaagccagaccggtcctcgtttgtaccgtccctcttcagtaagaagaagaaaaatgtcaccatgcgatccatcaagaccacccgggaccgagtgcctacatatcagtacaacatgaattttgaaaagctgggcaaatgcatcataataaacaacaagaactttgataaagtgacaggtatgggcgttcgaaacggaacagacaaagatgccgaggcgctcttcaagtgcttccgaagcctgggttttgacgtgattgtctataatgactgctcttgtgccaagatgcaagatctgcttaaaaaagcttctgaagaggaccatacaaatgccgcctgcttcgcctgcatcctcttaagccatggagaagaaaatgtaatttatgggaaagatggtgtcacaccaataaaggatttgacagcccactttaggggggatagatgcaaaacccttttagagaaacccaaactcttcttcattcaggcttgccgagggaccgagcttgatgatggcatccaggccgactcggggcccatcaatgacacagatgctaatcctcgatacaagatcccagtggaagctgacttcctcttcgcct

SEQ ID NO: 811 - DNA, 2229 bp, Homo sapiens
aaaggggccccagacccttgctgcggagcgacggagagagactgtgccagtcccagccgccctaccgccgtgggaacgatggcagatgatcagggctgtattgaagagcagggggttgaggattcagcaaatgaagattcagtggatgctaagccagaccggtcctcgtttgtaccgtccctcttcagtaagaagaagaaaaatgtcaccatgcgatccatcaagaccacccgggaccgagtgcctacatatcagtacaacatgaattttgaaaagctgggcaaatgcatcataataaacaacaagaactttgataaagtgacaggtatgggcgttcgaaacggaacagacaaagatgccgaggcgctcttcaagtgcttccgaagcctgggttttgacgtgattgtctataatgactgctcttgtgccaagatgcaagatctgcttaaaaaagcttctgaagaggaccatacaaatgccgcctgcttcgcctgcatcctcttcttcattcaggcttgccgagggaccgagcttgatgatggcatccaggccgactcggggcccatcaatgacacagatgctaatcctcgatacaagatcccagtggaagctgacttcctcttcgcctattccacggttccaggctattactcgtggaggagcccaggaagaggctcctggtttgtgcaagccctctgctccatcctggaggagcacggaaaagacctggaaatcatgcagatcctcaccagggtgaatgacagagttgccaggcactttgagtctcagtctgatgacccacacttccatgagaagaagcagatcccctgtgtggtctccatgctcaccaaggaactctacttcagtcaatagccatatcaggggtacattctagctgagaagcaatgggtcactcattaatgaatcacatttttttatgctcttgaaatattcagaaattctccaggattttaatttcaggaaaatgtattgattcaacagggaagaaactttctggtgctgtcttttgttctctgaattttcagagactttttttataatgttattcatttggtgactgtgtaactttctcttaagattaattttctctttgtatgtctgttaccttgttaatagacttaatacatgcaacagaagtgacttctggagaaagctcatggctgtgtccactgcaattggtggtaacagtggtagagtcatgtttgcacttggcaaaaagaatcccaatgtttgacaaaacacagccaaggggatatttactgctctttattgcagaatgtgggtattgagtgtgatttgaatgatttttcattggcttagggcagattttcatgcaaaagttctcatatgagttagaggagaaaaagcttaatgattctgatatgtatccatcaggatccagtctggaaaacagaaaccattctaggtgtttcaacagagggagtttaatacaggaaattgacttacatagatgataaaagagaagccaaacagcaagaagctgttaccacacccagggctatgaggataatgggaagaggtttggtttcctgtgtccagtagtgggatcatccagaggagctggaaccatggtgggggctgcctagtgggagttaggaccaccaatggattgtggaaaatggagccatgacaagaacaaagccactgactgagatggagtgagctgagacagataagagaataccttggtctcacctatcctgccctcacatcttccaccagcaccttactgcccaggcctatctggaagccacctcaccaaggaccttggaagagcaagggacagtgaggcaggagaagaacaagaaatggatgtaagcctggcccataatgtgaacataagtaatcactaatgctcaacaatttatccattcaatcatttattcattgggttgtcagatagtctatgtatgtgtaaaacaatctgttttggctttatgtgcaaaatctgttatagctttaaaatatatctggaactttttagattattccaagccttattttgagtaaatatttgttacttttagttctataagtgaggaagagtttatggcaaagatttttggcactttgttttcaagatggtgttatcttttgaattcttgataaatgactgtttttttctgcctaatagtaactggttaaaaaacaaatgttcatatttattgattaaaaatgtggttgctt

SEQ ID NO: 812 - DNA, 1148 bp, Homo sapiens
tgtcgtcgcagagcacagcctagttctgatgcagaggggactgttttcagatggagacactagtaagaagaagaaaaatgtcaccatgcgatccatcaagaccacccgggaccgagtgcctacatatcagtacaacatgaattttgaaaagctgggcaaatgcatcataataaacaacaagaactttgataaagtgacaggtatgggcgttcgaaacggaacagacaaagatgccgaggcgctcttcaagtgcttccgaagcctgggttttgacgtgattgtctataatgactgctcttgtgccaagatgcaagatctgcttaaaaaagcttctgaagaggaccatacaaatgccgcctgcttcgcctgcatcctcttaagccatggagaagaaaatgtaatttatgggaaagatggtgtcacaccaataaaggatttgacagcccactttaggggggatagatgcaaaacccttttagagaaacccaaactcttcttcattcaggcttgccgagggaccgagcttgatgatggcatccaggccgactcggggcccatcaatgacacagatgctaatcctcgatacaagatcccagtggaagctgacttcctcttcgcctattccacggttccaggctattactcgtggaggagcccaggaagaggctcctggtttgtgcaagccctctgctccatcctggaggagcacggaaaagacctggaaatcatgcagatcctcaccagggtgaatgacagagttgccaggcactttgagtctcagtctgatgacccacacttccatgagaagaagcagatcccctgtgtggtctccatgctcaccaaggaactctacttcagtcaatagccatatcaggggtacattctagctgagaagcaatgggtcactcattaatgaatcacatttttttatgctcttgaaatattcagaaattctccaggattttaatttcaggaaaatgtattgattcaacagggaagaaactttctggtgctgtcttttgttctctgaattttcagagactttttttataatgttattcatttggtgactgtgtaactttctcttaagattaattttctctttgtatgtctgttaccttgttaatagacttaatacatgcaacaga

SEQ ID NO: 813 - DNA, 2540 bp, Homo sapiens
gtgctctgagtttttggtttctgtttcaccttgtgtctgagctggtctgaaggctggttgttcagactgagcttcctgcctgcctgtaccccgccaacagcttcagaagaaggagcagcccctgggtgcgtccactttctgggcacgtgaggttgggccttggccgcctgagcccttgagttggtcacttgaaccttgggaatattgagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcgaggcgatgatattctcaccatcctgactgaagtgaactatgaagtaagcaacaaggatgacaagaaaaacatggggaaacagatgcctcagcctactttcacactaagaaaaaaacttgtcttcccttctgattgatggtgctattttgtttgttttgttttgttttgtttttttgagacagaatctcgctctgtcgcccaggctggagtgcagtggcgtgatctcggctcaccgcaagctccgcctcccgggttcaggccattctcctgcctcagcctcccgagtagctgggactacaggggcccgccaccacacctggctaattttttaaaaatatttttagtagagacagggtttcactgtgttagccagggtggtcttgatctcctgacctcgtgatccacccacctcggcctcccaaagtgctgggattacaggcgtgagccaccgcgcctggccgatggtactatttagatataacactatgtttatttactaattttctagattttctactttattaattgttttgcacttttttataagagctaaagttaaataggatattaacaacaataacactgtctcctttctcttatgcttaaggctttgggaatgtttttagctggtggcaataaataccagacacgtacaaaatccagctatgaatatagagggcttatgattcagattgttatctatcaactataagcccactgttaatattctattaactttaattctctttcaaagctaaattccacactaccacattaaaaaaattagaaagtagccacgtatggtggctcatgtctataatcccagcactttgggaggttgaggtgggaggattgcttgaacccaagaggtcaaggctgcagtgagccatgttcacaccgctgcactcaagcttgggtgacagaacaagaccccgtctcaaaaaaaattttttttttaataaaacaaaatttgtttgaaatcttttaaaaattcaaatgatttttacaagttttaaataagctctccccaaacttgctttatgccttcttattgcttttatgatatatatatgcttggctaactatatttgctttttgctaacaatgctctggggtctttttatgcatttgcatttgctctttcatctctgcttggattattttaaatcattaggaattaagttatctttaaaatttaagtatcttttttcaaaaacattttttaatagaataaaatataatttgatcttatt

SEQ ID NO: 814 - DNA, 1906 bp, Homo sapiens
tttcaccttgtgtctgagctggtctgaaggctggttgttcagactgagcttcctgcctgcctgtaccccgccaacagcttcagaagaaggtgactggtggctgcctgaggaataccagtgggcaagagaattagcatttctggagcatctgctgtctgagcagcccctgggtgcgtccactttctgggcacgtgaggttgggccttggccgcctgagcccttgagttggtcacttgaaccttgggaatattgagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacaggttccacttctgccgcatgagctgggctgaagcaaacagccagtgccagacacagtctgtacctttctggcggagggtcgatcatctattaataagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaaggggaggagttgtgtggggtaatgacaatctcggactctccaagagaacaggatagtgaatcacagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcgaggcgatgatattctcaccatcctgactgaagtgaactatgaagtaagcaacaaggatgacaagaaaaacatggggaaacagatgcctcagcctactttcacactaagaaaaaaacttgtcttcccttctgattgatggtgctattttgtttgttttgttttgttttgtttttttgagacagaatctcgctctgtcgcccaggctggagtgcagtggcgtgatctcggctcaccgcaagctccgcctcccgggttcaggccattctcctgc

SEQ ID NO: 815 - DNA, 2650 bp, Homo sapiens
gtagagctggctggctgtgcccttccgtccttcattagacgtttgctcttgtcttagatgctcagatggtagtggataggcctgtgacgaaggtgctaccatcgtgagagtaagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaaggggaggagttgtgtggggtaatgacaatctcggactctccaagagaacaggatagtgaatcacagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcgaggcgatgatattctcaccatcctgactgaagtgaactatgaagtaagcaacaaggatgacaagaaaaacatggggaaacagatgcctcagcctactttcacactaagaaaaaaacttgtcttcccttctgattgatggtgctattttgtttgttttgttttgttttgtttttttgagacagaatctcgctctgtcgcccaggctggagtgcagtggcgtgatctcggctcaccgcaagctccgcctcccgggttcaggccattctcctgcctcagcctcccgagtagctgggactacaggggcccgccaccacacctggctaattttttaaaaatatttttagtagagacagggtttcactgtgttagccagggtggtcttgatctcctgacctcgtgatccacccacctcggcctcccaaagtgctgggattacaggcgtgagccaccgcgcctggccgatggtactatttagatataacactatgtttatttactaattttctagattttctactttattaattgttttgcacttttttataagagctaaagttaaataggatattaacaacaataacactgtctcctttctcttatgcttaaggctttgggaatgtttttagctggtggcaataaataccagacacgtacaaaatccagctatgaatatagagggcttatgattcagattgttatctatcaactataagcccactgttaatattctattaactttaattctctttcaaagctaaattccacactaccacattaaaaaaattagaaagtagccacgtatggtggctcatgtctataatcccagcactttgggaggttgaggtgggaggattgcttgaacccaagaggtcaaggctgcagtgagccatgttcacaccgctgcactcaagcttgggtgacagaacaagaccccgtctcaaaaaaaattttttttttaataaaacaaaatttgtttgaaatcttttaaaaattcaaatgatttttacaagttttaaataagctctccccaaacttgctttatgccttcttattgcttttatgatatatatatgcttggctaactatatttgctttttgctaacaatgctctggggtctttttatgcatttgcatttgctctttcatctctgcttggattattttaaatcattaggaattaagttatctttaaaatttaagtatcttttttcaaaaacattttttaatagaataaaatataatttgatctta

SEQ ID NO: 816 - DNA, 2930 bp, Homo sapiens
agtcatctctgttctgctttaggagtaaagtttaccctgcagttccttctgtggtgaagttttctctttctctcggagaccagattctgcctttctgctggagggaagtgttttcacaggttctcctccttttatcttttgtgttttttttcaagccctgctgaatttgctagtcaactcaacaggaagtgaggccatggagggaggcagaagagccagggtggttattgaaagtaaaagaaacttcttcctgggagcctttcccacccccttccctgctgagcacgtggagttaggcaggttaggggactcggagactgcgatggtgccaggaaagggtggagcggattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaagagagaagcagcagccttgaaggaagtcctgatgaattttcaaatggggaggagttgtgtggggtaatgacaatctcggactctccaagagaacaggatagtgaatcacagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcgaggcgatgatattctcaccatcctgactgaagtgaactatgaagtaagcaacaaggatgacaagaaaaacatggggaaacagatgcctcagcctactttcacactaagaaaaaaacttgtcttcccttctgattgatggtgctattttgtttgttttgttttgttttgtttttttgagacagaatctcgctctgtcgcccaggctggagtgcagtggcgtgatctcggctcaccgcaagctccgcctcccgggttcaggccattctcctgcctcagcctcccgagtagctgggactacaggggcccgccaccacacctggctaattttttaaaaatatttttagtagagacagggtttcactgtgttagccagggtggtcttgatctcctgacctcgtgatccacccacctcggcctcccaaagtgctgggattacaggcgtgagccaccgcgcctggccgatggtactatttagatataacactatgtttatttactaattttctagattttctactttattaattgttttgcacttttttataagagctaaagttaaataggatattaacaacaataacactgtctcctttctcttatgcttaaggctttgggaatgtttttagctggtggcaataaataccagacacgtacaaaatccagctatgaatatagagggcttatgattcagattgttatctatcaactataagcccactgttaatattctattaactttaattctctttcaaagctaaattccacactaccacattaaaaaaattagaaagtagccacgtatggtggctcatgtctataatcccagcactttgggaggttgaggtgggaggattgcttgaacccaagaggtcaaggctgcagtgagccatgttcacaccgctgcactcaagcttgggtgacagaacaagaccccgtctcaaaaaaaattttttttttaataaaacaaaatttgtttgaaatcttttaaaaattcaaatgatttttacaagttttaaataagctctccccaaacttgctttatgccttcttattgcttttatgatatatatatgcttggctaactatatttgctttttgctaacaatgctctggggtctttttatgcatttgcatttgctctttcatctctgcttggattattttaaatcattaggaattaagttatctttaaaatttaagtatcttttttcaaaaacattttttaatagaataaaatataatttgatcttatt

SEQ ID NO: 817 - DNA, 1060 bp, Homo sapiens
agactgagcttcctgcctgcctgtaccccgccaacagcttcagaagaaggtgactggtggctgcctgaggaataccagtgggcaagagaattagcatttctggagcatctgctgtctgagcagcccctgggtgcgtccactttctgggcacgtgaggttgggccttggccgcctgagcccttgagttggtcacttgaaccttgggaatattgagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaagagagaagcagcagccttgaaggaagtcctgatgaattttcaaatgactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcagggtttgagaatgtttttagctggtggcaataaatattagaagcctgcagaatccagctacgaatatagagggttttgctcttg

SEQ ID NO: 818 - DNA, 2727 bp, Homo sapiens
gtgctctgagtttttggtttctgtttcaccttgtgtctgagctggtctgaaggctggttgttcagactgagcttcctgcctgcctgtaccccgccaacagcttcagaagaaggagcagcccctgggtgcgtccactttctgggcacgtgaggttgggccttggccgcctgagcccttgagttggtcacttgaaccttgggaatattgagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaagagagaagcagcagccttgaaggaagtcctgatgaattttcaaatgactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcgaggcgatgatattctcaccatcctgactgaagtgaactatgaagtaagcaacaaggatgacaagaaaaacatggggaaacagatgcctcagcctactttcacactaagaaaaaaacttgtcttcccttctgattgatggtgctattttgtttgttttgttttgttttgtttttttgagacagaatctcgctctgtcgcccaggctggagtgcagtggcgtgatctcggctcaccgcaagctccgcctcccgggttcaggccattctcctgcctcagcctcccgagtagctgggactacaggggcccgccaccacacctggctaattttttaaaaatatttttagtagagacagggtttcactgtgttagccagggtggtcttgatctcctgacctcgtgatccacccacctcggcctcccaaagtgctgggattacaggcgtgagccaccgcgcctggccgatggtactatttagatataacactatgtttatttactaattttctagattttctactttattaattgttttgcacttttttataagagctaaagttaaataggatattaacaacaataacactgtctcctttctcttatgcttaaggctttgggaatgtttttagctggtggcaataaataccagacacgtacaaaatccagctatgaatatagagggcttatgattcagattgttatctatcaactataagcccactgttaatattctattaactttaattctctttcaaagctaaattccacactaccacattaaaaaaattagaaagtagccacgtatggtggctcatgtctataatcccagcactttgggaggttgaggtgggaggattgcttgaacccaagaggtcaaggctgcagtgagccatgttcacaccgctgcactcaagcttgggtgacagaacaagaccccgtctcaaaaaaaattttttttttaataaaacaaaatttgtttgaaatcttttaaaaattcaaatgatttttacaagttttaaataagctctccccaaacttgctttatgccttcttattgcttttatgatatatatatgcttggctaactatatttgctttttgctaacaatgctctggggtctttttatgcatttgcatttgctctttcatctctgcttggattattttaaatcattaggaattaagttatctttaaaatttaagtatcttttttcaaaaacattttttaatagaataaaatataatttgatcttatt

SEQ ID NO: 819 - DNA, 1283 bp, Homo sapiens
gaagttttctctttctctcggagaccagattctgcctttctgctggagggaagtgttttcacagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaaggggaggagttgtgtggggtaatgacaatctcggactctccaagagaacaggatagtgaatcacagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcagggtctcactctgttgcccaggctggagtgcagtggtgtgatctcagctcactgcagcctccacctccctggttcaagtgattctcctgcctcagcctcccaagtagctgggactacaggcacacaccaccacacatggctaatttttgtatttttagtagagatggggttttgccatattggccaggctggtcttgaactcctgacctcaagtgatccgcctgcctcggcctcccaaagtgctggaattacaggtgtcagccacctgtacctggtccctgctaacatttgatttgtttatttaagcaaatctaagcctttaaaaaggcacagagattaagtccattgattacatcattcgtcactatgcgcttggtattgaaaaaaatattttggacccttgatttgtattcttttaaaattaaaacatttctatt

SEQ ID NO: 820 - DNA, 1627 bp, Homo sapiens
gtgctctgagtttttggtttctgtttcaccttgtgtctgagctggtctgaaggctggttgttcagactgagcttcctgcctgcctgtaccccgccaacagcttcagaagaaggagcagcccctgggtgcgtccactttctgggcacgtgaggttgggccttggccgcctgagcccttgagttggtcacttgaaccttgggaatattgagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaaggggaggagttgtgtggggtaatgacaatctcggactctccaagagaacaggatagtgaatcacagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcgaggcgatgatattctcaccatcctgactgaagtgaactatgaagtaagcaacaaggatgacaagaaaaacatggggaaacagatgcctcagcctactttcacactaagaaaaaaacttgtcttcccttctgat

SEQ ID NO: 821 - DNA, 2682 bp, Homo sapiens
gtgctctgagtttttggtttctgtttcaccttgtgtctgagctggtctgaaggctggttgttcagactgagcttcctgcctgcctgtaccccgccaacagcttcagaagaaggagcagcccctgggtgcgtccactttctgggcacgtgaggttgggccttggccgcctgagcccttgagttggtcacttgaaccttgggaatattgagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcgaggcgatgatattctcaccatcctgactgaagtgaactatgaagtaagcaacaaggatgacaagaaaaacatggggaaacagatgcctcagcctactttcacactaagaaaaaaacttgtcttcccttctgattgatggtgctattttgtttgttttgttttgttttgtttttttgagacagaatctcgctctgtcgcccaggctggagtgcagtggcgtgatctcggctcaccgcaagctccgcctcccgggttcaggccattctcctgcctcagcctcccgagtagctgggactacaggggcccgccaccacacctggctaattttttaaaaatatttttagtagagacagggtttcactgtgttagccagggtggtcttgatctcctgacctcgtgatccacccacctcggcctcccaaagtgctgggattacaggcgtgagccaccgcgcctggccgatggtactatttagatataacactatgtttatttactaattttctagattttctactttattaattgttttgcacttttttataagagctaaagttaaataggatattaacaacaataacactgtctcctttctcttatgcttaaggctttgggaatgtttttagctggtggcaataaataccagacacgtacaaaatccagctatgaatatagagggcttatgattcagattgttatctatcaactataagcccactgttaatattctattaactttaattctctttcaaagctaaattccacactaccacattaaaaaaattagaaagtagccacgtatggtggctcatgtctataatcccagcactttgggaggttgaggtgggaggattgcttgaacccaagaggtcaaggctgcagtgagccatgttcacaccgctgcactcaagcttgggtgacagaacaagaccccgtctcaaaaaaaattttttttttaataaaacaaaatttgtttgaaatcttttaaaaattcaaatgatttttacaagttttaaataagctctccccaaacttgctttatgccttcttattgcttttatgatatatatatgcttggctaactatatttgctttttgctaacaatgctctggggtctttttatgcatttgcatttgctctttcatctctgcttggattattttaaatcattaggaattaagttatctttaaaatttaagtatcttttttcaaaaacattttttaatagaataaaatataatttgatcttatt

SEQ ID NO: 822 - DNA, 658 bp, Homo sapiens
gattctgcctttctgctggagggaagtgttttcacagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaagagagaagcagcagccttgaaggaagtcctgatgaattttcaaatg

SEQ ID NO: 823 - DNA, 717 bp, Homo sapiens
agattctagcacttcctttgtgaggctctaaccccctctcctatagtggatttgttaagaacttctgtttttgtggctttgttattataaaattttttgaaatgttgttctctaaaaaagttatgattttatgtttttcttcatgagattctttcactgccttccagctgcaagtagaatgacgtctaaatctttgtgatctgtcactgaagcccttgagtgagacacttaaatctggctgtggctctctctcttactagcttatttccaagccgtgatttttcacaacagaaaaatggggacagtaatagtagtttcttcagaggcttttagtgaaatgagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaat

SEQ ID NO: 824 - DNA, 1629 bp, Homo sapiens
ctgtttcaccttgtgtctgagctggtctgaaggctggttgttcagactgagcttcctgcctgcctgtaccccgccaacagcttcagaagaaggagcagcccctgggtgcgtccactttctgggcacgtgaggttgggccttggccgcctgagcccttgagttggtcacttgaaccttgggaatattgagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaagagagaagcagcagccttgaaggaagtcctgatgaattttcaaatggggaggagttgtgtggggtaatgacaatctcggactctccaagagaacaggatagtgaatcacagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcgaggcgatgatattctcaccatcctgactgaagtgaactatgaagtaagcaacaaggatgacaagaaaaacatggggaaacagatgcctcagcctactttcacactaagaaaaaaacttgtcttcccttctgattga

SEQ ID NO: 825 - DNA, 592 bp, Homo sapiens
gttcagactgagcttcctgcctgcctgtaccccgccaacagcttcagaagaaggtgactggtggctgcctgaggaataccagtgggcaagagaattagcatttctggagcatctgctgtctgagcagcccctgggtgcgtccactttctgggcacgtgaggttgggccttggccgcctgagcccttgagttggtcacttgaaccttgggaatattgagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgca

SEQ ID NO: 826 - DNA, 707 bp, Homo sapiens
atggttggaaattgggcatctgttcctttaaacaggaaacatttcttgttcgaattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaagactttggacaaagtttaccaaatgaaaagcaaacctcggggatactgtctgatcatcaacaatcacaattttgcaaaa

SEQ ID NO: 827 - DNA, 2019 bp, Homo sapiens
ggccctggggcgggggcgggtcctggggactggggcgggcggccgaggcccggaagcggactgaggcggcctggagtcttagttggctactcgccatggacgaagcggatcggcggctcctgcggcggtgccggctgcggctggtggaagagctgcaggtggaccagctctgggacgccctgctgagccgcgagctgttcaggccccatatgatcgaggacatccagcgggcaggctctggatctcggcgggatcaggccaggcagctgatcatagatctggagactcgagggagtcaggctcttcctttgttcatctcctgcttagaggacacaggccaggacatgctggcttcgtttctgcgaactaacaggcaagcagcaaagttgtcgaagccaaccctagaaaaccttaccccagtggtgctcagaccagagattcgcaaaccagaggttctcagaccggaaacacccagaccagtggacattggttctggaggatttggtgatgtcggtgctcttgagagtttgaggggaaatgcagatttggcttacatcctgagcatggagccctgtggccactgcctcattatcaacaatgtgaacttctgccgtgagtccgggctccgcacccgcactggctccaacatcgactgtgagaagttgcggcgtcgcttctcctcgctgcatttcatggtggaggtgaagggcgacctgactgccaagaaaatggtgctggctttgctggagctggcgcagcaggaccacggtgctctggactgctgcgtggtggtcattctctctcacggctgtcaggccagccacctgcagttcccaggggctgtctacggcacagatggatgccctgtgtcggtcgagaagattgtgaacatcttcaatgggaccagctgccccagcctgggagggaagcccaagctctttttcatccaggcctgtggtggggagcagaaagaccatgggtttgaggtggcctccacttcccctgaagacgagtcccctggcagtaaccccgagccagatgccaccccgttccaggaaggtttgaggaccttcgaccagctggacgccatatctagtttgcccacacccagtgacatctttgtgtcctactctactttcccaggttttgtttcctggagggaccccaagagtggctcctggtacgttgagaccctggacgacatctttgagcagtgggctcactctgaagacctgcagtccctcctgcttagggtcgctaatgctgtttcggtgaaagggatttataaacagatgcctggttgctttaatttcctccggaaaaaacttttctttaaaacatcataaggccagggcccctcaccctgccttatcttgcaccccaaagctttcctgccccaggcctgaaagaggctgaggcctggactttcctgcaactcaaggactttgcagccggcacagggtctgctctttctctgccagtgacagacaggctcttagcagcttccagattgacgacaagtgctgaacagtggaggaagagggacagatgaatgccgtggattgcacgtggcctcttgagcagtggctggtccagggctagtgacttgtgtcccatgatccctgtgttgtctctagagcagggattaacctctgcactactgacatgtggggccaggtcaccctttgctgtgaggctgtcctgtacattgtgggatgttcagcactgtcccttgcctcaatgccagtaacgcgtcttcctgagtggtgccaaacaaaaaggttctcaggtgttgccaaatatgtcctggggtataaaactttcctcgcctgacaaccactggtctgtagggatttttggctacacacaaaccagtatcgctcatagatcagcaaaccggggcctactagagtctgaacagctgtaatctatgaattctaagtgaaattttaaaaattgttaatttttcctatattgcattaattttaaaaaataaatctgaggcaaatatggactctc

SEQ ID NO: 828 - DNA, 1621 bp, Homo sapiens
gtccggaggcggtggggagcgaagactgacccggggccgtgacgcgggggcaggccctggggcgggggcgggtcctggggactggggcgggcggccgaggcccggaagcggactgaggcggcctggagtcttagttggctactcgccatggacgaagcggatcggcggctcctgcggcggtgccggctgcggctggtggaagagctgcaggtggaccagctctgggacgccctgctgagccgcgagctgttcaggccccatatgatcgaggacatccagcgggcaggctctggatctcggcgggatcaggccaggcagctgatcatagatctggagactcgagggagtcaggctcttcctttgttcatctcctgcttagaggacacaggccaggacatgctggcttcgtttctgcgaactaacaggcaagcagcaaagttgtcgaagccaaccctagaaaaccttaccccagtggtgctcagaccagagattcgcaaaccagaggttctcagaccggaaacacccagaccagtggacattggttctggaggatttggtgatgtcgagcagaaagaccatgggtttgaggtggcctccacttcccctgaagacgagtcccctggcagtaaccccgagccagatgccaccccgttccaggaaggtttgaggaccttcgaccagctggacgccatatctagtttgcccacacccagtgacatctttgtgtcctactctactttcccaggttttgtttcctggagggaccccaagagtggctcctggtacgttgagaccctggacgacatctttgagcagtgggctcactctgaagacctgcagtccctcctgcttagggtcgctaatgctgtttcggtgaaagggatttataaacagatgcctggttgctttaatttcctccggaaaaaacttttctttaaaacatcataaggccagggcccctcaccctgccttatcttgcaccccaaagctttcctgccccaggcctgaaagaggctgaggcctggactttcctgcaactcaaggactttgcagccggcacagggtctgctctttctctgccagtgacagacaggctcttagcagcttccagattgacgacaagtgctgaacagtggaggaagagggacagatgaatgccgtggattgcacgtggcctcttgagcagtggctggtccagggctagtgacttgtgtcccatgatccctgtgttgtctctagagcagggattaacctctgcactactgacatgtggggccaggtcaccctttgctgtgaggctgtcctgtacattgtgggatgttcagcactgtcccttgcctcaatgccagtaacgcgtcttcctgagtggtgccaaacaaaaaggttctcaggtgttgccaaatatgtcctggggtataaaactttcctcgcctgacaaccactggtctgtagggatttttggctacacacaaaccagtatcgctcatagatcagcaaaccggggcctactagagtctgaacagctgtaatctatgaattctaagtgaaattttaaaaattgttaatttttcctatattgcattaattttaaaaaataaatctgaggcaaatatggactctc

SEQ ID NO: 829 - DNA, 1807 bp, Homo sapiens
ggccctggggcgggggcgggtcctggggactggggcgggcggccgaggcccggaagcggactgaggcggcctggagtcttagttggctactcgccatggacgaagcggatcggcggctcctgcggcggtgccggctgcggctggtggaagagctgcaggtggaccagctctgggacgccctgctgagccgcgagctgttcaggccccatatgatcgaggacatccagcgggcaggctctggatctcggcgggatcaggccaggcagctgatcatagatctggagactcgagggagtcaggctcttcctttgttcatctcctgcttagaggacacaggccaggacatgctggcttcgtttctgcgaactaacaggcaagcagcaaagttgtcgaagccaaccctagaaaaccttaccccagtggtgctcagaccagagattcgcaaaccagaggttctcagaccggaaacacccagaccagtggacattggttctggaggatttggtgatgtcggtgctcttgagagtttgaggggaaatgcagatttggcttacatcctgagcatggagccctgtggccactgcctcattatcaacaatgtgaacttctgccgtgagtccgggctccgcacccgcactggctccaacatcgactgtgagaagttgcggcgtcgcttctcctcgctgcatttcatggtggaggtgaagggcgacctgactgccaagaaaatggtgctggctttgctggagctggcgcagcaggaccacggtgctctggactgctgcgtggtggtcattctctctcacggctgtcaggccagccacctgcagttcccaggggctgtctacggcacagatggatgccctgtgtcggtcgagaagattgtgaacatcttcaatgggaccagctgccccagcctgggagggaagcccaagctctttttcatccaggcctgtggtgggggttttgtttcctggagggaccccaagagtggctcctggtacgttgagaccctggacgacatctttgagcagtgggctcactctgaagacctgcagtccctcctgcttagggtcgctaatgctgtttcggtgaaagggatttataaacagatgcctggttgctttaatttcctccggaaaaaacttttctttaaaacatcataaggccagggcccctcaccctgccttatcttgcaccccaaagctttcctgccccaggcctgaaagaggctgaggcctggactttcctgcaactcaaggactttgcagccggcacagggtctgctctttctctgccagtgacagacaggctcttagcagcttccagattgacgacaagtgctgaacagtggaggaagagggacagatgaatgccgtggattgcacgtggcctcttgagcagtggctggtccagggctagtgacttgtgtcccatgatccctgtgttgtctctagagcagggattaacctctgcactactgacatgtggggccaggtcaccctttgctgtgaggctgtcctgtacattgtgggatgttcagcactgtcccttgcctcaatgccagtaacgcgtcttcctgagtggtgccaaacaaaaaggttctcaggtgttgccaaatatgtcctggggtataaaactttcctcgcctgacaaccactggtctgtagggatttttggctacacacaaaccagtatcgctcatagatcagcaaaccggggcctactagagtctgaacagctgtaatctatgaattctaagtgaaattttaaaaattgttaatttttcctatattgcattaatttt

SEQ ID NO: 830 - DNA, 1351 bp, Homo sapiens
aattgaccctggggacagggcgaggcgcggaggcgtcctgaaggcgaggcggtgacgcaagagcgaatccttggggcggggcgaggcgttggagatgcgtcctgcgggcgggacggtaacgcgggggcggggcggtgacgtgagcgggcaggctctggatctcggcgggatcaggccaggcagctgatcatagatctggagactcgagggagtcaggctcttcctttgttcatctcctgcttagaggacacaggccaggacatgctggcttcgtttctgcgaactaacaggcaagcagcaaagttgtcgaagccaaccctagaaaaccttaccccagtggtgctcagaccagagattcgcaaaccagaggttctcagaccggaaacacccagaccagtggacattggttctggaggatttggtgatgtcggtgctcttgagagtttgaggggaaatgcagatttggcttacatcctgagcatggagccctgtggccactgcctcattatcaacaatgtgaacttctgccgtgagtccgggctccgcacccgcactggctccaacatcgactgtgagaagttgcggcgtcgcttctcctcgctgcatttcatggtggaggtgaagggcgacctgactgccaagaaaatggtgctggctttgctggagctggcgcagcaggaccacggtgctctggactgctgcgtggtggtcattctctctcacggctgtcaggccagccacctgcagttcccaggggctgtctacggcacagatggatgccctgtgtcggtcgagaagattgtgaacatcttcaatgggaccagctgccccagcctgggagggaagcccaagctctttttcatccaggcctgtggtggggagcagaaagaccatgggtttgaggtggcctccacttcccctgaagacgagtcccctggcagtaaccccgagccagatgccaccccgttccaggaaggtttgaggaccttcgaccagctggacgccatatctagtttgcccacacccagtgacatctttgtgtcctactctactttcccaggttttgtttcctggagggaccccaagagtggctcctggtacgttgagaccctggacgacatctttgagcagtgggctcactctgaagacctgcagtccctcctgcttagggtcgctaatgctgtttcggtgaaagggatttataaacagatgcctggttgctttaatttcctccggaaaaaacttttctttaaaacatcataaggccagggcccctcaccctgccttatcttgcaccccaaagctttcctgccccaggcctgaaagaggctgaggcctggactttcctgca

SEQ ID NO: 831 - DNA, 781 bp, Homo sapiens
ttagttggctactcgccatggacgaagcggatcggcggctcctgcggcggtgccggctgcggctggtggaagagctgcaggtggaccagctctgggacgccctgctgagccgcgagctgttcaggccccatatgatcgaggacatccagcgggcaggctctggatctcggcgggatcaggccaggcagctgatcatagatctggagactcgagggagtcaggctcttcctttgttcatctcctgcttagaggacacaggccaggacatgctggcttcgtttctgcgaactaacaggcaagcagcaaagttgtcgaagccaaccctagaaaaccttaccccagtggtgctcagaccagagattcgcaaaccagaggttctcagaccggaaacacccagaccagtggacattggttctggaggatttggtgatgtcggtgctcttgagagtttgaggggaaatgcagatttggcttacatcctgagcatggagccctgtggccactgcctcattatcaacaatgtgaacttctgccgtgagtccgggctccgcacccgcactggctccaacatcgactgtgagaagttgcggcgtcgcttctcctcgctgcatttcatggtggaggtgaagggcgacctgactgccaaggccagccacctgcagttcccaggggctgtctacggcacagatggatgccctgtgtcggtcgagaagattgtgaacatcttcaatgggaccagctgccccagcctgggagggaagcccaagctctttttcatcca

SEQ ID NO: 832 - DNA, 954 bp, Homo sapiens
gcgcggaatggattctggggtcggcgcgaggcgctgagcgggcaggctctggatctcggcgggatcaggccaggcagctgatcatagatctggagactcgagggagtcaggctcttcctttgttcatctcctgcttagaggacacaggccaggacatgctggcttcgtttctgcgaactaacaggcaagcagcaaagttgtcgaagccaaccctagaaaaccttaccccagtggtgctcagaccagagattcgcaaaccagaggttctcagaccggaaacacccagaccagtggacattggttctggaggatttggtgatgtcggtgctcttgagagtttgaggggaaatgcagatttggcttacatcctgagcatggagccctgtggccactgcctcattatcaacaatgtgaacttctgccgtgagtccgggctccgcacccgcactggctccaacatcgactgtgagaagttgcggcgtcgcttctcctcgctgcatttcatggtggaggtgaagggcgacctgactgccaagaaaatggtgctggctttgctggagctggcgcagcaggaccacggtgctctggactgctgcgtggtggtcattctctctcacggctgtcaggccagccacctgcagttcccaggggctgtctacggcacagatggatgccctgtgtcggtcgagaagattgtgaacatcttcaatgggaccagctgccccagcctgggagggaagcccaagctctttttcatccaggcctgtggtggggagcagaaagaccatgggtttgaggtggcctccacttcccctgaagacgagtcccctggcagtaaccccgagccagatgccaccccgttccaggaaggtttgaggaccttcgaccagctggacgccatatctagtttgcccacacccagtgacatctttgtgtcctactctactttcccag

SEQ ID NO: 833 - DNA, 4463 bp, Homo sapiens
ttggccctgggggcggggcgaggcgcagaggtgcgtcctgagggcggggcggtgacgcaagagcgactcctgggggcggggcgaggccttggagatgcgtccggaggcggtggggagcgaagactgacccggggccgtgacgcgggggcaggccctggggcgggggcgggtcctggggactggggcgggcggccgaggcccggaagcggactgaggcggcctggagtcttagttggctactcgccatggacgaagcggatcggcggctcctgcggcggtgccggctgcggctggtggaagagctgcaggtggaccagctctgggacgccctgctgagccgcgagctgttcaggccccatatgatcgaggacatccagcgggcaggctctggatctcggcgggatcaggccaggcagctgatcatagatctggagactcgagggagtcaggctcttcctttgttcatctcctgcttagaggacacaggccaggacatgctggcttcgtttctgcgaactaacaggcaagcagcaaagttgtcgaagccaaccctagaaaaccttaccccagtggtgctcagaccagagattcgcaaaccagaggttctcagaccggaaacacccagaccagtggacattggttctggaggatttggtgatgtcggtgctcttgagagtttgaggggaaatgcagatttggcttacatcctgagcatggagccctgtggccactgcctcattatcaacaatgtgaacttctgccgtgagtccgggctccgcacccgcactggctccaacatcgactgtgagaagttgcggcgtcgcttctcctcgctgcatttcatggtggaggtgaagggcgacctgactgccaagaaaatggtgctggctttgctggagctggcgcagcaggaccacggtgctctggactgctgcgtggtggtcattctctctcacggctgtcaggccagccacctgcagttcccaggggctgtctacggcacagatggatgccctgtgtcggtcgagaagattgtgaacatcttcaatgggaccagctgccccagcctgggagggaagcccaagctctttttcatccaggcctgtggtggggagcagaaagaccatgggtttgaggtggcctccacttcccctgaagacgagtcccctggcagtaaccccgagccagatgccaccccgttccaggaaggtttgaggaccttcgaccagctggacgccatatctagtttgcccacacccagtgacatctttgtgtcctactctactttcccaggttttgtttcctggagggaccccaagagtggctcctggtacgttgagaccctggacgacatctttgagcagtgggctcactctgaagacctgcagtccctcctgcttagggtgagtgctgccttcctctgcaaaggagaggggaggctgctgaggggcagcgtgtcctcctggggctggggatttggggtgagcagggcaggcccaaaccaagggtaaaaggtagtagactcctgcctctgagccttggagtcggcacttttgtgtctctttatgagaggcatcctgcctgtggtgacgtttgccctttattcaaagagttgccttccctgtctcctccaaggtccccaggttgacacctcccgctcctccactgatggagctggtcctcagtgccagcgcaggatggctctgtccagaccctgaaggcgggtcatgggcccctccctatatcctgtgggcatcatgtagtcttctactcttgaccctcaagaattgtgaacccctccttgtacatcgccttctcaggaggccccagtgaggaaacagatagggaagggtggcctgataggcccagtcctactccatagaaacccgactcagagcagttgcttcctctgagggtcctgtggccttgtggctgccttgggaggcagcatgtatgggccccagctgctctgctcaggtattcatgccacgagaaggggctgcgaggctggggccactcctggctccttgcaaatatttcagtctgatttgaactttatgaatttggaaattttgaattttgagttttttaaaggtaaagttgaggtgcgtattctttaagccctcctgctcaaagaggctgcagtttgagctgtttttaaggtgcgggttgagtggacattccccccagcccctcttgaattcttccttcagtccagagaactgaactcacagagctctccatggtcatgtcttacaggtcgctaatgctgtttcggtgaaagggatttataaacagatgcctggttgctttaatttcctccggaaaaaacttttctttaaaacatcataaggccagggcccctcaccctgccttatcttgcaccccaaagctttcctgccccaggcctgaaagaggctgaggcctggactttcctgcaactcaaggactttgcagccggcacagggtctgctctttctctgccagtgacagacaggctcttagcagcttccagattgacgacaagtgctgaacagtggaggaagagggacagatgaatgccgtggattgcacgtggcctcttgagcagtggctggtccagggctagtgacttgtgtcccatgatccctgtgttgtctctagagcagggattaacctctgcactactgacatgtggggccaggtcaccctttgctgtgaggctgtcctgtacattgtgggatgttcagcactgtcccttgcctcaatgccagtaacgcgtcttcctgagtggtgccaaacaaaaaggttctcaggtgttgccaaatatgtcctggggtataaaactttcctcgcctgacaaccactggtctgtagggatttttggctacacacaaaccagtatcgctcatagatcagcaaaccggggcctactagagtctgaacagctgtaatctatgaattctaagtgaaattttaaaaattgttaatttttcctatattgcattaattttaaaaaataaatctgaggcaaatatggactctcttttgcctatttcttccctcattttgctccaactctttcttcttccttacaaaagagacttttgcttttttcgaaacatttccccatgtttttctggggtctcgctatgttgcccaggctggtctcaaactcctgggctcaagtgaccctcccaagtagctcttactacaggcgtgcaccattgcacccagccccatttattcatgtcttatttcacttgatccttatcccatcccaggaaggcaacaagggtgagaaccctgtgctcagggaggttaggtctcttgtccaagggaaaacgattatccagagaagagacctggccagaacctgggtcccctgagtcctagccatgcttcccatgtgccttacttgctgaagcacccccggactgcagtgtgaacgtgctgtgcaatagtgacacgctgggcttccccacaaggctccaccctgaggtcttttaagctgtccttatgccagcctatttcttgttttttgggcctttttttttggagatagggtctcactctgtcgcccaggctggagtgcaatgacgcaatcttggcttattgcagtctcgacctcctgggctcaagagatccttccacctcagccacctgagtagcttggactacaggtgtgcaccacctctcccagttaatttttgtatttttagtagagacagagttatgccatgttactcaggctggtcttgaactcctggactcaagcgatcagcctgccttagcctcccaaagtgcaggggttacaggcttgagccattgcgcctgacctatttctggttcttagggccctggatgttaggatggatttctgaattaataataataataaaaccctcatcaagatgtgatttgcatagttgtcactttatataatattattttccttctgtgacctttccaagtctgaaacagtcccagggacttcttttggttagttatttgcaatcacctgcaggacacacacacaagaaaattgtcaggttcacgtaaccacagagctgtgcgtggcagtttcctgtctctgtcctcctgggctaagctactcaagtgagtcacaggcagcccacactacagtagctcctgcctgaggagttcagatgatgtttcggagaaaaagatgcaatcacagcttttcattgacctgttagggtcttcctgtaaagggggtcttagccaggagtcctgtgtgggcttcaggtcagggggccttcgaaccccctaaaaattatatgccaaatgtgcggatggcatatttttagatttcatttgtttctcatcaaaactgctgtttgcaaggcagttatgcactgtggttggggctataactgtttccagaggctgttgatcagtatctgttaaactttttttttttttttttgagacagtcttgctctgttgcccagacgagtaca

SEQ ID NO: 834 - DNA, 3756 bp, Homo sapiens
tcctcctcctagccggactggagggagacaaagcagcgcccgtctgcttcgggcctctggaatttagcgctcgcccagctagccgcagaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctaaaacctgaagtggataagctgaacattatggcagccaaaagacaacaggaattgaaagatgttggccatcgtgatcagatggctgcagctagaggaatcctgcagaagaacgttccgatcctctatactgcatcccaggcatgcctacagcaccctgatgtcgcagcctataaggccaacagggacctgatatacaagcagctgcagcaggcggtcacaggcatttccaatgcagcccaggccactgcctcagacgatgcctcacagcaccagggtggaggaggaggagaactggcatatgcactcaataactttgacaaacaaatcattgtggaccccttgagcttcagcgaggagcgctttaggccttccctggaggagcgtctggaaagcatcattagtggggctgccttgatggccgactcgtcctgcacgcgtgatgaccgtcgtgagcgaattgtggcagagtgtaatgctgtccgccaggccctgcaggacctgctttcggagtacatgggcaatgctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttattaatgctgcactggctttagcagcaaaaccacagagtaaactggcccaagagaacatggatctttttaaagaacaatgggaaaaacaagtccgtgttctcacagatgctgtcgatgacattacttccattgatgacttcttggctgtctcagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataaggacccctgaggagttggatgactctgactttgagacagaagattttgatgtcagaagcaggacgagcgtccagacagaagacgatcagctgatagctggccagagtgcccgggcgatcatggctcagcttccccaggagcaaaaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccgaggtaaaggaccactcaaaaatacatcggatgtcatcagtgctgccaagaaaattgctgaggcaggatccaggatggacaagcttggccgcaccattgcagaccattgccccgactcggcttgcaagcaggacctgctggcctacctgcaacgcatcgccctctactgccaccagctgaacatctgcagcaaggtcaaggccgaggtgcagaatctcggcggggagcttgttgtctctggggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaaacataatgtatcatgaagaaaactgattctctatgacatgaaatgaaaattttaatgcattgttataattactaatgtacgctgctgcaggacattaataaagttgcttttttaggctacagtgtctcgatgccataatcagaacacactttttttcctctttctcccagcttcaaatgcaaattcatcattgggctcacttctaataactgcagtgtttcccgccttgggcttgcagcagaaaaacctgacaacatagtgtttgctaaggcagtaatttagactttaccttatttgtgattactgtagtgattgattgattgattactattaactacaaggtataatttactatcaccttatttaaattttatgaattaatttgaatgttttttacactaactaacttttcccaataaagtccactatgaaaccacgaca

SEQ ID NO: 835 - DNA, 2741 bp, Homo sapiens
tttcctcctcctagccggactggagggagacaaagcagcgcccgtctgcttcgggcctctggaatttagcgctcgcccagctagccgcagaaatgactgctgtccatgcaggcaacataaacttcaagtgggatcctaaaagtctagagatcaggactctggcagttgagagactgttggagcctcttgttacacaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctaaaacctgaagtggataagctgaacattatggcagccaaaagacaacaggaattgaaagatgttggccatcgtgatcagatggctgcagctagaggaatcctgcagaagaacgttccgatcctctatactgcatcccaggcatgcctacagcaccctgatgtcgcagcctataaggccaacagggacctgatatacaagcagctgcagcaggcggtcacaggcatttccaatgcagcccaggccactgcctcagacgatgcctcacagcaccagggtggaggaggaggagaactggcatatgcactcaataactttgacaaacaaatcattgtggaccccttgagcttcagcgaggagcgctttaggccttccctggaggagcgtctggaaagcatcattagtggggctgccttgatggccgactcgtcctgcacgcgtgatgaccgtcgtgagcgaattgtggcagagtgtaatgctgtccgccaggccctgcaggacctgctttcggagtacatgggcaatgctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttattaatgctgcactggctttagcagcaaaaccacagagtaaactggcccaagagaacatggatctttttaaagaacaatgggaaaaacaagtccgtgttctcacagatgctgtcgatgacattacttccattgatgacttcttggctgtctcagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataaggacccctgaggagttggatgactctgactttgagacagaagattttgatgtcagaagcaggacgagcgtccagacagaagacgatcagctgatagctggccagagtgcccgggcgatcatggctcagcttccccaggagcaaaaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccgaggtaaaggaccactcaaaaatacatcggatgtcatcagtgctgccaagaaaattgctgaggcaggatccaggatggacaagcttggccgcaccattgcagaccattgccccgactcggcttgcaagcaggacctgctggcctacctgcaacgcatcgccctctactgccaccagctgaacatctgcagcaaggtcaaggccgaggtgcagaatctcggcggggagcttgttgtctctggggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaa

SEQ ID NO: 836 - DNA, 696 bp, Homo sapiens
aggagggggttgggcagtcgctggcgctgccgctggtggtccctgtgcttgaagtgccggtggtatcggagtccatgcacccaaggcccagcacccagcaacattctctggcccagcagagggggttattgtgaagatcaaatgacacattccctttggaaactcttaaaggctttacaaaggataccccaaaccaagacagatgtctcacaaaacacaagcagagatgtcagtcttcaggcctcgcatggagaagatgaaagagaggggtggcttttccaaagcccagcgtcagcacgaagcttccacgagatgattttccctcttattttgaagtcctgaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttc

SEQ ID NO: 837 - DNA, 859 bp, Homo sapiens
ccccgggcgggcgtgggacccgcgtcgggccggcggtcccttcccccgcagggcccgagtatggggcccgggcgggcacggccggcgcttcccagcgctcgggaagtcggggggccgcctgggctggggaggagaaactataggcccagcgccgccgccgcgtttcctcttggaaaagttttctcgcggtttccaaactttgttaccgcggcctcggcgcgcgcggcagccccgcgccgggcccctcggccgccttccttccctggggcggcttgtctgggagccgctttcccgggaagtgattgtcgtccggctccgaggcgttcctgccccctcccccttcccggccgctgagacttcccgatggggcggcggggacgcgggctcggcgaaccgggaggctggagcccgggcttctcccatacagcttcgccgtagaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgat

SEQ ID NO: 838 - DNA, 719 bp, Homo sapiens
ggcggcggttggcccagttccaaggttgactccctcttacgtcctcttgcatcttggtgacatttttttgaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctaaaacctgaagtggataagctgaacattatggcagccaaaagacaacaggaattgaaagatgttggccatcgtgatcagatggctgcagctagaggaatcctgcagaa

SEQ ID NO: 839 - DNA, 868 bp, Homo sapiens
ccatttcctcctcctagccggactggagggagacaaagcagcgcccgtctgcttcgggcctctggaatttagcgctcgcccagctagccgcaggaagaatgaagaatgagtgtaggagttacctatagtttctgcctaattatttaccaatctggacttttgaacaaacattttttttaaagacggggtctccgtcgcccgggctggagcgcagtgacacgatcatgactcactgcggcttctgtctcctgggctcaagtgatccccccacctcggcttccgaagtagttgggactacaggcacgcgccaccacatccgtctaatttttgtatttttggtagagatggtgtctcgctgtcttgcccaagctggtctcgaactcctgggctcaagtggtcctcctgcctcagcctcccaaagtgttgtgattacaggcctgagccagggtgcctgaccccatctggatatttattcagcgaaagaataattttttaatccacctaagagctcacagtgtaataggggagacacacaccccaggtgtagtacagagcggactgcaaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggt

SEQ ID NO: 840 - DNA, 642 bp, Homo sapiens
gggcagtcgctggcgctgccgctggtggtccctgtgcttgaagtgccggtggtatcggagtccatgcacccaaggcccagcacccagcaacattctctggcccagcagaggggataccccaaaccaagacagatgtctcacaaaacacaagcagagatgtcagtcttcaggcctcgcatggagaagatgaaagagaggggtggcttttccaaagcccagcgtcagcacgaagcttccacgagatgattttccctcttattttgaagtcctgaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaac

SEQ ID NO: 841 - DNA, 545 bp, Homo sapiens
accgctcctcctccctctcaggggtcactcccggcctaagctcccactaggggccggggaggaaggaattctgagaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagtt

SEQ ID NO: 842 - DNA, 483 bp, Homo sapiens
agttccaggcagagggaacagccaaggcaagagcactgaggataccccaaaccaagacagatgtctcacaaaacacaagcagagatgtcagtcttcaggcctcgcatggagaagatgaaagagaggggtggcttttccaaagcccagcgtcagcacgaagcttccacgagatgattttccctcttattttgaagtcctgaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgta

SEQ ID NO: 843 - DNA, 3800 bp, Homo sapiens
gagacaaagcagcgcccgtctgcttcgggcctctggaatttagcgctcgcccagctagccgcagaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctaaaacctgaagtggataagctgaacattatggcagccaaaagacaacaggaattgaaagatgttggccatcgtgatcagatggctgcagctagaggaatcctgcagaagaacgttccgatcctctatactgcatcccaggcatgcctacagcaccctgatgtcgcagcctataaggccaacagggacctgatatacaagcagctgcagcaggcggtcacaggcatttccaatgcagcccaggccactgcctcagacgatgcctcacagcaccagggtggaggaggaggagaactggcatatgcactcaataactttgacaaacaaatcattgtggaccccttgagcttcagcgaggagcgctttaggccttccctggaggagcgtctggaaagcatcattagtggggctgccttgatggccgactcgtcctgcacgcgtgatgaccgtcgtgagcgaattgtggcagagtgtaatgctgtccgccaggccctgcaggacctgctttcggagtacatgggcaatgctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttattaatgctgcactggctttagcagcaaaaccacagagtaaactggcccaagagaacatggatctttttaaagaacaatgggaaaaacaagtccgtgttctcacagatgctgtcgatgacattacttccattgatgacttcttggctgtctcagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataaggacccctgaggagttggatgactctgactttgagacagaagattttgatgtcagaagcaggacgagcgtccagacagaagacgatcagctgatagctggccagagtgcccgggcgatcatggctcagcttccccaggagcaaaaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccgaggtaaaggaccactcaaaaatacatcggatgtcatcagtgctgccaagaaaattgctgaggcaggatccaggatggacaagcttggccgcaccattgcagaccattgccccgactcggcttgcaagcaggacctgctggcctacctgcaacgcatcgccctctactgccaccagctgaacatctgcagcaaggtcaaggccgaggtgcagaatctcggcggggagcttgttgtctctgggaactgtgacacctgcggggcactgcaagggctgaaaggctggcctcctcccctttgcgccactcactgggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaaacataatgtatcatgaagaaaactgattctctatgacatgaaatgaaaattttaatgcattgttataattactaatgtacgctgctgcaggacattaataaagttgcttttttaggctacagtgtctcgatgccataatcagaacacactttttttcctctttctcccagcttcaaatgcaaattcatcattgggctcacttctaataactgcagtgtttcccgccttgggcttgcagcagaaaaacctgacaacatagtgtttgctaaggcagtaatttagactttaccttatttgtgattactgtagtgattgattgattgattactattaactacaaggtataatttactatcaccttatttaaattttatgaattaatttgaatgttttttacactaactaacttttcccaataaagtccactatgaaaccacgac

SEQ ID NO: 844 - DNA, 2684 bp, Homo sapiens
ctgccgattctgcatagagagatcatctaaatgggcagaagcctgcacaatttatgaagtgctgatttaacaccagcctatgcaaggctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttattaatgctgcactggctttagcagcaaaaccacagagtaaactggcccaagagaacatggatctttttaaagaacaatgggaaaaacaagtccgtgttctcacagatgctgtcgatgacattacttccattgatgacttcttggctgtctcagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataaggacccctgaggagttggatgactctgactttgagacagaagattttgatgtcagaagcaggacgagcgtccagacagaagacgatcagctgatagctggccagagtgcccgggcgatcatggctcagcttccccaggagcaaaaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccgaggtaaaggaccactcaaaaatacatcggatgtcatcagtgctgccaagaaaattgctgaggcaggatccaggatggacaagcttggccgcaccattgcagaccattgccccgactcggcttgcaagcaggacctgctggcctacctgcaacgcatcgccctctactgccaccagctgaacatctgcagcaaggtcaaggccgaggtgcagaatctcggcggggagcttgttgtctctggggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaaacataatgtatcatgaagaaaactgattctctatgacatgaaatgaaaattttaatgcattgttataattactaatgtacgctgctgcaggacattaataaagttgcttttttaggctacagtgtctcgatgccataatcagaacacactttttttcctctttctcccagcttcaaatgcaaattcatcattgggctcacttctaataactgcagtgtttcccgccttgggcttgcagcagaaaaacctgacaacatagtgtttgctaaggcagtaatttagactttaccttatttgtgattactgtagtgattgattgattgattactattaactacaaggtataatttactatcaccttatttaaattttatgaattaatttgaatgttttttacactaactaacttttcccaataaagtccactatgaaacc

SEQ ID NO: 845 - DNA, 3686 bp, Homo sapiens
gagacaaagcagcgcccgtctgcttcgggcctctggaatttagcgctcgcccagctagccgcagaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgaaagttgtggaagatggtatcttgaagttgaggaatgctggcaatgaacaagacttaggaatccagtataaagccctaaaacctgaagtggataagctgaacattatggcagccaaaagacaacaggaattgaaagatgttggccatcgtgatcagatggctgcagctagaggaatcctgcagaagaacgttccgatcctctatactgcatcccaggcatgcctacagcaccctgatgtcgcagcctataaggccaacagggacctgatatacaagcagctgcagcaggcggtcacaggcatttccaatgcagcccaggccactgcctcagacgatgcctcacagcaccagggtggaggaggaggagaactggcatatgcactcaataactttgacaaacaaatcattgtggaccccttgagcttcagcgaggagcgctttaggccttccctggaggagcgtctggaaagcatcattagtggggctgccttgatggccgactcgtcctgcacgcgtgatgaccgtcgtgagcgaattgtggcagagtgtaatgctgtccgccaggccctgcaggacctgctttcggagtacatgggcaatgctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttattaatgctgcactggctttagcagcaaaaccacagagtaaactggcccaagagaacatggatctttttaaagaacaatgggaaaaacaagtccgtgttctcacagatgctgtcgatgacattacttccattgatgacttcttggctgtctcagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataaggacccctgaggagttggatgactctgactttgagacagaagattttgatgtcagaagcaggacgagcgtccagacagaagacgatcagctgatagctggccagagtgcccgggcgatcatggctcagcttccccaggagcaaaaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccgaggtaaaggaccactcaaaaatacatcggatgtcatcagtgctgccaagaaaattgctgaggcaggatccaggatggacaagcttggccgcaccattgcagaccattgccccgactcggcttgcaagcaggacctgctggcctacctgcaacgcatcgccctctactgccaccagctgaacatctgcagcaaggtcaaggccgaggtgcagaatctcggcggggagcttgttgtctctggggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaaacataatgtatcatgaagaaaactgattctctatgacatgaaatgaaaattttaatgcattgttataattactaatgtacgctgctgcaggacattaataaagttgcttttttaggctacagtgtctcgatgccataatcagaacacactttttttcctctttctcccagcttcaaatgcaaattcatcattgggctcacttctaataactgcagtgtttcccgccttgggcttgcagcagaaaaacctgacaacatagtgtttgctaaggcagtaatttagactttaccttatttgtgattactgtagtgattgattgattgattactattaactacaaggtataatttactatcaccttatttaaattttatgaattaatttgaatgttttttacactaactaacttttcccaataaagtccactatgaaaccacgac

SEQ ID NO: 846 - DNA, 3729 bp, Homo sapiens
gccggtggcggcaggatacagcggcttctgcgcgacttataagagctccttgtgcggcgccattttaagcctctcggtctgtggcagcagcgttggcccggccccgggagcggagagcgaggggaggcggagacggaggaaggtctgaggagcagcttcagtccccgccgagccgccaccgcaggtcgaggacggtcggactcccgcggcgggaggagcctgttcccctgagggtatttgaagtataccatacaactgttttgaaaatccagcgtggacaatggctactcaagctgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttaggtaagaagttttaaaaagccagtttgggtaaaatacttttactctgcctacagaacttcagaaagacttggttggtagggtgggagtggtttaggctatttgtaaatctgccacaaaaacaggtatatactttgaaaggagatgtcttggaacattggaatgttctcagatttctggttgttatgtgatcatgtgtggaagttattaactttaatgttttttgccacagcttttgcaacttaatactcaaatgagtaacatttgctgttttaaacattaatagcagcctttctctctttatacagctgtattgtctgaacttgcattgtgattggcctgtagagttgctgagagggctcgaggggtgggctggtatctcagaaagtgcctgacacactaaccaagctgagtttcctatgggaacaattgaagtaaactttttgttctggtcctttttggtcgaggagtaacaatacaaatggattttgggagtgactcaagaagtgaagaatgcacaagaatggatcacaagatggaatttatcaaaccctagccttgcttgttaaatttttttttttttttttttaagaatatctgtaatggtactgactttgcttgctttgaagtagctctttttttttttttttttttttttttgcagtaactgttttttaagtctctcgtagtgttaagttatagtgaatactgctacagcaatttctaatttttaagaattgagtaatggtgtagaacactaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcattcga

SEQ ID NO: 847 - DNA, 3268 bp, Homo sapiens
gctgcgccggtggcggcaggatacagcggcttctgcgcgacttataagagctccttgtgcggcgccattttaagcctctcggtctgtggcagcagcgttggcccggccccgggagcggagagcgaggggaggcggagacggaggaaggtctgaggagcagcttcagtccccgccgagccgccaccgcaggtcgaggacggtcggactcccgcggcgggaggagcctgttcccctgagggtatttgaagtataccatacaactgttttgaaaatccagcgtggacaatggctactcaagctgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttaggagtaacaatacaaatggattttgggagtgactcaagaagtgaagaatgcacaagaatggatcacaagatggaatttatcaaaccctagccttgcttgttaaatttttttttttttttttttaagaatatctgtaatggtactgactttgcttgctttgaagtagctctttttttttttttttttttttttttgcagtaactgttttttaagtctctcgtagtgttaagttatagtgaatactgctacagcaatttctaatttttaagaattgagtaatggtgtagaacactaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcattc

SEQ ID NO: 848 - DNA, 3356 bp, Homo sapiens
aagcctctcggtctgtggcagcagcgttggcccggccccgggagcggagagcgaggggaggcggagacggaggaaggtctgaggagcagcttcagtccccgccgagccgccaccgcaggtcgaggacggtcggactcccgcggcgggaggagcctgttcccctgagggtatttgaagtataccatacaactgttttgaaaatccagcgtggacaatggctactcaagctgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttagctgtattgtctgaacttgcattgtgattggcctgtagagttgctgagagggctcgaggggtgggctggtatctcagaaagtgcctgacacactaaccaagctgagtttcctatgggaacaattgaagtaaactttttgttctggtcctttttggtcgaggagtaacaatacaaatggattttgggagtgactcaagaagtgaagaatgcacaagaatggatcacaagatggaatttatcaaaccctagccttgcttgttaaatttttttttttttttttttaagaatatctgtaatggtactgactttgcttgctttgaagtagctctttttttttttttttttttttttttgcagtaactgttttttaagtctctcgtagtgttaagttatagtgaatactgctacagcaatttctaatttttaagaattgagtaatggtgtagaacactaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcattc

SEQ ID NO: 849 - DNA, 2513 bp, Homo sapiens
aaagagggacggaatactgcagtgctagggtgctggagtccagaaatgattttttcgatgaatttaggattttgccgcagtatacatctgcagtcccagaatcctccgggtatttgaagtataccatacaactgttttgaaaatccagcgtggacaatggctactcaagctgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatccttta

SEQ ID NO: 850 - DNA, 634 bp, Homo sapiens
aggtactcctaaggacttgttgaattgcgggcttggcgcccgttctacggagagttcacagccttcgtgagtggggacagaaggcggctcggcccggtgattcaggtcgaaattcaagctgaacagcctgctgagagggtatttgaagtataccatacaactgttttgaaaatccagcgtggacaatggctactcaagctgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccac

SEQ ID NO: 851 - DNA, 596 bp, Homo sapiens
acataattttttgtttaagatccagtaagactccctgtttttaatacatataaagcaacagacatgtatatgtcgataaactgagggtttgcgtccctattgcctggtgcaagctacagcaaaaaaccggtgatatcacatctacaaatctcaatggattcaaaaacaatatgaaaatttttagctgacaagaacatgtctgctgcctgcagtccctgcaatagctcaccatgttgcctactaaccaaaagatcaaaaattatcgatttcatggcgctgcgaggtctggaaagaaaagctactttaaaatttgcattgtttaagaaatgacttaaaagaaaagaatcatttttttttctgaatactttggaaggtgaaaatggcttgttttaatcttatccatgatttactataattctattatttttagcagctggagtccagaaatgattttttcgatgaatttaggattttgccgcagtatacatctgcagtcccagaatcctccgggtatttgaagtataccatacaactgttttgaaaatccagcgtggacaatggctactcaagctgatttgatggagttggacatggcc

SEQ ID NO: 852 - DNA, 608 bp, Homo sapiens
aaaattttcctgaagtgattggtaagttttggctaattgggagcactagaattgggcccttaatggttggcagggtgtggtggaggagagacagcccttagtccaaaggctcaggccagaaaaagaaagaggaaggctttccttttcctttccggagcagggttctgccctaggtcttgcttggcagtctatttgatttctttagcagttaatgctcagttttttggcatatgtggatctgcctccagagcaggtacaagggtatttgaagtataccatacaactgttttgaaaatccagcgtggacaatggctactcaagctgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccct

SEQ ID NO: 853 - DNA, 645 bp, Homo sapiens
agttggggttcgggcgctgaggcagagacgccaccctaagtcccatcagtcctggggatcggaccagtggactttctcttaagatttcctctttcattcttaagaatagaagtgttattattttttttaatgccctggctatgtgagtttgaatcgaagcaactttaaaccttagagcaactaaactctaagtgcagcgggtgcgatgcgtcagtagggtgagcacataaaaaatccatgtcttgcacctgtattttagcgtactatgcagggtatttgaagtataccatacaactgttttgaaaatccagcgtggacaatggctactcaagctgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagat

SEQ ID NO: 854 - DNA, 2841 bp, Homo sapiens
ggcggcaggatacagcggcttctgcgcgacttataagagctccttgtgcggcgccattttaagcctctcggtctgtggcagcagcgttggcccggccccgggagcggagagcgaggggaggcggagacggaggaaggtctgaggagcagcttcagtccccgccgagccgccaccgcaggtcgaggacggtcggactcccgcggcgggaggagcctgttcccctgagggtatttgaagtataccatacaactgttttgaaaatccagcgtggacaatggctactcaaggctaccttttgctccattttctgctcactcctcctaatggcttggtgaaatagcaaacaagccaccagcaggaatctagtctggatgactgcttctggagcctggatgcagtaccattcttccactgattcactgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttagctgtattgtctgaacttgcattgtgattggcctgtagagttgctgagagggctcgaggggtgggctggtatctcaga

SEQ ID NO: 855 - DNA, 2028 bp, Homo sapiens
ggctccggcaaccgctccggcaacgccaaccgctccgctgcgcgcaggctgggctgcaggctctcggctgcagcgctgggtgtcttcaggcctatggagagcagcttgcgtgggctgggcctgcagtacctggtttgcatagatgattggcaggtgggcagcacggggaaggacctgtgagtggccaacctggttcaggtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccggatctgcatccacaccaatgcgcacgtcagcgtggaggtgtcggcggaggacctgctcacatgctgtggcagcatgtgtggggacggctgtaatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagtgtaccaacacgtcaccggagagatgatgggtggccatgccatccgcatcctgggctggggagtggagaatggcacaccctactggctggttgccaactcctggaacactgactggggtgacaatggcttctttaaaatactcagaggacaggatcactgtggaatcgaatcagaagtggtggctggaattccacgcaccgatcagtactgggaaaagatctaatctgccgtgggcctgtcgtgccagtcctgggggcgagatcggggtagaaatgcattttattctttaagttcacgtaagatacaagtttcagacagggtctgaaggactggattggccaaacatcagacctgtcttccaaggagaccaagtcctggctacatcccagcctgtggttacagtgcagacaggccatgtgagccaccgctgccagcacagagcgtccttccccctgtagactagtgccgtagggagtacctgctgccccagctgactgtggccccctccgtgatccatccatctccagggagcaagacagagacgcaggaatggaaagcggagttcctaacaggatgaaagttcccccatcagttcccccagtacctccaagcaagtagctttccacatttgtcacagaaatcagaggagagacggtgttgggagccctttggagaacgccagtctcccaggccccctgcatctatcgagtttgcaatgtcacaacctctctgatcttgtgctcagcatgattctttaatagaagttttattttttcgtgcactctgctaatcatgtgggtgagccagtggaacagcgggagacctgtgctagttttacagattgcctccttatgacgcggctcaaaaggaaaccaagtggtcaggagttgtttctgacccactgatctctactaccacaaggaaaatagtttaggagaaaccagcttttactgtttttgaaaaattacagcttcaccctgtcaagttaacaaggaatgcctgtgccaa

SEQ ID NO: 856 - DNA, 3591 bp, Homo sapiens
gggcggcggaaggtggcgggagggggtgggggctgggaagcaccgtgcgcgggcggcgggagggcccgggcggggctgcgcggtggtcacgtggggcggggccgggagggtacttagggccggggctggcccaggctacggcggctgcagggctccggcaaccgctccggcaacgccaaccgctccgctgcgcgcaggctgggctgcaggctctcggctgcagcgctgggtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccggatctgcatccacaccaatgcgcacgtcagcgtggaggtgtcggcggaggacctgctcacatgctgtggcagcatgtgtggggacggctgtaatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagtgtaccaacacgtcaccggagagatgatgggtggccatgccatccgcatcctgggctggggagtggagaatggcacaccctactggctggttgccaactcctggaacactgactggggtgacaatggcttctttaaaatactcagaggacaggatcactgtggaatcgaatcagaagtggtggctggaattccacgcaccgatcagtactgggaaaagatctaatctgccgtgggcctgtcgtgccagtcctgggggcgagatcggggtagaaatgcattttattctttaagttcacgtaagatacaagtttcagacagggtctgaaggactggattggccaaacatcagacctgtcttccaaggagaccaagtcctggctacatcccagcctgtggttacagtgcagacaggccatgtgagccaccgctgccagcacagagcgtccttccccctgtagactagtgccgtagggagtacctgctgccccagctgactgtggccccctccgtgatccatccatctccagggagcaagacagagacgcaggaatggaaagcggagttcctaacaggatgaaagttcccccatcagttcccccagtacctccaagcaagtagctttccacatttgtcacagaaatcagaggagagacggtgttgggagccctttggagaacgccagtctcccaggccccctgcatctatcgagtttgcaatgtcacaacctctctgatcttgtgctcagcatgattctttaatagaagttttattttttcgtgcactctgctaatcatgtgggtgagccagtggaacagcgggagacctgtgctagttttacagattgcctccttatgacgcggctcaaaaggaaaccaagtggtcaggagttgtttctgacccactgatctctactaccacaaggaaaatagtttaggagaaaccagcttttactgtttttgaaaaattacagcttcaccctgtcaagttaacaaggaatgcctgtgccaataaaagttttctccaacttgaagtctactctgatgggatctcagatcctttgtcactgcctatagacttgtagctgctgtctctctttgtccctgcagagaatcacgtcctggaactgcatgttcttgcgactcttgggacttcatcttaacttctcgctgccccagccatgttttcaaccatggcatccctcccccaattagttccctgtcatcctcgtcaaccttctctgtaagtgcctggtaagcttgcccttgcttaagaactcaaaacatagctgtgctctatttttttgttgttgttgtgactgacagagtgagattccgtctcccaggctggagtgcagtggcgccttctcagctcactgcaacctgcagcctcctagattcaagcgattctcctgcttcagccttccgagtagctgggatgacaggcactcaccaatatgcctgggtaatttttgtatttttaagtacatacaggatttcaccatgttggccaggctagtttcaaactcccggcctcaggtggtctgcctgcctcagcctcccaaagtgttgggattacaggcgtgagccactgggccctgcctgtattttttatcagccacaaatccagcaacaagctgaggattcagctcataaaacaggcttggtgtcttggtgatctcacataaccaagatgctaccccgtggggaaccacatccccctggatgccctccagccttggtttgggctggagtcagggcctgtatacagtattttgaatttgtatgccactggtttgcattgctggtcaggaactctagtgctttgcatagccctggtttagaaacatgttatagcagttcttggtatagagcaaactagaagaaccagcaatcattccactgtcctgccaaggtacacctcagtactccccttcccaactgaagtggtatgaggctagctctttccaaaagcattcaagtttggcttctgatgtgactcagaatttaggaaccagatgctagatcaaataagctctgaaaatctgaggaacattgtaggaaaggtttgttaagcatctcttaagtgccatgatgagcataacagccggccgtcgtggctcacgcctgtaatcccagcactttgggaggccaaggtgggaggatgacaaggtcaggagttcaagaccagcctggccaacatgctgaaacctcacctctactaaaaatacaaaaattagctgggcatggtggcacatgcctgtaatcccagctacttgggaggctgaggcaggagaatcgcttgaacccgggaggcggaggttgcagtgagccaagacagtgccagtgcactccagcctcggtgacagcgcaaggctccgtctcaataattaaaaaaaaaaaaaaaaaaaaaaaggccgggcgcagtggctcaagcctgtaatcccagcactttgggaggctgaggcgggcagatcacctgaggtcaggagttttgagatcagccttggcaacacggtgaaaccccatctctactaaaaatac

SEQ ID NO: 857 - DNA, 1772 bp, Homo sapiens
cgacccacataacagagaggtgtcctgatgccctctgtcctctccaggtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctggctgtaatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagtgtaccaacacgtcaccggagagatgatgggtggccatgccatccgcatcctgggctggggagtggagaatggcacaccctactggctggttgccaactcctggaacactgactggggtgacaatggcttctttaaaatactcagaggacaggatcactgtggaatcgaatcagaagtggtggctggaattccacgcaccgatcagtactgggaaaagatctaatctgccgtgggcctgtcgtgccagtcctgggggcgagatcggggtagaaatgcattttattctttaagttcacgtaagatacaagtttcagacagggtctgaaggactggattggccaaacatcagacctgtcttccaaggagaccaagtcctggctacatcccagcctgtggttacagtgcagacaggccatgtgagccaccgctgccagcacagagcgtccttccccctgtagactagtgccgtagggagtacctgctgccccagctgactgtggccccctccgtgatccatccatctccagggagcaagacagagacgcaggaatggaaagcggagttcctaacaggatgaaagttcccccatcagttcccccagtacctccaagcaagtagctttccacatttgtcacagaaatcagaggagagacggtgttgggagccctttggagaacgccagtctcccaggccccctgcatctatcgagtttgcaatgtcacaacctctctgatcttgtgctcagcatgattctttaatagaagttttattttttcgtgcactctgctaatcatgtgggtgagccagtggaacagcgggagacctgtgctagttttacagattgcctccttatgacgcggctcaaaaggaaaccaagtggtcaggagttgtttctgacccactgatctctactaccacaaggaaaatagtttaggagaaaccagcttttactgtttttgaaaaattacagcttcaccctgtcaagttaacaaggaatgcctgtgccaataaaagttttctcc

SEQ ID NO: 858 - DNA, 3859 bp, Homo sapiens
ggggcggggccgggagggtacttagggccggggctggcccaggctacggcggctgcagggctccggcaaccgctccggcaacgccaaccgctccgctgcgcgcaggctgggctgcaggctctcggctgcagcgctgggtgagtgctggggacccggggccaccgcagcgtaagtgacccagagaggtgtcctgatgccctctgtcctctccaggtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccggatctgcatccacaccaatgcgcacgtcagcgtggaggtgtcggcggaggacctgctcacatgctgtggcagcatgtgtggggacggctgtaatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagtgtaccaacacgtcaccggagagatgatgggtggccatgccatccgcatcctgggctggggagtggagaatggcacaccctactggctggttgccaactcctggaacactgactggggtgacaatggcttctttaaaatactcagaggacaggatcactgtggaatcgaatcagaagtggtggctggaattccacgcaccgatcagtactgggaaaagatctaatctgccgtgggcctgtcgtgccagtcctgggggcgagatcggggtagaaatgcattttattctttaagttcacgtaagatacaagtttcagacagggtctgaaggactggattggccaaacatcagacctgtcttccaaggagaccaagtcctggctacatcccagcctgtggttacagtgcagacaggccatgtgagccaccgctgccagcacagagcgtccttccccctgtagactagtgccgtagggagtacctgctgccccagctgactgtggccccctccgtgatccatccatctccagggagcaagacagagacgcaggaatggaaagcggagttcctaacaggatgaaagttcccccatcagttcccccagtacctccaagcaagtagctttccacatttgtcacagaaatcagaggagagacggtgttgggagccctttggagaacgccagtctcccaggccccctgcatctatcgagtttgcaatgtcacaacctctctgatcttgtgctcagcatgattctttaatagaagttttattttttcgtgcactctgctaatcatgtgggtgagccagtggaacagcgggagacctgtgctagttttacagattgcctccttatgacgcggctcaaaaggaaaccaagtggtcaggagttgtttctgacccactgatctctactaccacaaggaaaatagtttaggagaaaccagcttttactgtttttgaaaaattacagcttcaccctgtcaagttaacaaggaatgcctgtgccaataaaagttttctccaacttgaagtctactctgatgggatctcagatcctttgtcactgcctatagacttgtagctgctgtctctctttgtccctgcagagaatcacgtcctggaactgcatgttcttgcgactcttgggacttcatcttaacttctcgctgccccagccatgttttcaaccatggcatccctcccccaattagttccctgtcatcctcgtcaaccttctctgtaagtgcctggtaagcttgcccttgcttaagaactcaaaacatagctgtgctctatttttttgttgttgttgtgactgacagagtgagattccgtctcccaggctggagtgcagtggcgccttctcagctcactgcaacctgcagcctcctagattcaagcgattctcctgcttcagccttccgagtagctgggatgacaggcactcaccaatatgcctgggtaatttttgtatttttaagtacatacaggatttcaccatgttggccaggctagtttcaaactcccggcctcaggtggtctgcctgcctcagcctcccaaagtgttgggattacaggcgtgagccactgggccctgcctgtattttttatcagccacaaatccagcaacaagctgaggattcagctcataaaacaggcttggtgtcttggtgatctcacataaccaagatgctaccccgtggggaaccacatccccctggatgccctccagccttggtttgggctggagtcagggcctgtatacagtattttgaatttgtatgccactggtttgcattgctggtcaggaactctagtgctttgcatagccctggtttagaaacatgttatagcagttcttggtatagagcaaactagaagaaccagcaatcattccactgtcctgccaaggtacacctcagtactccccttcccaactgaagtggtatgaggctagctctttccaaaagcattcaagtttggcttctgatgtgactcagaatttaggaaccagatgctagatcaaataagctctgaaaatctgaggaacattgtaggaaaggtttgttaagcatctcttaagtgccatgatgagcataacagccggccgtcgtggctcacgcctgtaatcccagcactttgggaggccaaggtgggaggatgacaaggtcaggagttcaagaccagcctggccaacatgctgaaacctcacctctactaaaaatacaaaaattagctgggcatggtggcacatgcctgtaatcccagctacttgggaggctgaggcaggagaatcgcttgaacccgggaggcggaggttgcagtgagccaagacagtgccagtgcactccagcctcggtgacagcgcaaggctccgtctcaataattaaaaaaaaaaaaaaaaaaaaaaaggccgggcgcagtggctcaagcctgtaatcccagcactttgggaggctgaggcgggcagatcacctgaggtcaggagttttgagatcagccttggcaacacggtgaaaccccatctctactaaaaatacaaaattagccaagcatgctggcacatgcctgtaatcccagctactcgggaggctgaggtacgagaatcgcttgaacctgggaggcagaggatgcagtgagccgagatcacgccattgcactccagcctgggggacaagagtgaatctgtgtctcaccaaaaaaaaaaagaaaaagaaagatgcttaacaaaggttaccataagccacaaattcataaccacttatccttccagtttcaagtagaatatattcataacctcaataaagttctccctgctcccaaa

SEQ ID NO: 859 - DNA, 2011 bp, Homo sapiens
ggctgcagggctccggcaaccgctccggcaacgccaaccgctccgctgcgcgcaggctgggctgcaggctctcggctgcagcgctgggtgtcttcaggcctatggagagcagcttgcgtgggctgggcctgcagtacctggtttgcatagatgattggcaggtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccggatctgcatccacaccaatgcgcacgtcagcgtggaggtgtcggcggaggacctgctcacatgctgtggcagcatgtgtggggacggctgtaatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagtgtaccaacacgtcaccggagagatgatgggtggccatgccatccgcatcctgggctggggagtggagaatggcacaccctactggctggttgccaactcctggaacactgactggggtgacaatggcttctttaaaatactcagaggacaggatcactgtggaatcgaatcagaagtggtggctggaattccacgcaccgatcagtactgggaaaagatctaatctgccgtgggcctgtcgtgccagtcctgggggcgagatcggggtagaaatgcattttattctttaagttcacgtaagatacaagtttcagacagggtctgaaggactggattggccaaacatcagacctgtcttccaaggagaccaagtcctggctacatcccagcctgtggttacagtgcagacaggccatgtgagccaccgctgccagcacagagcgtccttccccctgtagactagtgccgtagggagtacctgctgccccagctgactgtggccccctccgtgatccatccatctccagggagcaagacagagacgcaggaatggaaagcggagttcctaacaggatgaaagttcccccatcagttcccccagtacctccaagcaagtagctttccacatttgtcacagaaatcagaggagagacggtgttgggagccctttggagaacgccagtctcccaggccccctgcatctatcgagtttgcaatgtcacaacctctctgatcttgtgctcagcatgattctttaatagaagttttattttttcgtgcactctgctaatcatgtgggtgagccagtggaacagcgggagacctgtgctagttttacagattgcctccttatgacgcggctcaaaaggaaaccaagtggtcaggagttgtttctgacccactgatctctactaccacaaggaaaatagtttaggagaaaccagcttttactgtttttgaaaaattacagcttcaccctgtcaagttaacaaggaatgcctgtgccaataaaagttttctccaacttg

SEQ ID NO: 860 - DNA, 1387 bp, Homo sapiens
ggccggggctggcccaggctacggcggctgcagggctccggcaaccgctccggcaacgccaaccgctccgctgcgcgcaggctgggctgcaggctctcggctgcagcgctgggtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccggatctgcatccacaccaatgcgcacgtcagcgtggaggtgtcggcggaggacctgctcacatgctgtggcagcatgtgtggggacggctgtaatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagtgtaccaacacgtcaccggagagatgatgggtggccatgccatccgcatcctgggctggggagtggagaatggcacaccctactggctggttgccaactcctggaacactgactggggtgacaatggcttctttaaaatactcagaggacaggatcactgtggaatcgaatcagaagtggtggctggaattccacgcaccgatcagtactgggaaaagatctaatctgccgtgggcctgtcgtgccagtcctgggggcgagatcgggagaatcacgtcctggaactgcatgttcttgcgactcttgggacttcatcttaacttctcgctgccccagccatgttttcaaccatggcatccctcccccaattagttccctgtcatcctcgtcaaccttctctgtaagtgcctggtaagcttgcccttgcttaagaactcaaaacatagctgtgctc

SEQ ID NO: 861 - DNA, 1436 bp, Homo sapiens
ggccggggctggcccaggctacggcggctgcagggctccggcaaccgctccggcaacgccaaccgctccgctgcgcgcaggctgggctgcaggctctcggctgcagcgctgggctggtgtgcagtggtgcgaccacggctcacggcagcctcagccacccagatgtaagcgatctggttcccacctcagcctcccgagtagtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccggatctgcatccacaccaatgcgcacgtcagcgtggaggtgtcggcggaggacctgctcacatgctgtggcagcatgtgtggggacggctgtaatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagtgtaccaacacgtcaccggagagatgatgggtggccatgccatccgcatcctgggctggggagtggagaatggcacaccctactggctggttgccaactcctggaacactgactggggtgacaatggcttctttaaaatactcagaggacaggatcactgtggaatcgaatcagaagtggtggctggaattccacgcaccgatcagtactgggaaaagatctaatctgccgtgggcctgtcgtgccagtcctgggggcgagatcgggagaatcacgtcctggaactgcatgttcttgcgactcttgggacttcatcttaacttctcgctgccccagccatgttttcaaccatggcatccctcccccaattagttccctgtcatcctcgtcaaccttctctgtaagtgcctggtaa

SEQ ID NO: 862 - DNA, 2009 bp, Homo sapiens
ggctggcccaggctacggcggctgcagggctccggcaaccgctccggcaacgccaaccgctccgctgcgcgcaggctgggctgcaggctctcggctgcagcgctgggctggtgtgcagtggtgcgaccacggctcacggcagcctcagccacccagatgtaagcgatctggttcccacctcagcctcccgagtagtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccggatctgcatccacaccaatgcgcacgtcagcgtggaggtgtcggcggaggacctgctcacatgctgtggcagcatgtgtggggacggctgtaatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagtgtaccaacacgtcaccggagagatgatgggtggccatgccatccgcatcctgggctggggagtggagaatggcacaccctactggctggttgccaactcctggaacactgactggggtgacaatggcttctttaaaatactcagaggacaggatcactgtggaatcgaatcagaagtggtggctggaattccacgcaccgatcagtactgggaaaagatctaatctgccgtgggcctgtcgtgccagtcctgggggcgagatcggggtagaaatgcattttattctttaagttcacgtaagatacaagtttcagacagggtctgaaggactggattggccaaacatcagacctgtcttccaaggagaccaagtcctggctacatcccagcctgtggttacagtgcagacaggccatgtgagccaccgctgccagcacagagcgtccttccccctgtagactagtgccgtagggagtacctgctgccccagctgactgtggccccctccgtgatccatccatctccagggagcaagacagagacgcaggaatggaaagcggagttcctaacaggatgaaagttcccccatcagttcccccagtacctccaagcaagtagctttccacatttgtcacagaaatcagaggagagacggtgttgggagccctttggagaacgccagtctcccaggccccctgcatctatcgagtttgcaatgtcacaacctctctgatcttgtgctcagcatgattctttaatagaagttttattttttcgtgcactctgctaatcatgtgggtgagccagtggaacagcgggagacctgtgctagttttacagattgcctccttatgacgcggctcaaaaggaaaccaagtggtcaggagttgtttctgacccactgatctctactaccacaaggaaaatagtttaggagaaaccagcttttactgtttttgaaaaattacagcttcaccctgtcaagttaacaag

SEQ ID NO: 863 - DNA, 1989 bp, Homo sapiens
ggctggcccaggctacggcggctgcagggctccggcaaccgctccggcaacgccaaccgctccgctgcgcgcaggctgggctgcaggctctcggctgcagcgctggcacgctggcggccccttgagccccaacctggataccataggggaggagcagagaagccaggaacaccacagccctgggccaaggtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccggatctgcatccacaccaatgcgcacgtcagcgtggaggtgtcggcggaggacctgctcacatgctgtggcagcatgtgtggggacggctgtaatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagtgtaccaacacgtcaccggagagatgatgggtggccatgccatccgcatcctgggctggggagtggagaatggcacaccctactggctggttgccaactcctggaacactgactggggtgacaatggcttctttaaaatactcagaggacaggatcactgtggaatcgaatcagaagtggtggctggaattccacgcaccgatcagtactgggaaaagatctaatctgccgtgggcctgtcgtgccagtcctgggggcgagatcggggtagaaatgcattttattctttaagttcacgtaagatacaagtttcagacagggtctgaaggactggattggccaaacatcagacctgtcttccaaggagaccaagtcctggctacatcccagcctgtggttacagtgcagacaggccatgtgagccaccgctgccagcacagagcgtccttccccctgtagactagtgccgtagggagtacctgctgccccagctgactgtggccccctccgtgatccatccatctccagggagcaagacagagacgcaggaatggaaagcggagttcctaacaggatgaaagttcccccatcagttcccccagtacctccaagcaagtagctttccacatttgtcacagaaatcagaggagagacggtgttgggagccctttggagaacgccagtctcccaggccccctgcatctatcgagtttgcaatgtcacaacctctctgatcttgtgctcagcatgattctttaatagaagttttattttttcgtgcactctgctaatcatgtgggtgagccagtggaacagcgggagacctgtgctagttttacagattgcctccttatgacgcggctcaaaaggaaaccaagtggtcaggagttgtttctgacccactgatctctactaccacaaggaaaatagtttaggagaaaccagcttttactgtttttgaaaaattacagcttcaccc

SEQ ID NO: 864 - DNA, 2400 bp, Homo sapiens
tagcggggatggctccaccttaacaacaaggtggtggcacagaactttctgctccagctgcctgcagcctcgccttggttccgcagtagcggtgttcactggcggctgcagatccgaaatgcctgagggcttaaaaaaatgcatgggcttctcccctaactagttaaatgggaatcactggcgattctcatttcagagaactggtggtgtttttaagtaccttagggaagtttagcgtctgctcagttgagaatcagtgttctacccggaagggcactcgtagcctggtctggtatggacatgaacaggagagcctcctgtcttctcccggatctttgtgggcaggggtggggctggcggttattccctgcaagctgtgcttatctagggagcgtcccttggagggtttggggtctgggaggtctgctcgcaccacttgctgcagctgggggtgggtccacgagtggcctcgggcacttgggtagcacacagtggtctggagagctggtggtgcttctctcagaggttttcattagaggctgtcttttcagctgtaatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagtgtaccaacacgtcaccggagagatgatgggtggccatgccatccgcatcctgggctggggagtggagaatggcacaccctactggctggttgccaactcctggaacactgactggggtgacaatggcttctttaaaatactcagaggacaggatcactgtggaatcgaatcagaagtggtggctggaattccacgcaccgatcagtactgggaaaagatctaatctgccgtgggcctgtcgtgccagtcctgggggcgagatcggggtagaaatgcattttattctttaagttcacgtaagatacaagtttcagacagggtctgaaggactggattggccaaacatcagacctgtcttccaaggagaccaagtcctggctacatcccagcctgtggttacagtgcagacaggccatgtgagccaccgctgccagcacagagcgtccttccccctgtagactagtgccgtagggagtacctgctgccccagctgactgtggccccctccgtgatccatccatctccagggagcaagacagagacgcaggaatggaaagcggagttcctaacaggatgaaagttcccccatcagttcccccagtacctccaagcaagtagctttccacatttgtcacagaaatcagaggagagacggtgttgggagccctttggagaacgccagtctcccaggccccctgcatctatcgagtttgcaatgtcacaacctctctgatcttgtgctcagcatgattctttaatagaagttttattttttcgtgcactctgctaatcatgtgggtgagccagtggaacagcgggagacctgtgctagttttacagattgcctccttatgacgcggctcaaaaggaaaccaagtggtcaggagttgtttctgacccactgatctctactaccacaaggaaaatagtttaggagaaaccagcttttactgtttttgaaaaattacagcttcaccctgtcaagttaacaaggaatgcctgtgccaataaaagttttctccaacttgaagtctactctgatgggatctcagatcctttgtcactgcctatagacttgtagctgctgtctctctttgtccctgcagagaatcacgtcctggaactgcatgttcttgcgactcttgggacttcatcttaacttctcgctgccccagccatgttttcaaccatggcatccctcccccaattagttccctgtcatcctcgtcaaccttctctgtaagtgcctggtaagcttgcccttgcttaagaactcaaaacatagctgtgctctatttttttgttgttgttgtgactgacagagtgagattccgtctcccaggctgggggacaagagtgaatctgtgtctcaccaaaaaaaaaaagaaaaagaaagatgcttaacaaaggttaccataagccacaaattcataaccacttatccttccagtttcaagtagaatatattcataacctcaataaagttctccctgctccc

SEQ ID NO: 865 - DNA, 958 bp, Homo sapiens
ggctgcagggctccggcaaccgctccggcaacgccaaccgctccgctgcgcgcaggctgggctgcaggctctcggctgcagcgctgggtggatctaggatccggcttccaacatgtggcagctctgggcctccctctgctgcctgctggtgttggccaatgcccggagcaggccctctttccatcccctgtcggatgagctgggccttcggggctgtggaagccatctctgaccggatctgcatccacaccaatgcgcacgtcagcgtggaggtgtcggcggaggacctgctcacatgctgtggcagcatgtgtggggacggctgtaatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagtgtaccaacacgtcaccggagagatgatgggtggccatgccatccgcatcctgggctggggagtggagaatggcacaccctactggctggttgccaactcctggaacactgactggggtgacaatggcttctttaaaatactcagaggacaggatcactgtggaatcgaatcagaagtggtggctggaattccacgcaccgatcagtactgggaaaagatctaatctgccgtgggcctgtcgtgccagtcctgggggcgagatcggggtagaaatgcattttattc

SEQ ID NO: 866 - DNA, 2123 bp, Homo sapiens
gcgcacgccggccgcgcccacgtgaccggtccgggtgcaaacacgcgggtcagctgatccggcccaactgcggcgtcatcccggctataagcgcacggcctcggcgaccctctccgacccggccgccgccgccatgcagccctccagccttctgccgctcgccctctgcctgctggctgcacccgcctccgcgctcgtcaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgcttcacagtcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcagggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccacaccaggccgtcctcccgggccctcccttggaaacctgccctgcctgagggcccctctgcccagcttgggcccagctgggctctgccaccctacctgttcagtgtcccgggcccgttgaggatgaggccgctagaggcctgaggatgagctggaaggagtgagaggggacaaaacccaccttgttggagcctgcagggtggtgctgggactgagccagtcccaggggcatgtattggcctggaggtggggttgggattgggggctggtgccagccttcctctgcagctgacctctgttgtcctccccttgggcggctgagagccccagctgacatggaaatacagttgttggcctccggcctcccctctgt

SEQ ID NO: 867 - DNA, 1436 bp, Homo sapiens
aagctgggccagaaccgcgacctccgcaaccttgagcggcatccgtggagtgcgcctgcgcagctacgaccgcagcaggaaagcgccgccggccaggcccagctgtggccggacagggactggaagagaggacgcggtcgagtaggttttaaaacatgaatcctacactcatccttgctgccttttgcctgggaattgcctcagctactctaacatttgatcacagtttagaggcacagtggaccaagtggaaggcgatgcacaacagattatacggcatgaatgaagaaggatggaggagagcagtgtgggagaagaacatgaagatgattgaactgcacaatcaggaatacagggaagggaaacacagcttcacaatggccatgaacgcctttggagacatgaccagtgaagaattcaggcaggtgatgaatggctttcaaaaccgtaagcccaggaaggggaaagtgttccaggaacctctgttttatgaggcccccagatctgtggattggagagagaaaggctacgtgactcctgtgaagaatcagggtcagtgtggttcttgttgggcttttagtgctactggtgctcttgaaggacagatgttccggaaaactgggaggcttatctcactgagtgagcagaatctggtagactgctctgggcctcaaggcaatgaaggctgcaatggtggcctaatggattatgctttccagtatgttcaggataatggaggcctggactctgaggaatcctatccatatgaggcaacagaagaatcctgtaagtacaatcccaagtattctgttgctaatgacaccggctttgtggacatccctaagcaggagaaggccctgatgaaggcagttgcaactgtggggcccatttctgttgctattgatgcaggtcatgagtccttcctgttctataaagaaggcatttattttgagccagactgtagcagtgaagacatggatcatggtgtgctggtggttggctacggatttgaaagcacagaatcagataacaataaatattggctggtgaagaacagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttc

SEQ ID NO: 868 - DNA, 933 bp, Homo sapiens
ttgagcggcatccgtggagtgcgcctgcgcagctacgaccgcagcaggaaagcgccgccggccaggcccagctgtggccggacagggactggaagagaggacgcggtcgagtaggttttaaaacatgaatcctacactcatccttgctgccttttgcctgggaattgcctcagctactctaacatttgatcacagtttagaggcacagtggaccaagtggaaggcgatgcacaacagattatacggcatgaatgaagaaggatggaggagagcagtgtgggagaagaacatgaagatgattgaactgcacaatcaggaatacagggaagggaaacacagcttcacaatggccatgaacgcctttggagacatgaccagtgaagaattcaggcaggtgatgaatggctttcaaaaccgtaagcccaggaaggggaaagtgttccaggaacctctgttttatgaggcccccagatctgtggattggagagagaaaggctacgtgactcctgtgaagaatcagggtcagtgtggttcttgttgggcttttagtgctactggtgctcttgaaggacagatgttccggaaaactgggaggcttatctcactgagtgagcagaatctggtagactgctctgggcctcaaggcaatgaaggctgcaatggtggcctaatggattatgctttccagtatgttcaggataatggaggcctggactctgaggaatcctatccatatgaggcaacagtaagtggagctccttgtcatcattccagctcagcttttggaaggtggacactttaagagataacagatacctttttcggaattcatatattagggctgggtggggtggctcacgcctgtaatcccagccctttaggaggctgagccaggcagatggcttaagctcaggagtttgagaccagcctggg

SEQ ID NO: 869 - DNA, 2177 bp, Homo sapiens
agccagtctcctccctcctagggtctggtcttgacgatagcatctcgtgttttggggatgcctttccttaccagattcttctaaagcccagctgcacccacccttaagtgggagataaggcttctgcccgcgggctctgcgttcgtccacccggccccacgtttgctgtggactaaacaggagccactggactagagtacacttgactctcggctctgcggaccaaaaattccaggactaaggaatagcaaggttaggctgaaacagtccacacagggcttgcggtaaacgtcttttcaggagccactcgcccagtgcagtaagtcgtgtacttagttgactcgagcgctccagggagacgcccgaccctactctgcgccgccccggggcaccagctctgcttcctccaggtccactgaggcaggcacgcccagctctgggacagtcagtaaacaagccacgaaccgcgccagggatcagagcacccagagtccccgcccagctgccggcacagccaatcgcagcgcagccaggcggcggggcggtgccggccgaacccagacccgaggttttagaagcagagtcaggcgaagctgggccagaaccgcgacctccgcaaccttgagcggcatccgtggagtgcgcctgcgcagctacgaccgcagcaggaaagcgccgccggccaggcccagctgtggccggacagggactggaagagaggacgcggtcgagtaggtgtgcaccagccctggcaacgagagcgtctaccccgaactctgctggccttgaggtggggaagccggggagggcagttgaggaccccgcggaggcgcgtgactggttgagcgggcaggccagcctccgagccgggtggacacaggttttaaaacatgaatcctacactcatccttgctgccttttgcctgggaattgcctcagctactctaacatttgatcacagtttagaggcacagtggaccaagtggaaggcgatgcacaacagattatacggcatgaatgaagaaggatggaggagagcagtgtgggagaagaacatgaagatgattgaactgcacaatcaggaatacagggaagggaaacacagcttcacaatggccatgaacgcctttggagacatgaccagtgaagaattcaggcaggtgatgaatggctttcaaaaccgtaagcccaggaaggggaaagtgttccaggaacctctgttttatgaggcccccagatctgtggattggagagagaaaggctacgtgactcctgtgaagaatcagggtcagtgtggttcttgttgggcttttagtgctactggtgctcttgaaggacagatgttccggaaaactgggaggcttatctcactgagtgagcagaatctggtagactgctctgggcctcaaggcaatgaaggctgcaatggtggcctaatggattatgctttccagtatgttcaggataatggaggcctggactctgaggaatcctatccatatgaggcaacagaagaatcctgtaagtacaatcccaagtattctgttgctaatgacaccggctttgtggacatccctaagcaggagaaggccctgatgaaggcagttgcaactgtggggcccatttctgttgctattgatgcaggtcatgagtccttcctgttctataaagaaggcatttattttgagccagactgtagcagtgaagacatggatcatggtgtgctggtggttggctacggatttgaaagcacagaatcagataacaataaatattggctggtgaagaacagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttcaaatgt

SEQ ID NO: 870 - DNA, 354 bp, Homo sapiens
tttgcctgggcacgaaacctggattttttgcgattggtacaaaacctggatcaaccgtttcccggtttcctagttgttgccttaagcttctcacacacaaggtagtttcataccgttctcataacctaaattgtcatcgcataaactgtttcagctcctacagctctggacaggctgcttttcattttggttttaaaacatgaatcctacactcatccttgctgccttttgcctgggaattgcctcagctactctaacatttgatcacagtttagaggcacagtggaccaagtggaaggcgatgcacaacagattatacggcatgaatgaagaaggatggaggagagcagtgtg

SEQ ID NO: 871 - DNA, 2628 bp, Homo sapiens
agagtacagaggggtgtggtgtcctctgcgagatcctcttaaaaagctggctacgcgcaggcggtttctgtgcacggagccgtagctgtcggagcggttagttcgatttcgagctcgaggtttcccccgccgccaggctgacttctcatcgcttgtttttctttttgcatttttcctcccaccgccgttgccgccctccccgtcctggccgtccgccctccgccctctgcagggacatctctacaccgttcccatccgggaacagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaagattgactttgaagatgtgattgcagaaccagaagggacacacagttttgacggcatttggaaggccagcttcaccaccttcactgtgacgaaatactggttttaccgcttgctgtctgccctctttggcatcccgatggcactcatctggggcatttacttcgccattctctctttcctgcacatctgggcagttgtaccatgcattaagagcttcctgattgagattcagtgcatcagccgtgtctattccatctacgtccacaccgtctgtgacccactctttgaagctgttgggaaaatattcagcaatgtccgcatcaacttgcagaaagaaatataaatgacatttcaaggatagaagtatacctgattttttttccttttaattttcctggtgccaatttcaagttccaagttgctaatacagcaacaatttatgaattgaattatcttggttgaaaataaaaagatcactttctcagttttcataagtattatgtctcttctgagctatttcatctatttttggcagtctgaatttttaaaacccatttaaatttttttccttacctttttatttgcatgtggatcaaccatcgctttattggctgagatatgaacatattgttgaaaggtaatttgagagaaatatgaagaactgaggaggaaaaaaaaaaaaaagaaaagaaccaacaacctcaactgcctactccaaaatgttggtcattttatgttaagggaagaattccagggtatggccatggagtgtacaagtatgtgggcagattttcagcaaactcttttcccactgtttaaggagttagtggattactgccattcacttcataatccagtaggatccagtgatccttacaagttagaaaacataatcttctgccttctcatgatccaactaatgccttactcttcttgaaattttaacctatgatattttctgtgcctgaatatttgttatgtagataacaagacctcagtgccttcctgtttttcacattttccttttcaaatagggtctaactcagcaactcgctttaggtcagcagcctccctgaagaccaaaattagaatatccatgacctagttttccatgcgtgtttctgactctgagctacagagtctggtgaagctcacttctgggcttcatctggcaacatctttatccgtagtgggtatggttgacactagcccaatgaaatgaattaaagtggaccaatagggctgagctctctgtgggctggcagtcctggaagccagctttccctgcctctcatcaactgaatgaggtcagcatgtctattcagcttcgtttattttcaagaataatcacgctttcctgaatccaaactaatccatcaccggggtggtttagtggctcaacattgtgttcccatttcagctgatcagtgggcctccaaggaggggctgtaaaatggaggccattgtgtgagcctatcagagttgctgcaaacctgacccctgctcagtaaagcacttgcaaccgtctgttatgctgtgacacatggcccctccccctgccaggagctttggacctaatccaagcatccctttgcccagaaagaagatgggggaggaggcagtaataaaaagattgaagtattttgctggaataagttcaaattcttctgaactcaaactgaggaatttcacctgtaaacctgagtcgtacagaaagctgcctggtatatccaaaagctttttattcctcctgctcatattgtgattctgcctttggggacttttcttaaaccttcagttatgatttttttttcatacacttattggaactctgcttgatttttgcctcttccagtcttcctgacactttaattaccaacctgttacctactttgactttttgcatttaaaacagacactggcatggatatagttttacttttaaactgtgtacataactgaaaatgtgctatactgcatactttttaaatgtaaagatatttttatctttatatgaagaaaatcacttaggaaatggctttgtgattcaatctgtaaactgtgtattccaagacatgtctgttctacatagatgcttagtccctcatgcaaatcaattactggtccaaaagattgctgaaattttatatgcttactgatatattttacaattttttatcatgcatgtcctgtaaaggttacaagcctgcacaataaaaatgtttaacggtt

SEQ ID NO: 872 - DNA, 2443 bp, Homo sapiens
gctgcccttcagccacccgcccgcagcctgggagtgccctgaggggacatctctacaccgttcccatccgggaacagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaagattgactttgaagatgtgattgcagaaccagaagggacacacagttttgacggcatttggaaggccagcttcaccaccttcactgtgacgaaatactggttttaccgcttgctgtctgccctctttggcatcccgatggcactcatctggggcatttacttcgccattctctctttcctgcacatctgggcagttgtaccatgcattaagagcttcctgattgagattcagtgcatcagccgtgtctattccatctacgtccacaccgtctgtgacccactctttgaagctgttgggaaaatattcagcaatgtccgcatcaacttgcagaaagaaatataaatgacatttcaaggatagaagtatacctgattttttttccttttaattttcctggtgccaatttcaagttccaagttgctaatacagcaacaatttatgaattgaattatcttggttgaaaataaaaagatcactttctcagttttcataagtattatgtctcttctgagctatttcatctatttttggcagtctgaatttttaaaacccatttaaatttttttccttacctttttatttgcatgtggatcaaccatcgctttattggctgagatatgaacatattgttgaaaggtaatttgagagaaatatgaagaactgaggaggaaaaaaaaaaaaaagaaaagaaccaacaacctcaactgcctactccaaaatgttggtcattttatgttaagggaagaattccagggtatggccatggagtgtacaagtatgtgggcagattttcagcaaactcttttcccactgtttaaggagttagtggattactgccattcacttcataatccagtaggatccagtgatccttacaagttagaaaacataatcttctgccttctcatgatccaactaatgccttactcttcttgaaattttaacctatgatattttctgtgcctgaatatttgttatgtagataacaagacctcagtgccttcctgtttttcacattttccttttcaaatagggtctaactcagcaactcgctttaggtcagcagcctccctgaagaccaaaattagaatatccatgacctagttttccatgcgtgtttctgactctgagctacagagtctggtgaagctcacttctgggcttcatctggcaacatctttatccgtagtgggtatggttgacactagcccaatgaaatgaattaaagtggaccaatagggctgagctctctgtgggctggcagtcctggaagccagctttccctgcctctcatcaactgaatgaggtcagcatgtctattcagcttcgtttattttcaagaataatcacgctttcctgaatccaaactaatccatcaccggggtggtttagtggctcaacattgtgttcccatttcagctgatcagtgggcctccaaggaggggctgtaaaatggaggccattgtgtgagcctatcagagttgctgcaaacctgacccctgctcagtaaagcacttgcaaccgtctgttatgctgtgacacatggcccctccccctgccaggagctttggacctaatccaagcatccctttgcccagaaagaagatgggggaggaggcagtaataaaaagattgaagtattttgctggaataagttcaaattcttctgaactcaaactgaggaatttcacctgtaaacctgagtcgtacagaaagctgcctggtatatccaaaagctttttattcctcctgctcatattgtgattctgcctttggggacttttcttaaaccttcagttatgatttttttttcatacacttattggaactctgcttgatttttgcctcttccagtcttcctgacactttaattaccaacctgttacctactttgactttttgcatttaaaacagacactggcatggatatagttttacttttaaactgtgtacataactgaaaatgtgctatactgcatactttttaaatgtaaagatatttttatctttatatgaagaaaatcacttaggaaatggctttgtgattcaatctgtaaactgtgtattccaagacatgtctgttctacatagatgcttagtccctcatgcaaatcaattactggtccaaaagattgctgaaattttatatgcttactgatatattttacaattttttatcatgcatgtcctgtaaaggttacaagcctgcacaataaaaatgtttaacggttaaa

SEQ ID NO: 873 - DNA, 2704 bp, Homo sapiens
gggagaaacgttctcactcgctctctgctcgctgcgggcgctccccgccctctgctgccagaaccttggggatgtgcctagacccggcgcagcacacgtccgggccaaccgcgagcagaacaaacctttggcgggcggccaggaggctccctcccagccaccgcccccctccagcgcctttttttccccccatacaatacaagatcttccttcctcagttcccttaaagcacagcccagggaaacctcctcacagttttcatccagccacgggccagcatgtctgggggcaaatacgtagactcggagggacatctctacaccgttcccatccgggaacagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaagattgactttgaagatgtgattgcagaaccagaagggacacacagttttgacggcatttggaaggccagcttcaccaccttcactgtgacgaaatactggttttaccgcttgctgtctgccctctttggcatcccgatggcactcatctggggcatttacttcgccattctctctttcctgcacatctgggcagttgtaccatgcattaagagcttcctgattgagattcagtgcatcagccgtgtctattccatctacgtccacaccgtctgtgacccactctttgaagctgttgggaaaatattcagcaatgtccgcatcaacttgcagaaagaaatataaatgacatttcaaggatagaagtatacctgattttttttccttttaattttcctggtgccaatttcaagttccaagttgctaatacagcaacaatttatgaattgaattatcttggttgaaaataaaaagatcactttctcagttttcataagtattatgtctcttctgagctatttcatctatttttggcagtctgaatttttaaaacccatttaaatttttttccttacctttttatttgcatgtggatcaaccatcgctttattggctgagatatgaacatattgttgaaaggtaatttgagagaaatatgaagaactgaggaggaaaaaaaaaaaaaagaaaagaaccaacaacctcaactgcctactccaaaatgttggtcattttatgttaagggaagaattccagggtatggccatggagtgtacaagtatgtgggcagattttcagcaaactcttttcccactgtttaaggagttagtggattactgccattcacttcataatccagtaggatccagtgatccttacaagttagaaaacataatcttctgccttctcatgatccaactaatgccttactcttcttgaaattttaacctatgatattttctgtgcctgaatatttgttatgtagataacaagacctcagtgccttcctgtttttcacattttccttttcaaatagggtctaactcagcaactcgctttaggtcagcagcctccctgaagaccaaaattagaatatccatgacctagttttccatgcgtgtttctgactctgagctacagagtctggtgaagctcacttctgggcttcatctggcaacatctttatccgtagtgggtatggttgacactagcccaatgaaatgaattaaagtggaccaatagggctgagctctctgtgggctggcagtcctggaagccagctttccctgcctctcatcaactgaatgaggtcagcatgtctattcagcttcgtttattttcaagaataatcacgctttcctgaatccaaactaatccatcaccggggtggtttagtggctcaacattgtgttcccatttcagctgatcagtgggcctccaaggaggggctgtaaaatggaggccattgtgtgagcctatcagagttgctgcaaacctgacccctgctcagtaaagcacttgcaaccgtctgttatgctgtgacacatggcccctccccctgccaggagctttggacctaatccaagcatccctttgcccagaaagaagatgggggaggaggcagtaataaaaagattgaagtattttgctggaataagttcaaattcttctgaactcaaactgaggaatttcacctgtaaacctgagtcgtacagaaagctgcctggtatatccaaaagctttttattcctcctgctcatattgtgattctgcctttggggacttttcttaaaccttcagttatgatttttttttcatacacttattggaactctgcttgatttttgcctcttccagtcttcctgacactttaattaccaacctgttacctactttgactttttgcatttaaaacagacactggcatggatatagttttacttttaaactgtgtacataactgaaaatgtgctatactgcatactttttaaatgtaaagatatttttatctttatatgaagaaaatcacttaggaaatggctttgtgattcaatctgtaaactgtgtattccaagacatgtctgttctacatagatgcttagtccctcatgcaaatcaattactggtccaaaagattgctgaaattttatatgcttactgatatattttacaattttttatcatgcatgtcctgtaaaggttacaagcctgcacaataaaaatgtttaacggtt

SEQ ID NO: 874 - DNA, 3301 bp, Homo sapiens
ctccctccaggaaggccgttgtcttccctgggacgacttgccagctctgaggcatgacagtacgggcccccagaagggtgaccaggaggccctcctcgtcccagctgccggcgtcgccgcccactgcagggcccgggctgtgactcgtggggacggttccctgcgccccggcgggggaggtgggcggggaggggcggcggggcgccggggcggggctcgggacggccgggctgggagctggagcccacagcgggaagcggccgccgcccgggcctcgcagggctaggcgaggcgagggggggcggggccgggcgctacgggaaggggaggccgcgcggaccgggagccgcaccgcgccagccgggctgcagcggccgcgcaccaaggctgcgatggggctggagacggagaaggcggacgtacagctcttcatggacgacgactcctacagccaccacagcggcctcgagtacgccgaccccgagaagttcgcggactcggaccaggaccgggatccccaccggctcaactcgcatctcaagctgggcttcgaggatgtgatcgcagagccggtgactacgcactcctttgacaaagtgtggatctgcagccatgccctctttgaaatcagcaaatacgtaatgtacaagttcctgacggtgttcctggccattcccctggccttcattgcgggaattctctttgccaccctcagctgtctgcacatctggattttaatgccttttgtaaagacctgcctaatggttctgccttcagtgcagacaatatggaagagtgtgacagatgttatcattgctccattgtgtacgagcgtaggacgatgcttctcttctgtcagcctgcaactgagccaggattgaatacttggaccccaggtctggagattgggatactgtaatacttctttgttattataacataaaagcaccactgttctgttcatttcctagctgttctaattaagaaaactattaagatgagcaaccacatttagaaatgtttattgacaggtcttttcaaataatgcttttctaattaatagccaaagatttcatatctaactttgtaaccagaattatacagtaagttgacaccacttagatttaaaggcagacagttttgctttagtacaatagtatacattttataatgatgaacttataatgattaagggacatttctataaaaatactacaatagttttatgcacaacttcccattaaaaatgagatttcttatttgtttgtctgtttttactctgggagtaatactttttaaattacctttacatatatagtcactggcatactgagaatatacaatgatcctggaaattgcagtaacaaaagcacacaacgattatagtaactataagatacaataaaacaaataaatatgaaagtagattcatgaaaatgtattcctttaaaatattgttttcctacaggcctatttaacaagatgtttcattttactgtatattttgtagttaatataaatgttgctctaatcagattgcttaaaagcatttttattatatttatgttgttgaactaatatatgaaataagtaaatgtagctcccacaaggtaaacttcattggtaagattgcactgttctgattatgtaagcatttgtacatcttctttggaaataaaagataaaagagcgatacacaaagctttcttttctaacttttccaagcaaaatctaaaatgttttatgacatttttctggctgtgatcttaaaataattcatatctaaatagtattttgtctaggagatgctttctctctagtagttagaaattaaatctgtgtcagcattcctattaatgtctcactttactttcaagtaatattggtgctatttaacattttacagtaaatgttacttctgatactttagtacaatttcaactacagtgattcatgtagagagacaggggagttgtcaacttgggctactgaactacatgcataaactaaaaactaacagctacaaacttttaagatttctctaatattggtatgtaacacaggataaagttattcttgtcattttgaactgtagagtcctatttcagtgtgatgaatcactgttgctttgaaaaatctcattatttctgggccgggcatggtggctcacccctgtaatcccagcactttgggaggccaaggcgggtggatcatgaggtcaggagatcaagaccatcctggccaacatggtgataccccgtctctactaaaaatacaaaaaaattagttgggcatggtggcatgcacctgtagtcccagctacctgggaggctgaggcaggagaattgcttgaacctgggaggcagaggttgcagtgagccaaaatcatgccactgcactcccgcctggcaacagagcaagagtctgtctcaaaaaaaaaaagaaaaaaagaaaaaaagaaaaaagaaaaatctcattatttcaaaatgatagacatataccaaaaacaagtctataatgtgagtagttactaaaatttacacatcttaaaagtgtgtaaatgcttaaatttcagaattaccatcagaacctcaattgacattcctttgaatacgctaataagtgacaaataagattaataagatttttcaaaatcgccaggactggtgaatataaatgatgattgaactggaataatattggggaccaaatcaaatgaatgattaaattatgaagctcatatccttttgaaggtagttgcaaagagacatttcaaaactgccctaggccattgcagcatccttagatgggacgcataatcattaccttaaagcatcaccactcattttgaccatatagattttattatgttagtttaaaaggtcaatcagcctcatgactttatagttatgtcttgtatttaaaaacattttttatacatttggttatgttgataaaccaaaaacatttgattaataaaatatctatttgaataaattatgagctatcctttcaaacagctattggcaagttttaaacccaaaatatatacacatagttctgtaataaaactgtttgacttctcaagtaacatgacttccttatttctgaacagtactggttactttcaaaatgaatttttattgagattttccattaactatttttttcaaagactcaaattttgtaccaagtaaatccaggctttatgtacaaacatgttgtttgttttatttggggctgggggaggtatatgatgagcagacttctcggaattcataataaattttctaaaagccta

SEQ ID NO: 875 - DNA, 776 bp, Homo sapiens
accgcgccagccgggctgcagcggccgcgcaccaaggctgcgatggggctggagacggagaaggcggacgtacagctcttcatggacgacgactcctacagccaccacagcggcctcgagtacgccgaccccgagaagttcgcggactcggaccaggaccgggatccccaccggctcaactcgcatctcaaggattttaatgccttttgtaaagacctgcctaatggttctgccttcagtgcagacaatatggaagagtgtgacagatgttatcattgctccattgtgtacgagcgtaggacgatgcttctcttctgtcagcctgcaactgagccaggattgaatacttggaccccaggtctggagattgggatactgtaatacttctttgttattataacataaaagcaccactgttctgttcatttcctagctgttctaattaagaaaactattaagatgagcaaccacatttagaaatgtttattgacaggtcttttcaaataatgcttttctaattaatagccaaagatttcatatctaactttgtaaccagaattatacagtaagttgacaccacttagatttaaaggcagacagttttgctttagtacaatagtatacattttataatgatgaacttataatgattaagggacatttctataaaaatactacaatagttttatgcacaacttcccattaaaaatgagatttcttatttgtttgtctgtttttactctgggagtaatactttttaaattacctttacatat

SEQ ID NO: 876 - DNA, 893 bp, Homo sapiens
cgatggggctggagacggagaaggcggacgtacagctcttcatggacgacgactcctacagccaccacagcggcctcgagtacgccgaccccgagaagttcgcggactcggaccaggaccgggatccccaccggctcaactcgcatctcaagctgggcttcgaggatgtgatcgcagagccggtgactacgcactcctttgacaaagtgtggatctgcagccatgccctctttgaaatcagcaaatacgtaatgtacaagttcctgacggtgttcctggccattcccctggccttcattgcgggaattctctttgccaccctcagctgtctgcacatctggtgagacggggcacaccgggtggaccggctttctgaaacatgggcatattctccgccacctgccccctactctcctcttatcccaggccggcgtcaggaggaggaacgcgcatcagttcccaagcagtaggaagaactggaaggccttgaaaggcaatgcgcttcctttagaataacagtttgggcttggagtttcaacaggagaaagaatgtcggtctttcctggggtgtgattttccttgcatacataaggctgggctgagtgtggaggcgggtacctggaagccacacttcttaccacaggctgctctcggggccctgttgtgactcgtacctgcggttctgggcaggactcttctttctttcattgccttttattcagtcactgcctgtgcttggggtaaaacaaaagtgatctctgagcagaatgccgctgacagtagaattggatgaggatgtcagacctggttaagcagtagtgtggaggggctgcttcaactttgcccctggcagatggcaaggatgggacccagaggaaagggaggtgtgtgca

SEQ ID NO: 877 - DNA, 1837 bp, Homo sapiens
gagccgcgcacgggactgggaaggggacccacccgagggtccagccaccagccccctcactaatagcggccaccccggcagcggcggcagcagcagcagcgacgcagcggcgacagctcagagcagggaggccgcgccacctgcgggccggccggagcgggcagccccaggccccctccccgggcacccgcgttcatgcaacgcctggtggcctgggacccagcatgtctccccctgccgccgccgccgcctgcctttaaatccatggaagtggccaacttctactacgaggcggactgcttggctgctgcgtacggcggcaaggcggcccccgcggcgccccccgcggccagacccgggccgcgcccccccgccggcgagctgggcagcatcggcgaccacgagcgcgccatcgacttcagcccgtacctggagccgctgggcgcgccgcaggccccggcgcccgccacggccacggacaccttcgaggcggctccgcccgcgcccgcccccgcgcccgcctcctccgggcagcaccacgacttcctctccgacctcttctccgacgactacgggggcaagaactgcaagaagccggccgagtacggctacgtgagcctggggcgcctgggggccgccaagggcgcgctgcaccccggctgcttcgcgcccctgcacccaccgcccccgccgccgccgccgcccgccgagctcaaggcggagccgggcttcgagcccgcggactgcaagcggaaggaggaggccggggcgccgggcggcggcgcaggcatggcggcgggcttcccgtacgcgctgcgcgcttacctcggctaccaggcggtgccgagcggcagcagcgggagcctctccacgtcctcctcgtccagcccgcccggcacgccgagccccgctgacgccaaggcgcccccgaccgcctgctacgcgggggccgcgccggcgccctcgcaggtcaagagcaaggccaagaagaccgtggacaagcacagcgacgagtacaagatccggcgcgagcgcaacaacatcgccgtgcgcaagagccgcgacaaggccaagatgcgcaacctggagacgcagcacaaggtcctggagctcacggccgagaacgagcggctgcagaagaaggtggagcagctgtcgcgcgagctcagcaccctgcggaacttgttcaagcagctgcccgagcccctgctcgcctcctccggccactgctagcgcggcccccgcgcgcgtccccctgccggccggggctgagactccggggagcgcccgcgcccgcgccctcgcccccgcccccggcggcgccggcaaaactttggcactggggcacttggcagcgcggggagcccgtcggtaattttaatattttattatatatatatatctatatttttgtccaaaccaaccgcacatgcagatggggctcccgcccgtggtgttatttaaagaagaaacgtctatgtgtacagatgaatgataaactctctgcttctccctctgcccctctccaggcgccggcgggcgggccggtttcgaagttgatgcaatcggtttaaacatggctgaacgcgtgtgtacacgggactgacgcaacccacgtgtaactgtcagccgggccctgagtaatcgcttaaagatgttcctacgggcttgttgctgttgatgttttgttttgttttgttttttggtctttttttgtattataaaaaataatctatttctatgagaaaagaggcgtctgtatattttgggaatcttttccgtttcaagcattaagaacacttttaataaacttttttttgagaatggttacaaagcc

SEQ ID NO: 878 - DNA, 3939 bp, Homo sapiens
cccatgctgccctgcgccaacccctcccctcacctttcctcccccgccctctactcgccgcccggccggtccccccacccgtcccttcccttatcagcacccgcggccccggcagcgccgacgcaggcgcactgcaccgcgccgccgccattttgtgtctgagcctgtggagcgattaaaccgtgcgcggagctgcttctttggcggcagcggcggcggcggtggccggtgcggacgcgcggagctcgccggagacgccgggtggccggagccgtggagcggcggcggagcgggcgccgcggggggtgtggcgcggagaatgattacggacctgaagccaaagaacaagatgcgctagtggacagattgctgaccaggggcttgagagctgggttctattttccctcctcaaactgactttgcagccacggagaggcaggggaaatggaaggtgatgcagtcgaagccattgtggaggagtccgaaacttttattaaaggaaaggagagaaagacttaccagagacgccgggaagggggccaggaagaagatgcctgccacttaccccagaaccagacggatgggggtgaggtggtccaggatgtcaacagcagtgtacagatggtgatgatggaacagctggaccccacccttcttcagatgaagactgaagtaatggagggcacagtggctccagaagcagaggctgctgtggacgatacccagattataactttacaggttgtaaatatggaggaacagcccataaacataggagaacttcagcttgttcaagtacctgttcctgtgactgtacctgttgctaccacttcagtagaagaacttcagggggcttatgaaaatgaagtgtctaaagagggccttgcggaaagtgaacccatgatatgccacaccctacctttgcctgaagggtttcaggtggttaaagtgggggccaatggagaggtggagacactagaacaaggggaacttccaccccaggaagatcctagttggcaaaaagacccagactatcagccaccagccaaaaaaacaaagaaaaccaaaaagagcaaactgcgttatacagaggagggcaaagatgtagatgtgtctgtctacgattttgaggaagaacagcaggagggtctgctatcagaggttaatgcagagaaagtggttggtaatatgaagcctccaaagccaacaaaaattaaaaagaaaggtgtaaagaagacattccagtgtgagctttgcagttacacgtgtccacggcgttcaaatttggatcgtcacatgaaaagccacactgatgagagaccacacaagtgccatctctgtggcagggcattcagaacagtcaccctcctgaggaatcaccttaacacacacacaggtactcgtcctcacaagtgcccagactgcgacatggcctttgtgaccagtggagaattggttcggcatcgtcgttacaaacacacccacgagaagccattcaagtgttccatgtgcgattacgccagtgtagaagtcagcaaattaaaacgtcacattcgctctcatactggagagcgtccgtttcagtgcagtttgtgcagttatgccagcagggacacatacaagctgaaaaggcacatgagaacccattcaggggaaaagccttatgaatgttatatttgtcatgctcggtttacccaaagtggtaccatgaagatgcacattttacagaagcacacagaaaatgtggccaaatttcactgtccccactgtgacacagtcatagcccgaaaaagtgatttgggtgtccacttgcgaaagcagcattcctatattgagcaaggcaagaaatgccgttactgtgatgctgtgtttcatgagcgctatgccctcatccagcatcagaagtcacacaagaatgagaagcgctttaagtgtgaccagtgtgattacgcttgtagacaggagaggcacatgatcatgcacaagcgcacccacaccggggagaagccttacgcctgcagccactgcgataagaccttccgccagaagcagcttctcgacatgcacttcaagcgctatcacgaccccaacttcgtccctgcggcttttgtctgttctaagtgtgggaaaacatttacacgtcggaataccatggcaagacatgctgataattgtgctggcccagatggcgtagagggggaaaatggaggagaaacgaagaagagtaaacgtggaagaaaaagaaagatgcgctctaagaaagaagattcctctgacagtgaaaatgctgaaccagatctggacgacaatgaggatgaggaggagcctgccgtagaaattgaacctgagccagagcctcagcctgtgaccccagccccaccacccgccaagaagcggagaggacgaccccctggcagaaccaaccagcccaaacagaaccagccaacagctatcattcaggttgaagaccagaatacaggtgcaattgagaacattatagttgaagtaaaaaaagagccagatgctgagcccgcagagggagaggaagaggaggcccagccagctgccacagatgcccccaacggagacctcacgcccgagatgatcctcagcatgatggaccggtgatggcggagccttgtgcgtcgccaggacttctctgggctgtgtttaaacggcccgcatcttaatttttctcccttctttctttttttggctttgggaaaagcatcattttaccaaacataccgagaacgaaaacttcaaggatgatgttagaaaaaaatgtgatttaactagaacttgctgtctgatgttagcaaatcatggaatgttctgagtccctgagggtttactgtgaagtgctgaggacagtgttgacaactaactcgttttcctagatggaaacggagacattgacccctccctccatgtggtaaaccactccagaatggccaccaggcttcccagagttctatggtcttcttcccaagagagtttttaattgtaaatgcatacttgggaaggacttagagttttaaactgttttttgcttttgcttttccctgactccctttgcttggagtcagctgcacaccagtagtatggcatgctacgatcaggttctgtcctgaaagctttgcctctttcttggcaaagtttctggtatggtcaagcttgtaaataactttttttacattttaatcttttccattaattaagaggttgaaaagaagtgcagtgtaagaaaacccagcattttaattacttgcaaattaagttaccacagactctgtagtgtgtaaatgttgacaaggaattggatcacaatcatgtagcagaatggcacccagaccactgcccaccagtgacggacatgcacgtggcagatcatgatttccagcccacggagccagcatttgaaccttgtataattaactttcagttatgatttcccatcgacattttctttgccctgtttgtagctgattgttgtgttttataaatcttctgttaaggcagaagggtgattatgagtggttcacagcagcccttataagctgggccagaaaatttcactaggtcagtaatttaaaccttggatcttcaaaaaataaaataatgtgaagcaaaaccaactaaaaagtgattcttgcacatgaactgtcacatgtttaaaaatgtgttttttagagagcctcagtcttactgatttcaaacacttttttcttctgtgtattgcttttaagagagccatcagttagctatcagactctaggttgatgcattttgtacttagctgtactgtgtgatatttttcattattttaggacgccaacatgagacctgtaataaaatatgtaatggggttgaaagctggggaggaggatctactgctgtacagctaataaatcataacggattaacaagtgctccaaa

SEQ ID NO: 879 - DNA, 2978 bp, Homo sapiens
cccatgctgccctgcgccaacccctcccctcacctttcctcccccgccctctactcgccgcccggccggtccccccacccgtcccttcccttatcagcacccgcggccccggcagcgccgacgcaggcgcactgcaccgcgccgccgccattttgtgtctgagcctgtggagcgattaaaccgtgcgcggagctgcttctttggcggcagcggcggcggcggtggccggtgcggacgcgcggagctcgccggagacgccgggtggccggagccgtggagcggcggcggagcgggcgccgcggggggtgtggcgcggagaatgattacggacctgaagccaaagaacaagatgcgctagtggacagattgctgaccaggggcttgagagctgggttctattttccctcctcaaactgactttgcagccacggagaggtactcgtcctcacaagtgcccagactgcgacatggcctttgtgaccagtggagaattggttcggcatcgtcgttacaaacacacccacgagaagccattcaagtgttccatgtgcgattacgccagtgtagaagtcagcaaattaaaacgtcacattcgctctcatactggagagcgtccgtttcagtgcagtttgtgcagttatgccagcagggacacatacaagctgaaaaggcacatgagaacccattcaggggaaaagccttatgaatgttatatttgtcatgctcggtttacccaaagtggtaccatgaagatgcacattttacagaagcacacagaaaatgtggccaaatttcactgtccccactgtgacacagtcatagcccgaaaaagtgatttgggtgtccacttgcgaaagcagcattcctatattgagcaaggcaagaaatgccgttactgtgatgctgtgtttcatgagcgctatgccctcatccagcatcagaagtcacacaagaatgagaagcgctttaagtgtgaccagtgtgattacgcttgtagacaggagaggcacatgatcatgcacaagcgcacccacaccggggagaagccttacgcctgcagccactgcgataagaccttccgccagaagcagcttctcgacatgcacttcaagcgctatcacgaccccaacttcgtccctgcggcttttgtctgttctaagtgtgggaaaacatttacacgtcggaataccatggcaagacatgctgataattgtgctggcccagatggcgtagagggggaaaatggaggagaaacgaagaagagtaaacgtggaagaaaaagaaagatgcgctctaagaaagaagattcctctgacagtgaaaatgctgaaccagatctggacgacaatgaggatgaggaggagcctgccgtagaaattgaacctgagccagagcctcagcctgtgaccccagccccaccacccgccaagaagcggagaggacgaccccctggcagaaccaaccagcccaaacagaaccagccaacagctatcattcaggttgaagaccagaatacaggtgcaattgagaacattatagttgaagtaaaaaaagagccagatgctgagcccgcagagggagaggaagaggaggcccagccagctgccacagatgcccccaacggagacctcacgcccgagatgatcctcagcatgatggaccggtgatggcggagccttgtgcgtcgccaggacttctctgggctgtgtttaaacggcccgcatcttaatttttctcccttctttctttttttggctttgggaaaagcatcattttaccaaacataccgagaacgaaaacttcaaggatgatgttagaaaaaaatgtgatttaactagaacttgctgtctgatgttagcaaatcatggaatgttctgagtccctgagggtttactgtgaagtgctgaggacagtgttgacaactaactcgttttcctagatggaaacggagacattgacccctccctccatgtggtaaaccactccagaatggccaccaggcttcccagagttctatggtcttcttcccaagagagtttttaattgtaaatgcatacttgggaaggacttagagttttaaactgttttttgcttttgcttttccctgactccctttgcttggagtcagctgcacaccagtagtatggcatgctacgatcaggttctgtcctgaaagctttgcctctttcttggcaaagtttctggtatggtcaagcttgtaaataactttttttacattttaatcttttccattaattaagaggttgaaaagaagtgcagtgtaagaaaacccagcattttaattacttgcaaattaagttaccacagactctgtagtgtgtaaatgttgacaaggaattggatcacaatcatgtagcagaatggcacccagaccactgcccaccagtgacggacatgcacgtggcagatcatgatttccagcccacggagccagcatttgaaccttgtataattaactttcagttatgatttcccatcgacattttctttgccctgtttgtagctgattgttgtgttttataaatcttctgttaaggcagaagggtgattatgagtggttcacagcagcccttataagctgggccagaaaatttcactaggtcagtaatttaaaccttggatcttcaaaaaataaaataatgtgaagcaaaaccaactaaaaagtgattcttgcacatgaactgtcacatgtttaaaaatgtgttttttagagagcctcagtcttactgatttcaaacacttttttcttctgtgtattgcttttaagagagccatcagttagctatcagactctaggttgatgcattttgtacttagctgtactgtgtgatatttttcattattttaggacgccaacatgagacctgtaataaaatatgtaatggggttgaaagctggggaggaggatctactgctgtacagctaataaatcataacggattaacaagtgctccaaa

SEQ ID NO: 880 - DNA, 1886 bp, Homo sapiens
aattctaccccccttggtgccaacagatgaggttcacaatctcttccacaaaacatgcagttaaatatctgaggatattcagggacttggatttggtggcaggagatcaacataaaccaagacaaggaagaagtcaaagaaatgaatcaagtagattctctgggatataaggtagggggattggggggttggatagtgcagagtatggtactggcctaaggcactgaggatcatccttttcccacacccaccagagaaggcttaggctcccgagtcaacagggcattcaccgcctggggcgcctgagtcatcaggacactgccaggagacacagaaccctagatgccctgcagaatccttcctgttacggtccccctccctgaaacatccttcattgcaatatttccaggaaaggaagggggctggctcggaggaagagaggtggggaggtgatcagggttcacagaggagggaactgaatgacatcccaggattacataaactgtcagaggcagccgaagagttcacaagtgtgaagcctggaagccggcgggtgccgctgtgtaggaaagaagctaaagcacttccagagcctgtccggagctcagaggttcggaagacttatcgaccatggagcgcgcgtcctgcttgttgctgctgctgctgccgctggtgcacgtctctgcgaccacgccagaaccttgtgagctggacgatgaagatttccgctgcgtctgcaacttctccgaacctcagcccgactggtccgaagccttccagtgtgtgtctgcagtagaggtggagatccatgccggcggtctcaacctagagccgtttctaaagcgcgtcgatgcggacgccgacccgcggcagtatgctgacacggtcaaggctctccgcgtgcggcggctcacagtgggagccgcacaggttcctgctcagctactggtaggcgccctgcgtgtgctagcgtactcccgcctcaaggaactgacgctcgaggacctaaagataaccggcaccatgcctccgctgcctctggaagccacaggacttgcactttccagcttgcgcctacgcaacgtgtcgtgggcgacagggcgttcttggctcgccgagctgcagcagtggctcaagccaggcctcaaggtactgagcattgcccaagcacactcgcctgccttttcctgcgaacaggttcgcgccttcccggcccttaccagcctagacctgtctgacaatcctggactgggcgaacgcggactgatggcggctctctgtccccacaagttcccggccatccagaatctagcgctgcgcaacacaggaatggagacgcccacaggcgtgtgcgccgcactggcggcggcaggtgtgcagccccacagcctagacctcagccacaactcgctgcgcgccaccgtaaaccctagcgctccgagatgcatgtggtccagcgccctgaactccctcaatctgtcgttcgctgggctggaacaggtgcctaaaggactgccagccaagctcagagtgctcgatctcagctgcaacagactgaacagggcgccgcagcctgacgagctgcccgaggtggataacctgacactggacgggaatcccttcctggtccctggaactgccctcccccacgagggctcaatgaactccggcgtggtcccagcctgtgcacgttcgaccctgtcggtgggggtgtcgggaaccctggtgctgctccaaggggcccggggctttgcctaagatccaagacagaataatgaatggactcaaactgccttggcttcaggggagtcccgtcaggacgttgaggacttttcgaccaattcaaccctttgccccacctttattaaaatcttaaacaacgggtc

SEQ ID NO: 881 - DNA, 1648 bp, Homo sapiens
aattctaccccccttggtgccaacagatgaggttcacaatctcttccacaaaacatgcagttaaatatctgaggatattcagggacttggatttggtggcaggagatcaacataaaccaagacaaggaagaagtcaaagaaatgaatcaagtagattctctgggatataaggaaaggaagggggctggctcggaggaagagaggtggggaggtgatcagggttcacagaggagggaactgaatgacatcccaggattacataaactgtcagaggcagccgaagagttcacaagtgtgaagcctggaagccggcgggtgccgctgtgtaggaaagaagctaaagcacttccagagcctgtccggagctcagaggttcggaagacttatcgaccatggagcgcgcgtcctgcttgttgctgctgctgctgccgctggtgcacgtctctgcgaccacgccagaaccttgtgagctggacgatgaagatttccgctgcgtctgcaacttctccgaacctcagcccgactggtccgaagccttccagtgtgtgtctgcagtagaggtggagatccatgccggcggtctcaacctagagccgtttctaaagcgcgtcgatgcggacgccgacccgcggcagtatgctgacacggtcaaggctctccgcgtgcggcggctcacagtgggagccgcacaggttcctgctcagctactggtaggcgccctgcgtgtgctagcgtactcccgcctcaaggaactgacgctcgaggacctaaagataaccggcaccatgcctccgctgcctctggaagccacaggacttgcactttccagcttgcgcctacgcaacgtgtcgtgggcgacagggcgttcttggctcgccgagctgcagcagtggctcaagccaggcctcaaggtactgagcattgcccaagcacactcgcctgccttttcctgcgaacaggttcgcgccttcccggcccttaccagcctagacctgtctgacaatcctggactgggcgaacgcggactgatggcggctctctgtccccacaagttcccggccatccagaatctagcgctgcgcaacacaggaatggagacgcccacaggcgtgtgcgccgcactggcggcggcaggtgtgcagccccacagcctagacctcagccacaactcgctgcgcgccaccgtaaaccctagcgctccgagatgcatgtggtccagcgccctgaactccctcaatctgtcgttcgctgggctggaacaggtgcctaaaggactgccagccaagctcagagtgctcgatctcagctgcaacagactgaacagggcgccgcagcctgacgagctgcccgaggtggataacctgacactggacgggaatcccttcctggtccctggaactgccctcccccacgagggctcaatgaactccggcgtggtcccagcctgtgcacgttcgaccctgtcggtgggggtgtcgggaaccctggtgctgctccaaggggcccggggctttgcctaagatccaagacagaataatgaatggactcaaactgccttggcttcaggggagtcccgtcaggacgttgaggacttttcgaccaattcaaccctttgccccacctttattaaaatcttaaacaacgggtc

SEQ ID NO: 882 - DNA, 478 bp, Homo sapiens
atcaaaagaggaaaccaacccctaagatgagctttccatgtaaatttgtagccagcttccttctgattttcaatgtttcttccaaaggtgcagtctccaaagagattacgaatgccttggaaacctggggtgccttgggtcaggacatcaacttggacattcctagttttcaaatgagtgatgatattgacgatataaaatgggaaaaaacttcagacaagaaaaagattgcacaattcagaaaagagaaagagactttcaaggaaaaagatacatataagctatttaaaaatggaactctgaaaattaagcatctgaagaccgatgatcaggatatctacaaggtatcaatatatgatacaaaaggaaaaaatgtgttggaaaaaatatttgatttgaagattcaaggtaagtgttcattcccttaattgctttatttcagtgtgggtgctatttggcaagttggaaaatagcattt

SEQ ID NO: 883 - DNA, 1609 bp, Homo sapiens
gtaaagagaggcacgtggttaagctctcggggtgtggactccaccagtctcacttcagttccttttgcatgaagagctcagaatcaaaagaggaaaccaacccctaagatgagctttccatgtaaatttgtagccagcttccttctgattttcaatgtttcttccaaaggtgcagtctccaaagagattacgaatgccttggaaacctggggtgccttgggtcaggacatcaacttggacattcctagttttcaaatgagtgatgatattgacgatataaaatgggaaaaaacttcagacaagaaaaagattgcacaattcagaaaagagaaagagactttcaaggaaaaagatacatataagctatttaaaaatggaactctgaaaattaagcatctgaagaccgatgatcaggatatctacaaggtatcaatatatgatacaaaaggaaaaaatgtgttggaaaaaatatttgatttgaagattcaagagagggtctcaaaaccaaagatctcctggacttgtatcaacacaaccctgacctgtgaggtaatgaatggaactgaccccgaattaaacctgtatcaagatgggaaacatctaaaactttctcagagggtcatcacacacaagtggaccaccagcctgagtgcaaaattcaagtgcacagcagggaacaaagtcagcaaggaatccagtgtcgagcctgtcagctgtccagagaaaggtctggacatctatctcatcattggcatatgtggaggaggcagcctcttgatggtctttgtggcactgctcgttttctatatcaccaaaaggaaaaaacagaggagtcggagaaatgatgaggagctggagacaagagcccacagagtagctactgaagaaaggggccggaagccccaccaaattccagcttcaacccctcagaatccagcaacttcccaacatcctcctccaccacctggtcatcgttcccaggcacctagtcatcgtcccccgcctcctggacaccgtgttcagcaccagcctcagaagaggcctcctgctccgtcgggcacacaagttcaccagcagaaaggcccgcccctccccagacctcgagttcagccaaaacctccccatggggcagcagaaaactcattgtccccttcctctaattaaaaaagatagaaactgtctttttcaataaaaagcactgtggatttctgccctcctgatgtgcatatccgtacttccatgaggtgttttctgtgtgcagaacattgtcacctcctgaggctgtgggccacagccacctctgcatcttcgaactcagccatgtggtcaacatctggagtttttggtctcctcagagagctccatcacaccagtaaggagaagcaatataagtgtgattgcaagaatggtagaggaccgagcacagaaatcttagagatttcttgtcccctctcaggtcatgtgtagatgcgataaatcaagtgattggtgtgcctgggtctcactacaagcagcctatctgcttaagagactctggagtttcttatgtgccctggtggacacttgcccaccatcctgtgagtaaaagtgaaataaaagctttgactag

SEQ ID NO: 884 - DNA, 3286 bp, Homo sapiens
acttctccttttgctctcagatgctgccagggtccctgaagagggaagacacgcggaaacaggcttgcacccagacacgacaccatgcatctcctcggcccctggctcctgctcctggttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcacaccccgaagttggagatcaaggtcactcccagtgatgccatagtgagggagggggactctgtgaccatgacctgcgaggtcagcagcagcaacccggagtacacgacggtatcctggctcaaggatgggacctcgctgaagaagcagaatacattcacgctaaacctgcgcgaagtgaccaaggaccagagtgggaagtactgctgtcaggtctccaatgacgtgggcccgggaaggtcggaagaagtgttcctgcaagtgcagtatgccccggaaccttccacggttcagatcctccactcaccggctgtggagggaagtcaagtcgagtttctttgcatgtcactggccaatcctcttccaacaaattacacgtggtaccacaatgggaaagaaatgcagggaaggacagaggagaaagtccacatcccaaagatcctcccctggcacgctgggacttattcctgtgtggcagaaaacattcttggtactggacagaggggcccgggagctgagctggatgtccagtatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactatagcccggagaccatcggcaggcgagtggctgtgggactcgggtcctgcctcgccatcctcatcctggcaatctgtgggctcaagctccagcgacgttggaagaggacacagagccagcaggggcttcaggagaattccagcggccagagcttctttgtgaggaataaaaaggttagaagggcccccctctctgaaggcccccactccctgggatgctacaatccaatgatggaagatggcattagctacaccaccctgcgctttcccgagatgaacataccacgaactggagatgcagagtcctcagagatgcagagacctcccccggactgcgatgacacggtcacttattcagcattgcacaagcgccaagtgggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcacacacacacacacacgcacacacacacacacacactcactgcggagaaccttgtgcctggctcagagccagtctttttggtgagggtaaccccaaacctccaaaactcctgcccctgttctcttccactctccttgctacccagaaatccatctaaatacctgccctgacatgcacacctccccctgcccccaccacggccactggccatctccacccccagctgcttgtgtccctcctgggatctgctcgtcatcatttttccttcccttctccatctctctggccctctacccctgatctgacatccccactcacgaatattatgcccagtttctgcctctgagggaaagcccagaaaaggacagaaacgaagtagaaaggggcccagtcctggcctggcttctcctttggaagtgaggcattgcacagggagacgtacgtatcagcggccccttgactctggggactccgggtttgagatggacacactggtgtggattaacctgccagggagacagagctcacaataaaaatggctcagatgccacttc

SEQ ID NO: 885 - DNA, 3084 bp, Homo sapiens
cttttgctctcagatgctgccagggtccctgaagagggaagacacgcggaaacaggcttgcacccagacacgacaccatgcatctcctcggcccctggctcctgctcctggttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcacaccccgaagttggagatcaaggtcactcccagtgatgccatagtgagggagggggactctgtgaccatgacctgcgaggtcagcagcagcaacccggagtacacgacggtatcctggctcaaggatgggacctcgctgaagaagcagaatacattcacgctaaacctgcgcgaagtgaccaaggaccagagtgggaagtactgctgtcaggtctccaatgacgtgggcccgggaaggtcggaagaagtgttcctgcaagtgcagtatgccccggaaccttccacggttcagatcctccactcaccggctgtggagggaagtcaagtcgagtttctttgcatgtcactggccaatcctcttccaacaaattacacgtggtaccacaatgggaaagaaatgcagggaaggacagaggagaaagtccacatcccaaagatcctcccctggcacgctgggacttattcctgtgtggcagaaaacattcttggtactggacagaggggcccgggagctgagctggatgtccagtatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactatagcccggagaccatcggcaggcgagtggctgtgggactcgggtcctgcctcgccatcctcatcctggcaatctgtgggctcaagctccagcgacgagatgcagagtcctcagagatgcagagacctcccccggactgcgatgacacggtcacttattcagcattgcacaagcgccaagtgggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcacacacacacacacacgcacacacacacacacacactcactgcggagaaccttgtgcctggctcagagccagtctttttggtgagggtaaccccaaacctccaaaactcctgcccctgttctcttccactctccttgctacccagaaatccatctaaatacctgccctgacatgcacacctccccctgcccccaccacggccactggccatctccacccccagctgcttgtgtccctcctgggatctgctcgtcatcatttttccttcccttctccatctctctggccctctacccctgatctgacatccccactcacgaatattatgcccagtttctgcctctgagggaaagcccagaaaaggacagaaacgaagtagaaaggggcccagtcctggcctggcttctcctttggaagtgaggcattgcacagggagacgtacgtatcagcggccccttgactctggggactccgggtttgagatggacacactggtgtggattaacctgccagggagacagagctcacaataaaaatggctcagatgccacttc

SEQ ID NO: 886 - DNA, 2755 bp, Homo sapiens
acttctccttttgctctcagatgctgccagggtccctgaagagggaagacacgcggaaacaggcttgcacccagacacgacaccatgcatctcctcggcccctggctcctgctcctggttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactatagcccggagaccatcggcaggcgagtggctgtgggactcgggtcctgcctcgccatcctcatcctggcaatctgtgggctcaagctccagcgacgttggaagaggacacagagccagcaggggcttcaggagaattccagcggccagagcttctttgtgaggaataaaaaggttagaagggcccccctctctgaaggcccccactccctgggatgctacaatccaatgatggaagatggcattagctacaccaccctgcgctttcccgagatgaacataccacgaactggagatgcagagtcctcagagatgcagagacctcccccggactgcgatgacacggtcacttattcagcattgcacaagcgccaagtgggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcacacacacacacacacgcacacacacacacacacactcactgcggagaaccttgtgcctggctcagagccagtctttttggtgagggtaaccccaaacctccaaaactcctgcccctgttctcttccactctccttgctacccagaaatccatctaaatacctgccctgacatgcacacctccccctgcccccaccacggccactggccatctccacccccagctgcttgtgtccctcctgggatctgctcgtcatcatttttccttcccttctccatctctctggccctctacccctgatctgacatccccactcacgaatattatgcccagtttctgcctctgagggaaagcccagaaaaggacagaaacgaagtagaaaggggcccagtcctggcctggcttctcctttggaagtgaggcattgcacagggagacgtacgtatcagcggccccttgactctggggactccgggtttgagatggacacactggtgtggattaacctgccagggagacagagctcacaataaaaatggctcagatgccacttc

SEQ ID NO: 887 - DNA, 2642 bp, Homo sapiens
ggaagacacgcggaaacagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcacaccccgaagttggagatcaaggtcactcccagtgatgccatagtgagggagggggactctgtgaccatgacctgcgaggtcagcagcagcaacccggagtacacgacggtatcctggctcaaggatgggacctcgctgaagaagcagaatacattcacgctaaacctgcgcgaagtgaccaaggaccagagtgggaagtactgctgtcaggtctccaatgacgtgggcccgggaaggtcggaagaagtgttcctgcaagtgcagtatgccccggaaccttccacggttcagatcctccactcaccggctgtggagggaagtcaagtcgagtttctttgcatgtcactggccaatcctcttccaacaaattacacgtggtaccacaatgggaaagaaatgcagggaaggacagaggagaaagtccacatcccaaagatcctcccctggcacgctgggacttattcctgtgtggcagaaaacattcttggtactggacagaggggcccgggagctgagctggatgtccagtatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactatagcccggagaccatcggcaggcgagtggctgtgggactcgggtcctgcctcgccatcctcatcctggcaatctgtgggctcaagctccagcgacgttggaagaggacacagagccagcaggggcttcaggagaattccagcggccagagcttctttgtgaggaataaaaaggttagaagggcccccctctctgaaggcccccactccctgggatgctacaatccaatgatggaagatggcattagctacaccaccctgcgctttcccgagatgaacataccacgaactggagatgcagagtcctcagagatgcagagacctcccccggactgcgatgacacggtcacttattcagcattgcacaagcgccaagtgggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcacacacacacacacacgcacacacacacacacacactcactgcggagaaccttgtgcctggctcagagccagtctttttggtgagggtaaccccaaacctccaaaactcctgcccctgttctcttcca

SEQ ID NO: 888 - DNA, 3022 bp, Homo sapiens
acttctccttttgctctcagatgctgccagggtccctgaagagggaagacacgcggaaacaggcttgcacccagacacgacaccatgcatctcctcggcccctggctcctgctcctggttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcacaccccgaagttggagatcaaggtcactcccagtgatgccatagtgagggagggggactctgtgaccatgacctgcgaggtcagcagcagcaacccggagtacacgacggtatcctggctcaaggatgggacctcgctgaagaagcagaatacattcacgctaaacctgcgcgaagtgaccaaggaccagagtgggaagtactgctgtcaggtctccaatgacgtgggcccgggaaggtcggaagaagtgttcctgcaagtgcagtatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactatagcccggagaccatcggcaggcgagtggctgtgggactcgggtcctgcctcgccatcctcatcctggcaatctgtgggctcaagctccagcgacgttggaagaggacacagagccagcaggggcttcaggagaattccagcggccagagcttctttgtgaggaataaaaaggttagaagggcccccctctctgaaggcccccactccctgggatgctacaatccaatgatggaagatggcattagctacaccaccctgcgctttcccgagatgaacataccacgaactggagatgcagagtcctcagagatgcagagacctcccccggactgcgatgacacggtcacttattcagcattgcacaagcgccaagtgggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcacacacacacacacacgcacacacacacacacacactcactgcggagaaccttgtgcctggctcagagccagtctttttggtgagggtaaccccaaacctccaaaactcctgcccctgttctcttccactctccttgctacccagaaatccatctaaatacctgccctgacatgcacacctccccctgcccccaccacggccactggccatctccacccccagctgcttgtgtccctcctgggatctgctcgtcatcatttttccttcccttctccatctctctggccctctacccctgatctgacatccccactcacgaatattatgcccagtttctgcctctgagggaaagcccagaaaaggacagaaacgaagtagaaaggggcccagtcctggcctggcttctcctttggaagtgaggcattgcacagggagacgtacgtatcagcggccccttgactctggggactccgggtttgagatggacacactggtgtggattaacctgccagggagacagagctcacaataaaaatggctcagatgccacttc

SEQ ID NO: 889 - DNA, 3167 bp, Homo sapiens
acttctccttttgctctcagatgctgccagggtccctgaagagggaagacacgcggaaacaggcttgcacccagacacgacaccatgcatctcctcggcccctggctcctgctcctggttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcacaccccgaagttggagatcaaggtcactcccagtgatgccatagtgagggagggggactctgtgaccatgacctgcgaggtcagcagcagcaacccggagtacacgacggtatcctggctcaaggatgggacctcgctgaagaagcagaatacattcacgctaaacctgcgcgaagtgaccaaggaccagagtgggaagtactgctgtcaggtctccaatgacgtgggcccgggaaggtcggaagaagtgttcctgcaagtgcagtatgccccggaaccttccacggttcagatcctccactcaccggctgtggagggaagtcaagtcgagtttctttgcatgtcactggccaatcctcttccaacaaattacacgtggtaccacaatgggaaagaaatgcagggaaggacagaggagaaagtccacatcccaaagatcctcccctggcacgctgggacttattcctgtgtggcagaaaacattcttggtactggacagaggggcccgggagctgagctggatgtccagtatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactatagcccggagaccatcggcaggcgagtggctgtgggactcgggtcctgcctcgccatcctcatcctggcaatctgtgggctcaagctccagcgacgttggaagaggacacagagccagcaggggcttcaggagaattccagcggccagagcttctttgtgaggaataaaaagagatgcagagtcctcagagatgcagagacctcccccggactgcgatgacacggtcacttattcagcattgcacaagcgccaagtgggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcacacacacacacacacgcacacacacacacacacactcactgcggagaaccttgtgcctggctcagagccagtctttttggtgagggtaaccccaaacctccaaaactcctgcccctgttctcttccactctccttgctacccagaaatccatctaaatacctgccctgacatgcacacctccccctgcccccaccacggccactggccatctccacccccagctgcttgtgtccctcctgggatctgctcgtcatcatttttccttcccttctccatctctctggccctctacccctgatctgacatccccactcacgaatattatgcccagtttctgcctctgagggaaagcccagaaaaggacagaaacgaagtagaaaggggcccagtcctggcctggcttctcctttggaagtgaggcattgcacagggagacgtacgtatcagcggccccttgactctggggactccgggtttgagatggacacactggtgtggattaacctgccagggagacagagctcacaataaaaatggctcagatgccacttc

SEQ ID NO: 890 - DNA, 1338 bp, Homo sapiens
aatactctccccagcacacggaaggggaagggggtggaggttgctgctatgagagagaaaaaaaaaacagccacaatagagattctgccttcaaaggttggcttgccacctgaagcagccactgcccagggggtgcaaagaagagacagcagcgcccagcttggaggtgctaactccagaggccagcatcagcaactgggcacagaaaggagccgcctgggcagggaccatggcacggccacatccctggtggctgtgcgttctggggaccctggtggggctctcagctactccagcccccaagagctgcccagagaggcactactgggctcagggaaagctgtgctgccagatgtgtgagccaggaacattcctcgtgaaggactgtgaccagcatagaaaggctgctcagtgtgatccttgcataccgggggtctccttctctcctgaccaccacacccggccccactgtgagagctgtcggcactgtaactctggtcttctcgttcgcaactgcaccatcactgccaatgctgagtgtgcctgtcgcaatggctggcagtgcagggacaaggagtgcaccgagtgtgatcctcttccaaacccttcgctgaccgctcggtcgtctcaggccctgagcccacaccctcagcccacccacttaccttatgtcagtgagatgctggaggccaggacagctgggcacatgcagactctggctgacttcaggcagctgcctgcccggactctctctacccactggccaccccaaagatccctgtgcagctccgattttattcgcatccttgtgatcttctctggaatgttccttgttttcaccctggccggggccctgttcctccatcaacgaaggaaatatagatcaaacaaaggagaaagtcctgtggagcctgcagagccttgtcattacagctgccccagggaggaggagggcagcaccatccccatccaggaggattaccgaaaaccggagcctgcctgctccccctgagccagcacctgcgggagctgcactacagccctggcctccacccccaccccgccgaccatccaagggagagtgagacctggcagccacaactgcagtcccatcctcttgtcagggccctttcctgtgtacacgtgacagagtgccttttcgagactggcagggacgaggacaaatatggatgaggtggagagtgggaagcaggagcccagccagctgcgcctgcgctgcaggagggcgggggctctggttgtaaaacacacttcctgctgcgaaagacccacatgctacaagacgggcaaaataaagtgacagatgaccaccctgca

SEQ ID NO: 891 - DNA, 2679 bp, Homo sapiens
aagaagtgggatggggcctctccagaaagctgaacgaggcatctggagcccgaacaaacctccaccttttttggcctcgacggcggcaacccagcctccctcctaacgccctccgcctttgggaccaaccaggggagctcaagttagtagcagccaaggagaggcgctgccttgccaagactaaaaagggaggggagaagagaggaaaaaagcaagaatcccccacccctctcccgggcggagggggcgggaagagcgcgtcctggccaagccgagtagtgtcttccactcggtgcgtctctctaggagccgcgcgggaaggatgctggtccgcaggggcgcgcgcgcagggcccaggatgccgcggggctggaccgcgctttgcttgctgagtttgctgccttctgggttcatgagtcttgacaacaacggtactgctaccccagagttacctacccagggaacattttcaaatgtttctacaaatgtatcctaccaagaaactacaacacctagtacccttggaagtaccagcctgcaccctgtgtctcaacatggcaatgaggccacaacaaacatcacagaaacgacagtcaaattcacatctacctctgtgataacctcagtttatggaaacacaaactcttctgtccagtcacagacctctgtaatcagcacagtgttcaccaccccagccaacgtttcaactccagagacaaccttgaagcctagcctgtcacctggaaatgtttcagacctttcaaccactagcactagccttgcaacatctcccactaaaccctatacatcatcttctcctatcctaagtgacatcaaggcagaaatcaaatgttcaggcatcagagaagtgaaattgactcagggcatctgcctggagcaaaataagacctccagctgtgcggagtttaagaaggacaggggagagggcctggcccgagtgctgtgtggggaggagcaggctgatgctgatgctggggcccaggtatgctccctgctccttgcccagtctgaggtgaggcctcagtgtctactgctggtcttggccaacagaacagaaatttccagcaaactccaacttatgaaaaagcaccaatctgacctgaaaaagctggggatcctagatttcactgagcaagatgttgcaagccaccagagctattcccaaaagaccctgattgcactggtcacctcgggagccctgctggctgtcttgggcatcactggctatttcctgatgaatcgccgcagctggagccccacaggagaaaggctgggcgaagacccttattacacggaaaacggtggaggccagggctatagctcaggacctgggacctcccctgaggctcagggaaaggccagtgtgaaccgaggggctcaggaaaacgggaccggccaggccacctccagaaacggccattcagcaagacaacacgtggtggctgataccgaattgtgactcggctaggtggggcaaggctgggcagtgtccgagagagcacccctctctgcatctgaccacgtgctacccccatgctggaggtgacatctcttacgcccaacccttccccactgcacacacctcagaggctgttcttggggccctacaccttgaggaggggcaggtaaactcctgtcctttacacattcggctccctggagccagactctggtcttctttgggtaaacgtgtgacgggggaaagccaaggtctggagaagctcccaggaacaatcgatggccttgcagcactcacacaggacccccttcccctaccccctcctctctgccgcaatacaggaacccccaggggaaagatgagcttttctaggctacaattttctcccaggaagctttgatttttaccgtttcttccctgtattttctttctctactttgaggaaaccaaagtaaccttttgcacctgctctcttgtaatgatatagccagaaaaacgtgttgccttgaaccacttccctcatctctcctccaagacactgtggacttggtcaccagctcctcccttgttctctaagttccactgagctccatgtgccccctctaccatttgcagagtcctgcacagttttctggctggagcctagaacaggcctcccaagttttaggacaaacagctcagttctagtctctctggggccacacagaaactctttttgggctcctttttctccctctggatcaaagtaggcaggaccatgggaccaggtcttggagctgagcctctcacctgtactcttccgaaaaatcctcttcctctgaggctggatcctagccttatcctctgatctccatggcttcctcctccctcctgccgactcctgggttgagctgttgcctcagtcccccaacagatgcttttctgtctctgcctccctcaccctgagccccttccttgctctgcacccccatatggtcatagcccagatcagctcctaacccttatcaccagctgcctcttctgtgggtgacccaggtccttgtttgctgttgatttctttccagaggggttgagcagggatcctggtttcaatgacggttggaaatagaaatttccagagaagagagtattgggtagatattttttctgaatacaaagtgatgtgtttaaatactgcaattaaagtgatactgaaacac

SEQ ID NO: 892 - DNA, 2874 bp, Homo sapiens
aagaagtgggatggggcctctccagaaagctgaacgaggcatctggagcccgaacaaacctccaccttttttggcctcgacggcggcaacccagcctccctcctaacgccctccgcctttgggaccaaccaggggagctcaagttagtagcagccaaggagaggcgctgccttgccaagactaaaaagggaggggagaagagaggaaaaaagcaagaatcccccacccctctcccgggcggagggggcgggaagagcgcgtcctggccaagccgagtagtgtcttccactcggtgcgtctctctaggagccgcgcgggaaggatgctggtccgcaggggcgcgcgcgcagggcccaggatgccgcggggctggaccgcgctttgcttgctgagtttgctgccttctgggttcatgagtcttgacaacaacggtactgctaccccagagttacctacccagggaacattttcaaatgtttctacaaatgtatcctaccaagaaactacaacacctagtacccttggaagtaccagcctgcaccctgtgtctcaacatggcaatgaggccacaacaaacatcacagaaacgacagtcaaattcacatctacctctgtgataacctcagtttatggaaacacaaactcttctgtccagtcacagacctctgtaatcagcacagtgttcaccaccccagccaacgtttcaactccagagacaaccttgaagcctagcctgtcacctggaaatgtttcagacctttcaaccactagcactagccttgcaacatctcccactaaaccctatacatcatcttctcctatcctaagtgacatcaaggcagaaatcaaatgttcaggcatcagagaagtgaaattgactcagggcatctgcctggagcaaaataagacctccagctgtgcggagtttaagaaggacaggggagagggcctggcccgagtgctgtgtggggaggagcaggctgatgctgatgctggggcccaggtatgctccctgctccttgcccagtctgaggtgaggcctcagtgtctactgctggtcttggccaacagaacagaaatttccagcaaactccaacttatgaaaaagcaccaatctgacctgaaaaagctggggatcctagatttcactgagcaagatgttgcaagccaccagagctattcccaaaagaccctgattgcactggtcacctcgggagccctgctggctgtcttgggcatcactggctatttcctgatgaatcgccgcagctggagccccacaggagaaaggctggagctggaaccctgaccactcttcaggaagaaaggagtctgcacatgcagctgcaccctccctccgatccttcctcccacctccccctcccccttctcccacccctgcccccacttcctgtttgggcccctctcccatccagtgtctcacagccctgcttaccagataatgctactttatttatacactgtctagggcgaagacccttattacacggaaaacggtggaggccagggctatagctcaggacctgggacctcccctgaggctcagggaaaggccagtgtgaaccgaggggctcaggaaaacgggaccggccaggccacctccagaaacggccattcagcaagacaacacgtggtggctgataccgaattgtgactcggctaggtggggcaaggctgggcagtgtccgagagagcacccctctctgcatctgaccacgtgctacccccatgctggaggtgacatctcttacgcccaacccttccccactgcacacacctcagaggctgttcttggggccctacaccttgaggaggggcaggtaaactcctgtcctttacacattcggctccctggagccagactctggtcttctttgggtaaacgtgtgacgggggaaagccaaggtctggagaagctcccaggaacaatcgatggccttgcagcactcacacaggacccccttcccctaccccctcctctctgccgcaatacaggaacccccaggggaaagatgagcttttctaggctacaattttctcccaggaagctttgatttttaccgtttcttccctgtattttctttctctactttgaggaaaccaaagtaaccttttgcacctgctctcttgtaatgatatagccagaaaaacgtgttgccttgaaccacttccctcatctctcctccaagacactgtggacttggtcaccagctcctcccttgttctctaagttccactgagctccatgtgccccctctaccatttgcagagtcctgcacagttttctggctggagcctagaacaggcctcccaagttttaggacaaacagctcagttctagtctctctggggccacacagaaactctttttgggctcctttttctccctctggatcaaagtaggcaggaccatgggaccaggtcttggagctgagcctctcacctgtactcttccgaaaaatcctcttcctctgaggctggatcctagccttatcctctgatctccatggcttcctcctccctcctgccgactcctgggttgagctgttgcctcagtcccccaacagatgcttttctgtctctgcctccctcaccctgagccccttccttgctctgcacccccatatggtcatagcccagatcagctcctaacccttatcaccagctgcctcttctgtgggtgacccaggtccttgtttgctgttgatttctttccagaggggttgagcagggatcctggtttcaatgacggttggaaatagaaatttccagagaagagagtattgggtagatattttttctgaatacaaagtgatgtgtttaaatactgcaattaaagtgatactgaaacac

SEQ ID NO: 893 - DNA, 2538 bp, Homo sapiens
acagagacccagttctgatgatggtcacacaccccagcagttttcccctaacaggaaagttgtcagggctgttcaggcatttccttctctgccatctgccatccggactgaagagaaagtcttagtttcaattcctttcctgttcaggggaggaggacactctgattggaggctgctggaataaattctgactcactattgaagaattatcagagtttttcttctgagtccaaattcctgggtctgatggcccagtcagcaacctgaagaaaaatctatgaacttcattaaaactgggttccatgcttttaatggaaaacagagatggaagacgagacaaaaatgccatttcagtttgagcaatgcactttttgagactcctttgggtagaaagagggaggaggccactgaggtttccactgagtgtatattatagatttgttctctcctcctcacctcccttggcttttcttccatcattggggactgctgtaatcttgaaacagaatattttctcttagttattattgcattattaatattttctgtttttggccatttcttttgagtttaatttgcatatgtgtacatgggcaatgcttcaacgagacaatttttttaagtttgttctctaacatcttagatactagaagatatggattttggtcctgggagattatttaggtttttttcttattgtgttgttgcacatatacagttagcagttttttttttttctgttggaattttagaaacaaggatccttcttgcggacggggcggagtttaagaaggacaggggagagggcctggcccgagtgctgtgtggggaggagcaggctgatgctgatgctggggcccaggtatgctccctgctccttgcccagtctgaggtgaggcctcagtgtctactgctggtcttggccaacagaacagaaatttccagcaaactccaacttatgaaaaagcaccaatctgacctgaaaaagctggggatcctagatttcactgagcaagatgttgcaagccaccagagctattcccaaaagaccctgattgcactggtcacctcgggagccctgctggctgtcttgggcatcactggctatttcctgatgaatcgccgcagctggagccccacaggagaaaggctgggcgaagacccttattacacggaaaacggtggaggccagggctatagctcaggacctgggacctcccctgaggctcagggaaaggccagtgtgaaccgaggggctcaggaaaacgggaccggccaggccacctccagaaacggccattcagcaagacaacacgtggtggctgataccgaattgtgactcggctaggtggggcaaggctgggcagtgtccgagagagcacccctctctgcatctgaccacgtgctacccccatgctggaggtgacatctcttacgcccaacccttccccactgcacacacctcagaggctgttcttggggccctacaccttgaggaggggcaggtaaactcctgtcctttacacattcggctccctggagccagactctggtcttctttgggtaaacgtgtgacgggggaaagccaaggtctggagaagctcccaggaacaatcgatggccttgcagcactcacacaggacccccttcccctaccccctcctctctgccgcaatacaggaacccccaggggaaagatgagcttttctaggctacaattttctcccaggaagctttgatttttaccgtttcttccctgtattttctttctctactttgaggaaaccaaagtaaccttttgcacctgctctcttgtaatgatatagccagaaaaacgtgttgccttgaaccacttccctcatctctcctccaagacactgtggacttggtcaccagctcctcccttgttctctaagttccactgagctccatgtgccccctctaccatttgcagagtcctgcacagttttctggctggagcctagaacaggcctcccaagttttaggacaaacagctcagttctagtctctctggggccacacagaaactctttttgggctcctttttctccctctggatcaaagtaggcaggaccatgggaccaggtcttggagctgagcctctcacctgtactcttccgaaaaatcctcttcctctgaggctggatcctagccttatcctctgatctccatggcttcctcctccctcctgccgactcctgggttgagctgttgcctcagtcccccaacagatgcttttctgtctctgcctccctcaccctgagccccttccttgctctgcacccccatatggtcatagcccagatcagctcctaacccttatcaccagctgcctcttctgtgggtgacccaggtccttgtttgctgttgatttctttccagaggggttgagcagggatcctggtttcaatgacggttggaaatagaaatttccagagaagagagtattgggtagatattttttctgaatacaaagtgatgtgtttaaatactgcaattaaagtgatactgaaacac

SEQ ID NO: 894 - DNA, 1307 bp, Homo sapiens
aagcaagaatcccccacccctctcccgggcggagggggcgggaagagcgcgtcctggccaagccgagtagtgtcttccactcggtgcgtctctctaggagccgcgcgggaaggatgctggtccgcaggaccgcgctttgcttgctgagtttgctgccttctgggttcatgagtcttgacaacaacggtactgctaccccagagttacctacccagggaacattttcaaatgtttctacaaatgtatcctaccaagaaactacaacacctagtacccttggaagtaccagcctgcaccctgtgtctcaacatggcaatgaggccacaacaaacatcacagaaacgacagtcaaattcacatctacctctgtgataacctcagtttatggaaacacaaactcttctgtccagtcacagacctctgtaatcagcacagtgttcaccaccccagccaacgtttcaactccagagacaaccttgaagcctagcctgtcacctggaaatgtttcagacctttcaaccactagcactagccttgcaacatctcccactaaaccctatacatcatcttctcctatcctaagtgacatcaaggcagaaatcaaatgttcaggcatcagagaagtgaaattgactcagggcatctgcctggagcaaaataagacctccagctgtgcggagtttaagaaggacaggggagagggcctggcccgagtgctgtgtggggaggagcaggctgatgctgatgctggggcccaggtatgctccctgctccttgcccagtctgaggtgaggcctcagtgtctactgctggtcttggccaacagaacagaaatttccagcaaactccaacttatgaaaaagcaccaatctgacctgaaaaagctggggatcctagatttcactgagcaagatgttgcaagccaccagagctattcccaaaagaccctgattgcactggtcacctcgggagccctgctggctgtcttgggcatcactggctatttcctgatgaatcgccgcagctggagccccacaggagaaaggctgggcgaagacccttattacacggaaaacggtggaggccagggctatagctcaggacctgggacctcccctgaggctcagggaaaggccagtgtgaaccgaggggctcaggaaaacgggaccggccaggccacctccagaaacggccattcagcaagacaacacgtggtggctgataccgaattgtgactcggctaggtggggcaaggctgggcagtgtccgagagagcacccctctctgcatctgaccacgtgctaccc

SEQ ID NO: 895 - DNA, 1362 bp, Homo sapiens
cactcggtgcgtctctctaggagccgcgcgggaaggatgctggtccgcaggggcgcgcgcgcagggcccaggatgccgcggggctggaccgcgctttgcttgctgagtttgctgccttctgggttcatgagtcttgacaacaacggtactgctaccccagagttacctacccagggaacattttcaaatgtttctacaaatgtatcctaccaagaaactacaacacctagtacccttggaagtaccagcctgcaccctgtgtctcaacatggcaatgaggccacaacaaacatcacaggcagaaatcaaatgttcaggcatcagagaagtgaaattgactcagggcatctgcctggagcaaaataagacctccagctgtgcggagtttaagaaggacaggggagagggcctggcccgagtgctgtgtggggaggagcaggctgatgctgatgctggggcccaggtatgctccctgctccttgcccagtctgaggtgaggcctcagtgtctactgctggtcttggccaacagaacagaaatttccagcaaactccaacttatgaaaaagcaccaatctgacctgaaaaagctggggatcctagatttcactgagcaagatgttgcaagccaccagagctattcccaaaagaccctgattgcactggtcacctcgggagccctgctggctgtcttgggcatcactggctatttcctgatgaatcgccgcagctggagccccacaggagaaaggctgggcgaagacccttattacacggaaaacggtggaggccagggctatagctcaggacctgggacctcccctgaggctcagggaaaggccagtgtgaaccgaggggctcaggaaaacgggaccggccaggccacctccagaaacggccattcagcaagacaacacgtggtggctgataccgaattgtgactcggctaggtggggcaaggctgggcagtgtccgagagagcacccctctctgcatctgaccacgtgctacccccatgctggaggtgacatctcttacgcccaacccttccccactgcacacacctcagaggctgttcttggggccctacaccttgaggaggggcaggtaaactcctgtcctttacacattcggctccctggagccagactctggtcttctttgggtaaacgtgtgacgggggaaagccaaggtctggagaagctcccaggaacaatcgatggccttgcagcactcacacaggacccccttcccctaccccctcctctctgccgcaatacaggaacccccaggggaaagatgagcttttctaggctacaattttctcccaggaagctttgatttttaccgtttcttccctgta

SEQ ID NO: 896 - DNA, 861 bp, Homo sapiens
agagaagcagacatcttctagttcctcccccactctcctctttccggtacctgtgagtcagctaggggagggcagctctcacccaggctgatagttcggtgacctggctttatctactggatgagttccgctgggagatggaacatagcacgtttctctctggcctggtactggctacccttctctcgcaagtgagccccttcaagatacctatagaggaacttgaggacagagtgtttgtgaattgcaataccagcatcacatgggtagagggaacggtgggaacactgctctcagacattacaagactggacctgggaaaacgcatcctggacccacgaggaatatataggtgtaatgggacagatatatacaaggacaaagaatctaccgtgcaagttcattatcgaatgtgccagagctgtgtggagctggatccagccaccgtggctggcatcattgtcactgatgtcattgccactctgctccttgctttgggagtcttctgctttgctggacatgagactggaaggctgtctggggctgccgacacacaagctctgttgaggaatgaccaggtctatcagcccctccgagatcgagatgatgctcagtacagccaccttggaggaaactgggctcggaacaagtgaacctgagactggtggcttctagaagcagccattaccaactgtaccttcccttcttgctcagccaataaatatatcctctttcactcagcaggtgcctgggcttcttaaggctcctgggcaaggcgtgggagttgtcctgacttgcttgggatctcgccctcctacctacctgtttcttccttcatctccttccttcctctgcctcaca

SEQ ID NO: 897 - DNA, 476 bp, Homo sapiens
ctactggatgagttccgctgggagatggaacatagcacgtttctctctggcctggtactggctacccttctctcgcaagtgagccccttcaagatacctatagaggaacttgaggacagagtgtttgtgaattgcaataccagcatcacatgggtagagggaacggtgggaacactgctctcagacattacaagactggacctgggaaaacgcatcctggacccacgaggaatatataggtgtaatgggacagatatatacaaggacaaagaatctaccgtgcaagttcattatcgaactgccgacacacaagctctgttgaggaatgaccaggtctatcagcccctccgagatcgagatgatgctcagtacagccaccttggaggaaactgggctcggaacaagtgaacctgagactggtggcttctagaagcagccattaccaactgtaccttcccttcttgctcagccaataa

SEQ ID NO: 898 - DNA, 3114 bp, Homo sapiens
gtttggggccggcccaggcctagggtgtggaggagccttgccatcgggcttcctgtctctcttcatttaagcacgactctgcagaaggaacaaagcaccctccccactgggctcctggttgcagagctccaagtcctcacacagatacgcctgtttgagaagcagcgggcaagaaagacgcaagcccagaggccctgccatttctgtgggctcaggtccctactggctcaggcccctgcctccctcggcaaggccacaatgaaccggggagtcccttttaggcacttgcttctggtgctgcaactggcgctcctcccagcagccactcagggaaagaaagtggtgctgggcaaaaaaggggatacagtggaactgacctgtacagcttcccagaagaagagcatacaattccactggaaaaactccaaccagataaagattctgggaaatcagggctccttcttaactaaaggtccatccaagctgaatgatcgcgctgactcaagaagaagcctttgggaccaaggaaactttcccctgatcatcaagaatcttaagatagaagactcagatacttacatctgtgaagtggaggaccagaaggaggaggtgcaattgctagtgttcggattgactgccaactctgacacccacctgcttcaggggcagagcctgaccctgaccttggagagcccccctggtagtagcccctcagtgcaatgtaggagtccaaggggtaaaaacatacagggggggaagaccctctccgtgtctcagctggagctccaggatagtggcacctggacatgcactgtcttgcagaaccagaagaaggtggagttcaaaatagacatcgtggtgctagctttccagaaggcctccagcatagtctataagaaagagggggaacaggtggagttctccttcccactcgcctttacagttgaaaagctgacgggcagtggcgagctgtggtggcaggcggagagggcttcctcctccaagtcttggatcacctttgacctgaagaacaaggaagtgtctgtaaaacgggttacccaggaccctaagctccagatgggcaagaagctcccgctccacctcaccctgccccaggccttgcctcagtatgctggctctggaaacctcaccctggcccttgaagcgaaaacaggaaagttgcatcaggaagtgaacctggtggtgatgagagccactcagctccagaaaaatttgacctgtgaggtgtggggacccacctcccctaagctgatgctgagtttgaaactggagaacaaggaggcaaaggtctcgaagcgggagaaggcggtgtgggtgctgaaccctgaggcggggatgtggcagtgtctgctgagtgactcgggacaggtcctgctggaatccaacatcaaggttctgcccacatggtccaccccggtgcagccaatggccctgattgtgctggggggcgtcgccggcctcctgcttttcattgggctaggcatcttcttctgtgtcaggtgccggcaccgaaggcgccaagcagagcggatgtctcagatcaagagactcctcagtgagaagaagacctgccagtgtcctcaccggtttcagaagacatgtagccccatttgaggcacgaggccaggcagatcccacttgcagcctccccaggtgtctgccccgcgtttcctgcctgcggaccagatgaatgtagcagatccccagcctctggcctcctgttcgcctcctctacaatttgccattgtttctcctgggttaggccccggcttcactggttgagtgttgctctctagtttccagaggcttaatcacaccgtcctccacgccatttccttttccttcaagcctagcccttctctcattatttctctctgaccctctccccactgctcatttggatcccaggggagtgttcagggccagccctggctggcatggagggtgaggctgggtgtctggaagcatggagcatgggactgttcttttacaagacaggaccctgggaccacagagggcaggaacttgcacaaaatcacacagccaagccagtcaaggatggatgcagatccagaggtttctggcagccagtacctcctgccccatgctgcccgcttctcaccctatgtgggtgggaccacagactcacatcctgaccttgcacaaacagcccctctggacacagccccatgtacacggcctcaagggatgtctcacatcctctgtctatttgagacttagaaaaatcctacaaggctggcagtgacagaactaagatgatcatctccagtttatagaccagaaccagagctcagagaggctagatgattgattaccaagtgccggactagcaagtgctggagtcgggactaacccaggtcccttgtcccaagttccactgctgcctcttgaatgcagggacaaatgccacacggctctcaccagtggctagtggtgggtactcaatgtgtacttttgggttcacagaagcacagcacccatgggaagggtccatctcagagaatttacgagcagggatgaaggcctccctgtctaaaatccctccttcatcccccgctggtggcagaatctgttaccagaggacaaagcctttggctcttctaatcagagcgcaagctgggagcacaggcactgcaggagagaatgcccagtgaccagtcactgaccctgtgcagaacctcctggaagcgagctttgctgggagagggggtagctagcctgagagggaaccctctaagggacctcaaaggtgattgtgccaggctctgcgcctgccccacaccctcccttaccctcctccagaccattcaggacacagggaaatcagggttacaaatcttcttgatccacttctctcaggatcccctctcttcctacccttcctcaccacttccctcagtcccaactccttttccctatttccttctcctcctgtctttaaagcctgcctcttccaggaagacccccctattgctgctggggctccccatttgcttactttgcatttgtgcccactctccacccctgctcccctgagctgaaataaaaatacaataaacttactataaagat

SEQ ID NO: 899 - DNA, 1720 bp, Homo sapiens
accatttcaactttaacacagcatgatcgaaacatacaaccaaacttctccccgatctgcggccactggactgcccatcagcatgaaaatttttatgtatttacttactgtttttcttatcacccagatgattgggtcagcactttttgctgtgtatcttcatagaaggttggacaagatagaagatgaaaggaatcttcatgaagattttgtattcatgaaaacgatacagagatgcaacacaggagaaagatccttatccttactgaactgtgaggagattaaaagccagtttgaaggctttgtgaaggatataatgttaaacaaagaggagacgaagaaagaaaacagctttgaaatgcaaaaagtgttacagtgggctgaaaaaggatactacaccatgagcaacaacttggtaaccctggaaaatgggaaacagctgaccgttaaaagacaaggactctattatatctatgcccaagtcaccttctgttccaatcgggaagcttcgagtcaagctccatttatagccagcctctgcctaaagtcccccggtagattcgagagaatcttactcagagctgcaaatacccacagttccgccaaaccttgcgggcaacaatccattcacttgggaggagtatttgaattgcaaccaggtgcttcggtgtttgtcaatgtgactgatccaagccaagtgagccatggcactggcttcacgtcctttggcttactcaaactctgaacagtgtcaccttgcaggctgtggtggagctgacgctgggagtcttcataatacagcacagcggttaagcccaccccctgttaactgcctatttataaccctaggatcctccttatggagaactatttattatacactccaaggcatgtagaactgtaataagtgaattacaggtcacatgaaaccaaaacgggccctgctccataagagcttatatatctgaagcagcaaccccactgatgcagacatccagagagtcctatgaaaagacaaggccattatgcacaggttgaattctgagtaaacagcagataacttgccaagttcagttttgtttctttgcgtgcagtgtctttccatggataatgcatttgatttatcagtgaagatgcagaagggaaatggggagcctcagctcacattcagttatggttgactctgggttcctatggccttgttggagggggccaggctctagaacgtctaacacagtggagaaccgaaaccccccccccccccccgccaccctctcggacagttattcattctctttcaatctctctctctccatctctctctttcagtctctctctctcaacctctttcttccaatctctctttctcaatctctctgtttccctttgtcagtctcttccctcccccagtctctcttctcaatccccctttctaacacacacacacacacacacacacacacacacacacacacacacacacacacagagtcaggccgttgctagtcagttctcttctttccaccctgtccctatctctaccactatagatgagggtgaggagtagggagtgcagccctgagcctgcccactcctcattacgaaatgactgtatttaaaggaaatctattgtatctacctgcagtctccattgtttccagagtgaacttgtaattatcttgttatttattttttgaataataaagacctcttaacatta

SEQ ID NO: 900 - DNA, 1817 bp, Homo sapiens
catgctgcctctgccaccttctctgccagaagataccatttcaactttaacacagcatgatcgaaacatacaaccaaacttctccccgatctgcggccactggactgcccatcagcatgaaaatttttatgtatttacttactgtttttcttatcacccagatgattgggtcagcactttttgctgtgtatcttcatagaaggttggacaagatagaagatgaaaggaatcttcatgaagattttgtattcatgaaaacgatacagagatgcaacacaggagaaagatccttatccttactgaactgtgaggagattaaaagccagtttgaaggctttgtgaaggatataatgttaaacaaagaggagacgaagaaagaaaacagctttgaaatgcaaaaaggtgatcagaatcctcaaattgcggcacatgtcataagtgaggccagcagtaaaacaacatctgtgttacagtgggctgaaaaaggatactacaccatgagcaacaacttggtaaccctggaaaatgggaaacagctgaccgttaaaagacaaggactctattatatctatgcccaagtcaccttctgttccaatcgggaagcttcgagtcaagctccatttatagccagcctctgcctaaagtcccccggtagattcgagagaatcttactcagagctgcaaatacccacagttccgccaaaccttgcgggcaacaatccattcacttgggaggagtatttgaattgcaaccaggtgcttcggtgtttgtcaatgtgactgatccaagccaagtgagccatggcactggcttcacgtcctttggcttactcaaactctgaacagtgtcaccttgcaggctgtggtggagctgacgctgggagtcttcataatacagcacagcggttaagcccaccccctgttaactgcctatttataaccctaggatcctccttatggagaactatttattatacactccaaggcatgtagaactgtaataagtgaattacaggtcacatgaaaccaaaacgggccctgctccataagagcttatatatctgaagcagcaaccccactgatgcagacatccagagagtcctatgaaaagacaaggccattatgcacaggttgaattctgagtaaacagcagataacttgccaagttcagttttgtttctttgcgtgcagtgtctttccatggataatgcatttgatttatcagtgaagatgcagaagggaaatggggagcctcagctcacattcagttatggttgactctgggttcctatggccttgttggagggggccaggctctagaacgtctaacacagtggagaaccgaaaccccccccccccccccgccaccctctcggacagttattcattctctttcaatctctctctctccatctctctctttcagtctctctctctcaacctctttcttccaatctctctttctcaatctctctgtttccctttgtcagtctcttccctcccccagtctctcttctcaatccccctttctaacacacacacacacacacacacacacacacacacacacacacacacacacacagagtcaggccgttgctagtcagttctcttctttccaccctgtccctatctctaccactatagatgagggtgaggagtagggagtgcagccctgagcctgcccactcctcattacgaaatgactgtatttaaaggaaatctattgtatctacctgcagtctccattgtttccagagtgaacttgtaattatcttgttatttattttttgaataataaagacctcttaacatta

SEQ ID NO: 901 - DNA, 1623 bp, Homo sapiens
tggtcctgccgcctggtctcacctcgctatggttcgtctgcctctgcagtgcgtcctctggggctgcttgctgaccgctgtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattgctacaggggtttctgataccatctgcgagccctgcccagtcggcttcttctccaatgtgtcatctgctttcgaaaaatgtcacccttggacaaggtccccaggatcggctgagagccctggtggtgatccccatcatcttcgggatcctgtttgccatcctcttggtgctggtctttatcaaaaaggtggccaagaagccaaccaataaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgagggtgaggggctggcactgactgggcatagctccccgcttctgcctgcacccctgcagtttgagacaggagacctggcactggatgcagaaacagttcaccttgaagaacctctcacttcaccctggagcccatccagtctcccaacttgtattaaagacagaggcagaagtttggtggtggtggtgttggggtatggtttagtaatatccaccagaccttccgatccagcagtttggtgcccagagaggcatcatggtggcttccctgcgcccaggaagccatatacacagatgcccattgcagcattgtttgtgatagtgaacaactggaagctgcttaactgtccatcagcaggagactggctaaataaaattagaatatatttatacaacagaatctcaaaaacactgttgagtaaggaaaaaaaggcatgctgctgaatgatgggtatggaactttttaaaaaagtacatgcttttatgtatgtatattgcctatggatatatgtataaatacaatatgcatcatatattgatataacaagggttctggaagggtacacagaaaacccacagctcgaagagtggtgacgtctggggtggggaagaagggtctgggggagggttggttaaagggagatttggctttcccataatgcttcatcatttttcccaaaaggagagtgaattcacataatgcttatgtaattaaaaaatcatcaaacatgtaaaaagaaaa

SEQ ID NO: 902 - DNA, 5815 bp, Homo sapiens
cctcgctatggttcgtctgcctctgcagtgcgtcctctggggctgcttgctgaccgctgtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattggtaagtggctcatctgggaatcagttttggagggggacagaggagcttagggcccaaggtgaggggctgggcagtgggcacttagccccagaggcagaggaagcagaggctccaacctatgtcggtatccccactggagtgagctgcagacgggaccttgttcattctgccttctgccatggggatctgcctttgaagggcaatgggagaagtcctcctggggactgcagctgtcgggggcagtaccacatcgggggaagagtgctcaaggcaggagctcttcccgtcctgcctggccactggctgccttgtgagccggacaggtggtccactgtgatggttaatgtccccctccccacccactcccagctacaggggtttctgataccatctgcgagccctgcccagtcggcttcttctccaatgtgtcatctgctttcgaaaaatgtcacccttggacaaggtataagcactcatcccttgtgtttcctgctctaagagtggcatggagctgcctccattctctccagccacctgtcctgtccctgctcccagaggtccacacacactcatgtacttgtgaagcatctgcagagtggcctcatggccaaccagacaggcacatttccacattttttttgcctgctgtctctttgaggtaatagacactgttgatctctcgcttcatgagagcctcctatcttgggggtattgggacacttattttagctttccttctgcccctcctgcttctcctcagttttcctcgtcttgctttcaccttacctggctttctagggctttctgggctctgggtgctcaccctgagggcctccctctcttacctccaactccaaacccacaccaggtcctgccactggctgtctacgtgttttgggaacttactgtctccactgttgtcactttagtttgggcctcatcactgtggtctgggtgatgccttttctgcctcctggcctccctgcctctgtctctcccctcctgctggttctgtctccatcctcttgccaacatgagcgttcgacagtttctttcaaatcatgacactctcctatttgagatgcttcctgtctctctgttggaactaagactccttagcatggcacccaaccttcctgttgcatttcctgctctctttcctgcatcgcatagcttcatgctacttgcaatcctctgaacacactgttcattctcttccatcaaactcatctgcctggaataccttaaacatgggccccaggccaggcgcggtggctcttgcctgtaatctcagcactttggatgccaaggcgggtggatcacttgaggtcaggagttcaagaccagccagcacaacatggtaaaaacccatctctactaaaaataccaaaaaattagctgggtgtggtggtgggcgcctgtaatcccagctcctcgggaggctgaggcaggagaatcacttgaacccggaaggtggagtttgcagtgagccaagatagcgccactgcactccagcctgggcaacagagcgacattctgtctcaaaaaaaaaaaaaaaaaaaaaaaagactaaagtacatggtttcttcaaagcttctctctctttctcccaccttagatgatttttcctttgcaatgtcctgtgtccattccgccccactcctcctggggccacctggaccaggtcttcatcatctcatatctatatgtttgctgtgtctcctggctggccactcttctgtaatttctcctcctctgagctctctgggcagctgaatcttctcactagtgaagtcgcctggttggatgctgatgagactgaccagctgaatccagttgaaaacttcacacttggcagtgatctggttctaaagacacaattttccatagtttcctaacaccatcctgcatgccacctgccttatttccccacatcacatcgtcccacttagcgggactgcactgctgatccaaattttacatcctttagggcccactcaggtcatatgtcctcagggaagtctttctggaagaaccttaaaccagaggttctcaacagggggcagttttgctccctgtggaacgtttgccaatgtctggacacatttcattcgtcacaaacggagagggggatgctacagggatctggcggatagaggccagggatgctgctgaacatctgcaatgcataggacagcccacccccacccccacacccccagtaaataatgatccagcccaagtgtcactggtgctgacgttgagtaaccctatcttaagctgaactcatcatctctccattccagccttggtggattctgtctcctctgaaccattcccatctcactttagcctacctagatcacaaagcttggcactcattatagactcccctatttattactccttcaagatgtgcaagaatcttttctctgcacttttaagttctgtaagaagagtctgtgtcgttcctataataaccagcataggacgttgcacgtgttgtgtgctcagtgaacctggatttgttgattgttgactgactcactctagagttggaaatcttatgcttggggaaacttaatatctctttctttctctgtgtgtgtgcatttgtgcacgtgtctgtgcatagctgtgagaccaaagacctggttgtgcaacaggcaggcacaaacaagactgatgttgtctgtggtgagtcctggacaatgggccctggagaaagcctaggaaggtgggaactgaagggggagatgaggcacacaggaacactggatgggaaaaaggggaggggaggcagtttgggggtgtggtatcacagctctgccacttatcttgggagtctgggcaaatcacttcccctctcttagcctcagtttcttcatctgtaaaatgggatgataacagcacttccttagtaggttttgattttagagtgagaaggttggcctacagtaaagatcagataatgtaaatcagtgaaaaaggtcaggggtaagaaaattacattctctttacctaacgctaaatgaccagttaatgggtgcagcacaccaacatggtacatgtatacatatgtaacaaacctgcacattatgcacatgtaccctaaagcttaaagtataataataataaaatttaaaaaaacgaaaaatacattctctttgctttttctcaaaatgtactttcctctttgtagggctgggactagaatgaggtgagcaaggcacttgccctcgggcgcaatatttaagaaggtgccataaaagtgtagtaatcaaggtaaattcattttgatgcaatatttttaaaaataaaaattaatgcaaagaaatccatgatgagcaagatagcaacattttaaataaagaacaggatccgaccctgtgtttgcatgaccctgcctcactcacctcaccctaatcctggccctggttccagtaaaaggaataggcagccagcctgcaggccgtagtttgctgacttggtgtccgcctgatgattttcaaaatatggcattaaaagaatgtttaccttgatgactgagtgttttggacatccttttcaattttgtcctgaaacaatttcatcccttgcctcacgctagtctccgccctgccttttggtctttcttttattttcccactttgaaaaaaaaattcggcatgagaaatactttacctttcccctccactcttctataccaaaagcaacatgcagacatgaatcatgctagacctcggcattgggcagagagcagggagtggcggggagcatggtgagcaggtggtgacagccactgccaccactcgcttctagatggttcccaggtggggaggctgccaactggaacccagtcttcccagtttgtaagagaaatcagatgtctaggtttgaatatgtgatctcccagtttaaaaatgtcggcaaatatttccaaacgttaagaaaatgttctggctcctttaaagacatctgccagccacatttccccaaggaccgcggtttgaaccttctgatgtagatgagctctgacattggaagattctggagtctgacaagtcacagcaggttgagggtagggagaaactgcaggtgaggggtgcatgctgaagtcctgatttctccaggtccccaggatcggctgagagccctggtggtgatccccatcatcttcgggatcctgtttgccatcctcttggtgctggtctttatcaaaaaggtggccaagaagccaaccaataaggtaggtcacccctgagaacccgggacagagttttgacaaactgggaagatggcctcacggttgcctatggggcagtaaaactgattcagagtctgtctctgcagccagtggggtggcagcagaattggggactgtcatccccacccaccatgctccttccatccagagctcaatcccccacagaactgcccctggcaccactggcagagcctaacactggctgttcttcactcctttcctggcattcaacgcgtggggagctgcatctttgggccttggggctgggtcaaatgggtgggagcaaatgtggcagccccttaagcccactggctcccactctggaagctcttcgtcgcccttggtgtggccagcagggggcaggaggcacccgaggaatcagcactgacccgccgtctgggaaaggggggagggcttggggaagggatccgcttcccagggaggggctcctcagaggcacagctgcccctgctgctgggggtgacctcacaccttgcctctccaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgagggtgaggggctggcactgactgggcatagctccccgcttctgcctgcacccctgcagtttgagacaggagacctggcactggatgcagaaacagttcaccttgaagaacctctcacttcaccctggagcccatccagtctcccaacttgtattaaagacagaggcagaagtttggtggtggtggtgttggggtatggtttagtaatatccaccagaccttccgatccagcagtttggtgcccagagaggcatcatggtggcttccctgcgcccaggaagccatatacacagatgcccattgcagcattgtttgtgatagtgaacaactggaagctgcttaactgtccatcagcaggagactggctaaataaaattagaatatatttatac

SEQ ID NO: 903 - DNA, 1729 bp, Homo sapiens
ggctggggcaggggagtcagcagaggcctcgctcgggcgcccagtggtcctgccgcctggtctcacctcgctatggttcgtctgcctctgcagtgcgtcctctggggctgcttgctgaccgctgtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattgctacaggggtttctgataccatctgcgagccctgcccagtcggcttcttctccaatgtgtcatctgctttcgaaaaatgtcacccttggacaagctgtgagaccaaagacctggttgtgcaacaggcaggcacaaacaagactgatgttgtctgtggtccccaggatcggctgagagccctggtggtgatccccatcatcttcgggatcctgtttgccatcctcttggtgctggtctttatcaaaaaggtggccaagaagccaaccaataaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgagggtgaggggctggcactgactgggcatagctccccgcttctgcctgcacccctgcagtttgagacaggagacctggcactggatgcagaaacagttcaccttgaagaacctctcacttcaccctggagcccatccagtctcccaacttgtattaaagacagaggcagaagtttggtggtggtggtgttggggtatggtttagtaatatccaccagaccttccgatccagcagtttggtgcccagagaggcatcatggtggcttccctgcgcccaggaagccatatacacagatgcccattgcagcattgtttgtgatagtgaacaactggaagctgcttaactgtccatcagcaggagactggctaaataaaattagaatatatttatacaacagaatctcaaaaacactgttgagtaaggaaaaaaaggcatgctgctgaatgatgggtatggaactttttaaaaaagtacatgcttttatgtatgtatattgcctatggatatatgtataaatacaatatgcatcatatattgatataacaagggttctggaagggtacacagaaaacccacagctcgaagagtggtgacgtctggggtggggaagaagggtctgggggagggttggttaaagggagatttggctttcccataatgcttcatcatttttcccaaaaggagagtgaattcacataatgcttatgtaattaaaaaatcatcaaacatgtaaaaagaaaa

SEQ ID NO: 904 - DNA, 4589 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacaga

SEQ ID NO: 905 - DNA, 484 bp, Homo sapiens
ccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaa

SEQ ID NO: 906 - DNA, 1023 bp, Homo sapiens
atggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaa

SEQ ID NO: 907 - DNA, 1460 bp, Homo sapiens
cctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccaatatggactccagtcatagtataacgcttcagcctactgcaaatccaaacacaggtttggtggaagatttggacaggacaggacctctttcaatgacaacgcgtagagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctt

SEQ ID NO: 908 - DNA, 2369 bp, Homo sapiens
cctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccaaagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctt

SEQ ID NO: 909 - DNA, 1768 bp, Homo sapiens
gcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttca

SEQ ID NO: 910 - DNA, 3046 bp, Homo sapiens
agcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccactttgatgagcactagtgctacagcaactgagacagcaaccaagaggcaagaaacctgggattggttttcatggttgtttctaccatcagagtcaaagaatcatcttcacacaacaacacaaatggctggtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccaaagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttca

SEQ ID NO: 911 - DNA, 2414 bp, Homo sapiens
cctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccactttgatgagcactagtgctacagcaactgagacagcaaccaagaggcaagaaacctgggattggttttcatggttgtttctaccatcagagtcaaagaatcatcttcacacaacaacacaaatggctggtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgcagatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccaaagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtataacgcttcagcctactgcaaatccaaacacaggtttggtggaagatttggacaggacaggacctctttcaatgacaacgcgtaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctt

SEQ ID NO: 912 - DNA, 2292 bp, Homo sapiens
cccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccaatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttca

SEQ ID NO: 913 - DNA, 1634 bp, Homo sapiens
ctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttc

SEQ ID NO: 914 - DNA, 2294 bp, Homo sapiens
cctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccactttgatgagcactagtgctacagcaactgagacagcaaccaagaggcaagaaacctgggattggttttcatggttgtttctaccatcagagtcaaagaatcatcttcacacaacaacacaaatggctggtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccaaagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcagagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctt

SEQ ID NO: 915 - DNA, 2369 bp, Homo sapiens
cctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccactttgatgagcactagtgctacagcaactgagacagcaaccaagaggcaagaaacctgggattggttttcatggttgtttctaccatcagagtcaaagaatcatcttcacacaacaacacaaatggctggtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgatgtagacagaaatggcaccactgcttatgaaggaaactggaacccagaagcacaccctcccctcattcaccatgagcatcatgaggaagaagagaccccacattctacaagcacaacagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctt

SEQ ID NO: 916 - DNA, 1052 bp, Homo sapiens
agtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtaagagaccagcacccgaccactggggaaagctggcggcctgggaccaggcagctgggcttagaactggaaggctcctttcccacagctgaatggattattgcctaaggagtcaaccccacgtattaatttggccaagtcaatctgcaacctgtatgacaactggagtttaaagtcagctaaagacacctttgtgaatcatagagcgggaacccagaggaagccattaggggtcctctcggctggaatcctcttgtctaacctgcttccacagagctctcctggctttgaagaagctgcagtatcattgtcagaaccacaagaaaacataaaccaaataacagtgtttgaaataaatatgtggctgttagagtcttggccctgcagacttggatca

SEQ ID NO: 917 - DNA, 1825 bp, Homo sapiens
ggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaagttgaagagattcaggttatagcataagaagagcactgtttcatcgtcttcttgctgttaggaggtctatgaagcagagaagaactttcctttggaaaacaactaaatgaagacagtcacctcgctagaactgacacatgggctgtttttatattcttgaaggccactctctccctacctgaaccaagacctataggtttacatgttatttacattttatatataatatatatatatatatatacacatacattatatatacacaatagtaattctagcaacagaggaaatgacctttaacaggggtataaatctaaatttataaaagtataaatctaaatttcttacccaagacactttaaagatacattatttttctccaggacgtaattcataggaatattaagccttttgtaaatgtccctttagatggtttctcataaggtaaaagaaacttatttccaagcaggaccacctttattgtgtccccagatcacctcacagggcagaaaaatgcccctcagtctgggagaagacctagagagaattatggactccttactggtttttggaaagcaaccaacagctaattccaacaccatgggcagcccatacagtctctaattatctgagaaaatcaaatgatgctgttacaataattacgctggtacaagttaataaaagtgccatgttacagtcaaacagctatgttgctatctataccattgagggcatagttttaaaaagtagttatgctacctgattgtataaggaacaaaactgagagaaaaaatctaaaaggccgcctatgattgaatggaaagattttttttagttgaatttaaataatgtgacttgggggagcctttacaaagagtctttatacctcccttcagcttcctcattttcccttggattacttttgctcaattaaatatgaatttcct

SEQ ID NO: 918 - DNA, 5020 bp, Homo sapiens
tgggcagtgggtcctgcctgtgacgcgcggcggcggtcggtcctgcctgtaacggcggcggcggctgctgctccggacacctgcggcggcggcggcgaccccgcggcgggcgcggagatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgttgtttgcccaattgagatccagttttttgttgttatttttaatcaattaggggcaatagtagaatggacaatttccaagaatgatgcctttcaggtcctagggcctctggcctctaggtaaccagtttaaattggttcagggtgataactacttagcactgccctggtgattacccagagatatctatgaaaaccagtggcttccatcaaacctttgccaactcaggttcacagcagctttgggcagttatggcagtatggcattagctgagaggtgtctgccacttctgggtcaatggaataataaattaagtacaggcaggaatttggttgggagcatcttgtatgatctccgtatgatgtgatattgatggagatagtggtcctcattcttgggggttgccattcccacattcccccttcaacaaacagtgtaacaggtccttcccagatttagggtacttttattgatggatatgttttccttttattcacataaccccttgaaaccctgtcttgtcctcctgttacttgcttctgctgtacaagatgtagcaccttttctcctctttgaacatggtctagtgacacggtagcaccagttgcaggaaggagccagacttgttctcagagcactgtgttcacacttttcagcaaaaatagctatggttgtaacatatgtattcccttcctctgatttgaaggcaaaaatctacagtgtttcttcacttcttttctgatctggggcatgaaaaaagcaagattgaaatttgaactatgagtctcctgcatggcaacaaaatgtgtgtcaccatcaggccaacaggccagcccttgaatggggatttattactgttgtatctatgttgcatgataaacattcatcaccttcctcctgtagtcctgcctcgtactccccttcccctatgattgaaaagtaaacaaaacccacatttcctatcctggttagaagaaaattaatgttctgacagttgtgatcgcctggagtacttttagacttttagcattcgttttttacctgtttgtggatgtgtgtttgtatgtgcatacgtatgagataggcacatgcatcttctgtatggacaaaggtggggtacctacaggagagcaaaggttaattttgtgcttttagtaaaaacatttaaatacaaagttctttattgggtggaattatatttgatgcaaatatttgatcacttaaaacttttaaaacttctaggtaatttgccacgctttttgactgctcaccaataccctgtaaaaatacgtaattcttcctgtttgtgtaataagatattcatatttgtagttgcattaataatagttatttcttagtccatcagatgttcccgtgtgcctcttttatgccaaattgattgtcatatttcatgttgggaccaagtagtttgcccatggcaaacctaaatttatgacctgctgaggcctctcagaaaactgagcatactagcaagacagctcttcttgaaaaaaaaaatatgtatacacaaatatatacgtatatctatatatacgtatgtatatacacacatgtatattcttccttgattgtgtagctgtccaaaataataacatatatagagggagctgtattcctttatacaaatctgatggctcctgcagcactttttccttctgaaaatatttacattttgctaacctagtttgttactttaaaaatcagttttgatgaaaggagggaaaagcagatggacttgaaaaagatccaagctcctattagaaaaggtatgaaaatctttatagtaaaattttttataaactaaagttgtaccttttaatatgtagtaaactctcatttatttggggttcgctcttggatctcatccatccattgtgttctctttaatgctgcctgccttttgaggcattcactgccctagacaatgccaccagagatagtgggggaaatgccagatgaaaccaactcttgctctcactagttgtcagcttctctggataagtgaccacagaagcaggagtcctcctgcttgggcatcattgggccagttccttctctttaaatcagatttgtaatggctcccaaattccatcacatcacatttaaattgcagacagtgttttgcacatcatgtatctgttttgtcccataatatgctttttactccctgatcccagtttctgctgttgactcttccattcagttttatttattgtgtgttctcacagtgacaccatttgtccttttctgcaacaacctttccagctacttttgccaaattctatttgtcttctccttcaaaacattctcctttgcagttcctcttcatctgtgtagctgctcttttgtctcttaacttaccattcctatagtactttatgcatctctgcttagttctattagttttttggccttgctcttctccttgattttaaaattccttctatagctagagcttttctttctttcattctctcttcctgcagtgttttgcatacatcagaagctaggtacataagttaaatgattgagagttggctgtatttagatttatcactttttaatagggtgagcttgagagttttctttctttctgttttttttttttgttttttttttttttttttttttttttttttttgactaatttcacatgctctaaaaaccttcaaaggtgattatttttctcctggaaactccaggtccattctgtttaaatccctaagaatgtcagaattaaaataacagggctatcccgtaattggaaatatttcttttttcaggatgctatagtcaatttagtaagtgaccaccaaattgttatttgcactaacaaagctcaaaacacgataagtttactcctccatctcagtaataaaaattaagctgtaatcaaccttctaggtttctcttgtcttaaaatgggtattcaaaaatggggatctgtggtgtatgtatggaaacacatactccttaatttacctgttgttggaaactggagaaatgattgtcgggcaaccgtttattttttattgtattttatttggttgagggatttttttataaacagttttacttgtgtcatattttaaaattactaactgccatcacctgctggggtcctttgttaggtcattttcagtgactaatagggataatccaggtaactttgaagagatgagcagtgagtgaccaggcagtttttctgcctttagctttgacagttcttaattaagatcattgaagaccagctttctcataaatttctctttttgaaaaaaagaaagcatttgtactaagctcctctgtaagacaacatcttaaatcttaaaagtgttgttatcatgactggtgagagaagaaaacattttgtttttattaaatggagcattatttacaaaaagccattgttgagaattagatcccacatcgtataaatatctattaaccattctaaataaagagaactccagtgttgctatgtgcaagatcctctcttggagcttttttgcatagcaattaaaggtgtgctatttgtcagtagccatttttttgcagtgatttgaagaccaaagttgttttacagctgtgttaccgttaaaggtttttttttttatatgtattaaatcaatttatcactgtttaaagctttgaatatctgcaatctttgccaaggtacttttttatttaaaaaaaaacataactttgtaaatattaccctgtaatattatatatacttaataaaacattttaagcta

SEQ ID NO: 919 - DNA, 1285 bp, Homo sapiens
tcctgcctgtgacgcgcggcggcggtcggtcctgcctgtaacggcggcggcggctgctgctccggacacctgcggcggcggcggcgaccccgcggcgggcgcggagatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaaagctgtagaggaaccccttaatgcattcaaagaatcaaaaggaatgatgaatgatgaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatc

SEQ ID NO: 920 - DNA, 3221 bp, Homo sapiens
aacttcaaacatgggtgacgcaggccccacactgcctgctccccgtcccacccctccctgagcacgccaccccgccctctccctctctgagagcgagatacccggccagacaccctcacctgcggtgcccagctgcccaggctgaggcaagagaaggccagaaaccatgcccatggggtctctgcaaccgctggccaccttgtacctgctggggatgctggtcgcttcctgcctcggacggctcagctggtatgacccagatttccaggcaaggctcacccgttccaactcgaagtgccagggccagctggaggtctacctcaaggacggatggcacatggtttgcagccagagctggggccggagctccaagcagtgggaggaccccagtcaagcgtcaaaagtctgccagcggctgaactgtggggtgcccttaagccttggccccttccttgtcacctacacacctcagagctcaatcatctgctacggacaactgggctccttctccaactgcagccacagcagaaatgacatgtgtcactctctgggcctgacctgcttagaaccccagaagacaacacctccaacgacaaggcccccgcccaccacaactccagagcccacagctcctcccaggctgcagctggtggcacagtctggcggccagcactgtgccggcgtggtggagttctacagcggcagcctggggggtaccatcagctatgaggcccaggacaagacccaggacctggagaacttcctctgcaacaacctccagtgtggctccttcttgaagcatctgccagagactgaggcaggcagagcccaagacccaggggagccacgggaacaccagcccttgccaatccaatggaagatccagaactcaagctgtacctccctggagcattgcttcaggaaaatcaagccccagaaaagtggccgagttcttgccctcctttgctcaggtttccagcccaaggtgcagagccgtctggtggggggcagcagcatctgtgaaggcaccgtggaggtgcgccagggggctcagtgggcagccctgtgtgacagctcttcagccaggagctcgctgcggtgggaggaggtgtgccgggagcagcagtgtggcagcgtcaactcctatcgagtgctggacgctggtgacccaacatcccgggggctcttctgtccccatcagaagctgtcccagtgccacgaactttgggagagaaattcctactgcaagaaggtgtttgtcacatgccaggatccaaaccccgcaggcctggccgcaggcacggtggcaagcatcatcctggccctggtgctcctggtggtgctgctggtcgtgtgcggcccccttgcctacaagaagctagtgaagaaattccgccagaagaagcagcgccagtggattggcccaacgggaatgaaccaaaacatgtctttccatcgcaaccacacggcaaccgtccgatcccatgctgagaaccccacagcctcccacgtggataacgaatacagccaacctcccaggaactcccacctgtcagcttatccagctctggaaggggctctgcatcgctcctccatgcagcctgacaactcctccgacagtgactatgatctgcatggggctcagaggctgtaaagaactgggatccatgagcaaaaagccgagagccagacctgtttgtcctgagaaaactgtccgctcttcacttgaaatcatgtccctatttctaccccggccagaacatggacagaggccagaagccttccggacaggcgctgctgccccgagtggcaggccagctcacactctgctgcacaacagctcggccgcccctccacttgtggaagctgtggtgggcagagccccaaaacaagcagccttccaactagagactcgggggtgtctgaagggggccccctttccctgcccgctggggagcggcgtctcagtgaaatcggctttctcctcagactctgtccctggtaaggagtgacaaggaagctcacagctgggcgagtgcattttgaatagttttttgtaagtagtgcttttcctccttcctgacaaatcgagcgctttggcctcttctgtgcagcatccacccctgcggatccctctggggaggacaggaaggggactcccggagacctctgcagccgtggtggtcagaggctgctcacctgagcacaaagacagctctgcacattcaccgcagctgccagccaggggtctgggtgggcaccaccctgacccacagcgtcaccccactccctctgtcttatgactcccctccccaaccccctcatctaaagacaccttcctttccactggctgtcaagcccacagggcaccagtgccacccagggcccggcacaaaggggcgcctagtaaaccttaaccaacttggttttttgcttcacccagcaattaaaagtcccaagctgaggtagtttcagtccatcacagttcatcttctaacccaagagtcagagatggggctggtcatgttcctttggtttgaataactcccttgacgaaaacagactcctctagtacttggagatcttggacgtacacctaatcccatggggcctcggcttccttaactgcaagtgagaagaggaggtctacccaggagcctcgggtctgatcaagggagaggccaggcgcagctcactgcggcggctccctaagaaggtgaagcaacatgggaacacatcctaagacaggtcctttctccacgccatttgatgctgtatctcctgggagcacaggcatcaatggtccaagccgcataataagtctggaagagcaaaagggagttactaggatatggggtgggctgctcccagaatctgctcagctttctgcccccaccaacaccctccaaccaggccttgccttctgagagcccccgtggccaagcccaggtcacagatcttcccccgaccatgctgggaatccagaaacagggaccccatttgtcttcccatatctggtggaggtgagggggctcctcaaaagggaactgagaggctgctcttagggagggcaaaggttcgggggcagccagtgtctcccatcagtgccttttttaataaaagctctttcatctatagtttggccaccatacagtggcctcaaagcaaccatggcctacttaaaaaccaaaccaaaaataaagagtttagttgaggagaaa

SEQ ID NO: 921 - DNA, 896 bp, Homo sapiens
ccagagaggggcaggctggtcccctgacaggttgaagcaagtagacgcccaggagccccgggagggggctgcagtttccttccttccttctcggcagcgctccgcgcccccatcgcccctcctgcgctagcggaggtgatcgccgcggcgatgccggaggagggttcgggctgctcggtgcggcgcaggccctatgggtgcgtcctgcgggctgctttggtcccattggtcgcgggcttggtgatctgcctcgtggtgtgcatccagcgcttcgcacaggctcagcagcagctgccgctcgagtcacttgggtgggacgtagctgagctgcagctgaatcacacaggacctcagcaggaccccaggctatactggcaggggggcccagcactgggccgctccttcctgcatggaccagagctggacaaggggcagctacgtatccatcgtgatggcatctacatggtacacatccaggtgacgctggccatctgctcctccacgacggcctccaggcaccaccccaccaccctggccgtgggaatctgctctcccgcctcccgtagcatcagcctgctgcgtctcagcttccaccaaggttgtaccattgcctcccagcgcctgacgcccctggcccgaggggacacactctgcaccaacctcactgggacacttttgccttcccgaaacactgatgagaccttctttggagtgcagtgggtgcgcccctgaccactgctgctgattagggttttttaaattttattttattttatttaagttcaagagaaaaagtgtacacacaggggccacccggggttggggtgggagtgtggtggggcgtagtggtggcaggacaagagaaggcattgagctttttctttcattttcctatt

SEQ ID NO: 922 - DNA, 915 bp, Homo sapiens
aagtagacgcccaggagccccgggagggggctgcagtttccttccttccttctcggcagcgctccgcgcccccatcgcccctcctgcgctagcggaggtgatcgccgcggcgatgccggaggagggttcgggctgctcggtgcggcgcaggccctatgggtgcgtcctgcgggctgctttggtcccattggtcgcgggcttggtgatctgcctcgtggtgtgcatccagcgcttcgcacaggctcagcagcagctgccgctcgagtcacttgggtgggacgtagctgagctgcagctgaatcacacaggacctcagcaggaccccaggctatactggcaggggggcccagcactgggccgctccttcctgcatggaccagagctggacaaggggcagctacgtatccatcgtgatggcatctacatggtacacatccaggtgacgctggccatctgctcctccacgacggcctccaggcaccaccccaccaccctggccgtgggaatctgctctcccgcctcccgtagcatcagcctgctgcgtctcagcttccaccaagggctttttggattttggaactggggactcaaagtcaagtgcttcttacggcatttaatatggactgcacactgttttatcccattaactcagctcgtgttcatgcaagccctacaaagctggaggaatcatcattgttcccatttcacagatgaggaaaacagaggcgtaaaccgttgagtcatctgtccaaagttactggttttgtaacagctggaacctcagtatttaacagttgaggaaaatagtggcagaaaacctgagtcacaagcccgaggcaattcatctacatagtagtggactcaggattccaagccagataatcccgcatcttgcatccatgatctcacttctag

SEQ ID NO: 923 - DNA, 1258 bp, Homo sapiens
tccactcacagcctgaagcatacccggcaggggctgtccccaggcccaacaagcaaagggcccagtagcgagggccactggagcccatctccggggggctgggcaggaagtagggtggggtttggggtagggatctggtaccctgggactgctgcaactcaaactaaccaacccactgggagaagatgcctgggggtccaggagtcctccaagctctgcctgccaccatcttcctcctcttcctgctgtctgctgtctacctgggccctgggtgccaggccctgtggatgcacaaggtcccagcatcattgatggtgagcctgggggaagacgcccacttccaatgcccgcacaatagcagcaacaacgccaacgtcacctggtggcgcgtcctccatggcaactacacgtggccccctgagttcttgggcccgggcgaggaccccaatggtacgctgatcatccagaatgtgaacaagagccatgggggcatatacgtgtgccgggtccaggagggcaacgagtcataccagcagtcctgcggcacctacctccgcgtgcgccagccgccccccaggcccttcctggacatgggggagggcaccaagaaccgaatcatcacagccgaggggatcatcctcctgttctgcgcggtggtgcctgggacgctgctgctgttcaggaaacgatggcagaacgagaagctcgggttggatgccggggatgaatatgaagatgaaaacctttatgaaggcctgaacctggacgactgctccatgtatgaggacatctcccggggcctccagggcacctaccaggatgtgggcagcctcaacataggagatgtccagctggagaagccgtgacacccctactcctgccaggctgcccccgcctgctgtgcacccagctccagtgtctcagctcacttccctgggacattctcctttcagcccttctgggggcttccttagtcatattcccccagtggggggtgggagggtaacctcactcttctccaggccaggcctccttggactcccctgggggtgtcccactcttcttccctctaaactgccccacctcctaacctaatccccccgccccgctgcctttcccaggctcccctcaccccagcgggtaatgagcccttaatcgctgcctctaggggagctgattgtagcagcctcgttagtgtcaccccctcctccctgatctgtcagggccacttagtgataataaattcttcccaactgca

SEQ ID NO: 924 - DNA, 1144 bp, Homo sapiens
tccactcacagcctgaagcatacccggcaggggctgtccccaggcccaacaagcaaagggcccagtagcgagggccactggagcccatctccggggggctgggcaggaagtagggtggggtttggggtagggatctggtaccctgggactgctgcaactcaaactaaccaacccactgggagaagatgcctgggggtccaggagtcctccaagctctgcctgccaccatcttcctcctcttcctgctgtctgctgtctacctgggccctgggtgccaggccctgtggatgcacaaggtcccagcatcattgatggtgagcctgggggaagacgcccacttccaatgcccgcacaatagcagcaacaacgccaacgtcacctggtggcgcgtcctccatggcaactacacgtggccccctgagttcttgggcccgggcgaggaccccaatgagccgccccccaggcccttcctggacatgggggagggcaccaagaaccgaatcatcacagccgaggggatcatcctcctgttctgcgcggtggtgcctgggacgctgctgctgttcaggaaacgatggcagaacgagaagctcgggttggatgccggggatgaatatgaagatgaaaacctttatgaaggcctgaacctggacgactgctccatgtatgaggacatctcccggggcctccagggcacctaccaggatgtgggcagcctcaacataggagatgtccagctggagaagccgtgacacccctactcctgccaggctgcccccgcctgctgtgcacccagctccagtgtctcagctcacttccctgggacattctcctttcagcccttctgggggcttccttagtcatattcccccagtggggggtgggagggtaacctcactcttctccaggccaggcctccttggactcccctgggggtgtcccactcttcttccctctaaactgccccacctcctaacctaatccccccgccccgctgcctttcccaggctcccctcaccccagcgggtaatgagcccttaatcgctgcctctaggggagctgattgtagcagcctcgttagtgtcaccccctcctccctgatctgtcagggccacttagtgataataaattcttcccaactgca

SEQ ID NO: 925 - DNA, 2725 bp, Homo sapiens
aagtaacagaagttagaaggggaaatgtcgcctctctgaagattacccaaagaaaaagtgatttgtcattgctttatagactgtaagaagagaacatctcagaagtggagtcttaccctgaaatcaaaggatttaaagaaaaagtggaatttttcttcagcaagctgtgaaactaaatccacaacctttggagacccaggaacaccctccaatctctgtgtgttttgtaaacatcactggagggtcttctacgtgagcaattggattgtcatcagccctgcctgttttgcacctgggaagtgccctggtcttacttgggtccaaattgttggctttcacttttgaccctaagcatctgaagccatgggccacacacggaggcagggaacatcaccatccaagtgtccatacctcaatttctttcagctcttggtgctggctggtctttctcacttctgttcaggtgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgatcctggctctgcgcccatctgacgagggcacatacgagtgtgttgttctgaagtatgaaaaagacgctttcaagcgggaacacctggctgaagtgacgttatcagtcaaagctgacttccctacacctagtatatctgactttgaaattccaacttctaatattagaaggataatttgctcaacctctggaggttttccagagcctcacctctcctggttggaaaatggagaagaattaaatgccatcaacacaacagtttcccaagatcctgaaactgagctctatgctgttagcagcaaactggatttcaatatgacaaccaaccacagcttcatgtgtctcatcaagtatggacatttaagagtgaatcagaccttcaactggaatacaaccaagcaagagcattttcctgataacctgctcccatcctgggccattaccttaatctcagtaaatggaatttttgtgatatgctgcctgacctactgctttgccccaagatgcagagagagaaggaggaatgagagattgagaagggaaagtgtacgccctgtataacagtgtccgcagaagcaaggggctgaaaagatctgaaggtcccacctccatttgcaattgacctcttctgggaacttcctcagatggacaagattaccccaccttgccctttacgtatctgctcttaggtgcttcttcacttcagttgctttgcaggaagtgtctagaggaatatggtgggcacagaagtagctctggtgaccttgatcaaggtgttttgaaatgcagaattcttgagttctggaagggactttagagaataccagtgttattaatgacaaaggcactgaggcccagggaggtgacccgaattataaaggccagcgccagaacccagatttcctaactctggtgctctttccctttatcagtttgactgtggcctgttaactggtatatacatatatatgtcaggcaaagtgctgctggaagtagaatttgtccaataacaggtcaacttcagagactatctgatttcctaatgtcagagtagaagattttatgctgctgtttacaaaagcccaatgtaatgcataggaagtatggcatgaacatctttaggagactaatggaaatattattggtgtttacccagtattccatttttttcattgtgttctctattgctgctctctcactcccccatgaggtacagcagaaaggagaactatccaaaactaatttcctctgacatgtaagacgaatgatttaggtacgtcaaagcagtagtcaaggaggaaagggatagtccaaagacttaactggttcatattggactgataatctctttaaatggctttatgctagtttgacctcatttgtaaaatatttatgagaaagttctcatttaaaatgagatcgttgtttacagtgtatgtactaagcagtaagctatcttcaaatgtctaaggtagtaactttccatagggcctccttagatccctaagatggctttttctccttggtatttctgggtctttctgacatcagcagagaactggaaagacatagccaactgctgttcatgttactcatgactcctttctctaaaactgccttccacaattcactagaccagaagtggacgcaacttaagctgggataatcacattatcatctgaaaatctggagttgaacagcaaaagaagacaacatttctcaaatgcacatctcatggcagctaagccacatggctgggatttaaagcctttagagccagcccatggctttagctacctcactatgctgcttcacaaaccttgctcctgtgtaaaactatattctcagtgtagggcagagaggtctaacaccaacataaggtactagcagtgtttcccgtattgacaggaatacttaactcaataattcttttcttttccatttagtaacagttgtgatgactatgtttctattctaagtaattcctgtattctacagcagatactttgtcagcaatactaagggaagaaacaaagttgaaccgtttctttaataa

SEQ ID NO: 926 - DNA, 489 bp, Homo sapiens
atgggccacacacggaggcagggaacatcaccatccaagtgtccatacctcaatttctttcagctcttggtgctggctggtctttctcacttctgttcaggtgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgatcctggctctgcgcccatctgacgagggcacatacgagtgtgttgttctgaagtatgaaaaagacgctttcaagcgggaacacctggctgaagtgacgttatcagtcaaaggctttgccccaagatgcagagagagaaggaggaatgagagattgagaagggaaagtgtacgccctgtataa

SEQ ID NO: 927 - DNA, 771 bp, Homo sapiens
atgggccacacacggaggcagggaacatcaccatccaagtgtccatacctcaatttctttcagctcttggtgctggctggtctttctcacttctgttcaggtgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgatcctggctctgcgcccatctgacgagggcacatacgagtgtgttgttctgaagtatgaaaaagacgctttcaagcgggaacacctggctgaagtgacgttatcagtcaaagctgacttccctacacctagtatatctgactttgaaattccaacttctaatattagaaggataatttgctcaacctctggaggttttccagagcctcacctctcctggttggaaaatggagaagaattaaatgccatcaacacaacagtttcccaagatcctgaaactgagctctatgctgttagcagcaaactggatttcaatatgacaaccaaccacagcttcatgtgtctcatcaagtatggacatttaagagtgaatcagaccttcaactggaatacaagctttgccccaagatgcagagagagaaggaggaatgagagattgagaagggaaagtgtacgccctgtataa

SEQ ID NO: 928 - DNA, 1491 bp, Homo sapiens
ccaaagaaaaagtgatttgtcattgctttatagactgtaagaagagaacatctcagaagtggagtcttaccctgaaatcaaaggatttaaagaaaaagtggaatttttcttcagcaagctgtgaaactaaatccacaacctttggagacccaggaacaccctccaatctctgtgtgttttgtaaacatcactggagggtcttctacgtgagcaattggattgtcatcagccctgcctgttttgcacctgggaagtgccctggtcttacttgggtccaaattgttggctttcacttttgaccctaagcatctgaagccatgggccacacacggaggcagggaacatcaccatccaagtgtccatacctcaatttctttcagctcttggtgctggctggtctttctcacttctgttcaggtgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgatcctggctctgcgcccatctgacgagggcacatacgagtgtgttgttctgaagtatgaaaaagacgctttcaagcgggaacacctggctgaagtgacgttatcagtcaaagctgacttccctacacctagtatatctgactttgaaattccaacttctaatattagaaggataatttgctcaacctctggaggttttccagagcctcacctctcctggttggaaaatggagaagaattaaatgccatcaacacaacagtttcccaagatcctgaaactgagctctatgctgttagcagcaaactggatttcaatatgacaaccaaccacagcttcatgtgtctcatcaagtatggacatttaagagtgaatcagaccttcaactggaatacaaccaagcaagagcattttcctgataacctgctcccatcctgggccattaccttaatctcagtaaatggaatttttgtgatatgctgcctgacctactgctttgccccaagatgcagagagagaaggaggaatgagagattgagaagggaaagtgtacgccctgtataacagtgtccgcagaagcaaggggctgaaaagatctgaaggtagcctccgtcatctcttctgggatacatggatcgtggggatcatgaggcattcttcccttaacaaatttaagctgttttacccactacctcaccttcttaaaaacctctttcagattaagctgaacagttacaagatggctggcatccctctcctttctccccatatgcaatttgcttaatgtaacctcttcttttgccatgtttccattctgccatcttgaattgtcttgtcagccaattcattatctattaaacactaatttgag

SEQ ID NO: 929 - DNA, 2289 bp, Homo sapiens
ggcctgccgagtccgcggcgttccccggctgcagccgggagggggccgaggagtgactgagccccgggctgtgcagtccgacgccgactgaggcacgagcgggtgacgctgggcctgcagcgcggagcagaaagcagaacccgcagagtcctccctgctgctgtgtggacgacacgtgggcacaggcagaagtgggccctgtgaccagctgcactggtttcgtggaaggaagctccaggactggcgggatgggctcagcctgtatcaaagtcaccaaatactttctcttcctcttcaacttgatcttctttatcctgggcgcagtgatcctgggcttcggggtgtggatcctggccgacaagagcagtttcatctctgtcctgcaaacctcctccagctcgcttaggatgggggcctatgtcttcatcggcgtgggggcagtcactatgctcatgggcttcctgggctgcatcggcgccgtcaacgaggtccgctgcctgctggggctgtactttgctttcctgctcctgatcctcattgcccaggtgacggccggggccctcttctacttcaacatgggcaagctgaagcaggagatgggcggcatcgtgactgagctcattcgagactacaacagcagtcgcgaggacagcctgcaggatgcctgggactacgtgcaggctcaggtgaagtgctgcggctgggtcagcttctacaactggacagacaacgctgagctcatgaatcgccctgaggtcacctacccctgttcctgcgaagtcaagggggaagaggacaacagcctttctgtgaggaagggcttctgcgaggcccccggcaacaggacccagagtggcaaccaccctgaggactggcctgtgtaccaggagggctgcatggagaaggtgcaggcgtggctgcaggagaacctgggcatcatcctcggcgtgggcgtgggtgtggccatcatcgagctcctggggatggtcctgtccatctgcttgtgccggcacgtccattccgaagactacagcaaggtccccaagtactgaggcagctgctatccccatctccctgcctggcccccaacctcagggctcccaggggtctccctggctccctcctccaggcctgcctcccacttcactgcgaagaccctcttgcccatcctgactgaaagtagggggctttctggggcctagcgatctctcctggcctatccgctgccagccttgagccctggctgttctgtggttcctctgctcaccgcccatcagggttctcttagcaactcagagaaaaatgctccccacagcgtccctggcgcaggtgggctggacttctacctgccctcaagggtgtgtatattgtataggggcaactgtatgaaaaattggggaggagggggccgggcgcggtggctcacgcctgtaatcccagcactttgggaggccgaggcgggtggatcacgaggtcaggagatcgagaccatcctggctaacatggtgaaaccccgtctctactaaaaatacaaaaaaaatttagccgggcgcggtggcgggcacctgtagtcccagctacttgggaggctgaggcaggagaatggtgtgaacccgggagcggaggttgcagtgagctgagatcgtgctactgcactccagcctgggggacagaaagagactccgtctcaaaaaaaaaaaaaaaaaaaaaaaaaattggggagggaagggcgttagataaggcactctgggctgtcaggagactgcctactgggtgggtcaacttatttcccactatgacatttatatctttatttttcacaattatattgaaggcagtgggagaggggagagggtgggttttacctgatattaaggggtggcaccccttccccaggcctgatgcaggtccatctagacagctcagattagcctaggccatgccctagggacacggcctaggggagctgggctggagggggtctgcctgggtaaggggatctggcttggccctgagctgcttagggacaggtgagtccttgggggcatggcacagagctggtcctgtattctccagggtccggagctggccaggggcggggaggaggaggatggcttctcctgggagaaggtgggctggcctttcttggcaagcggtcctctggcccctggggagtggggtgggtgaggctgtgccttgtagggggagaggggagggggctttgtgtgcaccattctgtaaaacacactcaagattctaagactattaaagaggatttataacagtcta

SEQ ID NO: 930 - DNA, 967 bp, Homo sapiens
gtccgcggcgttccccggctgcagccgggagggggccgaggagtgactgagccccgggctgtgcagtccgacgccgactgaggcacgagcgggtgacgctgggcctgcagcgcggagcagaaagcagaacccgcagagtcctccctgctgctgtgtggacgacacgtgggcacaggcagaagtgggccctgtgaccagctgcactggtttcgtggaaggaagctccaggactggcgggatgggctcagcctgtatcaaagtcaccaaatactttctcttcctcttcaacttgatcttctttatcctgggcgcagtgatcctgggcttcggggtgtggatcctggccgacaagagcagtttcatctctgtcctgcaaacctcctccagctcgcttaggatgggggcctatgtcttcatcggcgtgggggcagtcactatgctcatgggcttcctgggctgcatcggcgccgtcaacgaggtccgctgcctgctggggctgctgaagcaggagatgggcggcatcgtgactgagctcattcgagactacaacagcagtcgcgaggacagcctgcaggatgcctgggactacgtgcaggctcaggtgaagtgctgcggctgggtcagcttctacaactggacagacaacgctgagctcatgaatcgccctgaggtcacctacccctgttcctgcgaagtcaagggggaagaggacaacagcctttctgtgaggaagggcttctgcgaggcccccggcaacaggacccagagtggcaaccaccctgaggactggcctgtgtaccaggagggctgcatggagaaggtgcaggcgtggctgcaggagaacctgggcatcatcctcggcgtgggcgtgggtgtggccatcatcgagctcctggggatggtcctgtccatctgcttgtgccggcacgtccattccgaagactacagcaaggtccccaagtactga

SEQ ID NO: 931 - DNA, 584 bp, Homo sapiens
agcagaacccgcaggtgagcaagggggcagcgggccggggtagcctgccggacaaccataggcaaagttagttttagcccccgcttctgcggtccggctcggacaactttcctcggaactagtgacaggtcggggcagctggtgggtgaaaaggagctttagccaccagtcctgaacccccagttctcacactcggccgtgcacagctgcgtgatcctgggtccgtccctctacctggctctggacctcccgggttccagcaggaggaagtgaaccagagtcctccctgctgctgtgtggacgacacgtgggcacaggcagaagtgggccctgtgaccagctgcactggtttcgtggaaggaagctccaggactggcgggatgggctcagcctgtatcaaagtcaccaaatactttctcttcctcttcaacttgatcttctttatcctgggcgcagtgatcctgggcttcggggtgtggatcctggccgacaagagcagtttcatctctgtcctgcaaacctcctccagctcgcttaggatgggggcctatgtcttcatcggcgtgggggcagtcactatgctc

SEQ ID NO: 932 - DNA, 468 bp, Homo sapiens
gcagtccgacgccgactgaggcacgagcgggtgacgctgggcctgcagcgcggagcagaaagcagaacccgcagagtcctccctgctgctgtgtggacgacacgtgggcacaggcagaagtgggccctgtgaccagctgcactggtttcgtggaagcatttagagtcctggagtgctggtccctggggaggctcggcagcaggtcctggcattcagagctggcccagggttgagcacctgacacacccccaacctgccctgcgggcaaggacagaagaggcctgagaaccgtctcttcggactcaggggcagtggaactcagactgccttcaggaagctccaggactggcgggatgggctcagcctgtatcaaagtcaccaaatactttctcttcctcttcaacttgatcttctttatcctgggcgcagtgatcctgggcttcggggtgtggatcctggccgacaaga

SEQ ID NO: 933 - DNA, 573 bp, Homo sapiens
aagcctcccagggcgtggcgtgaagcggggatttggtaggggagcgcagagcgaggcctgaggtgtttccctggcagaggtccctccactgggaaacaaacggagaggggagtatgtgttcccacgtgtacacataaaccgttttgaatgatacctgagtcctccctgctgctgtgtggacgacacgtgggcacaggcagaagtgggccctgtgaccagctgcactggtttcgtggaaggaagctccaggactggcgggatgggctcagcctgtatcaaagtcaccaaatactttctcttcctcttcaacttgatcttctttatcctgggcgcagtgatcctgggcttcggggtgtggatcctggccgacaagagcagtttcatctctgtcctgcaaacctcctccagctcgcttaggatgggggcctatgtcttcatcggcgtgggggcagtcactatgctcatgggcttcctgggctgcatcggcgccgtcaacgaggtccgctgcctgctggggctgtactttgctttcctgctcctgatcctcattgcccaggtgacggccggggccct

SEQ ID NO: 934 - DNA, 580 bp, Homo sapiens
gagtgactgagccccgggctgtgcagtccgacgccgactgaggcacgagcgggtgacgctgggcctgcagcgcggagcagaaagcagaacccgcagttcaactgagccggaccccctaagacttcaagttggaaactcagtggggcttttccagagtcctccctgctgctgtgtggacgacacgtgggcacaggcagaagtgggccctgtgaccagctgcactggtttcgtggaaggaagctccaggactggcgggatgggctcagcctgtatcaaagtcaccaaatactttctcttcctcttcaacttgatcttctttatcctgggcgcagtgatcctgggcttcggggtgtggatcctggccgacaagagcagtttcatctctgtcctgcaaacctcctccagctcgcttaggatgggggcctatgtcttcatcggcgtgggggcagtcactatgctcatgggcttcctgggctgcatcggcgccgtcaacgaggtccgctgcctgctggggctgtactttgctttcctgctcctgatcctcattgcccaggtgacggccggggccctcttctacttc

SEQ ID NO: 935 - DNA, 2873 bp, Homo sapiens
gaatttccatccagcaatgcaggccatgggaggctgcagcagtgacgctgtcagatcccctttgtgagaataataatttttataacaacgtggctggaggactgatcaggagagagactggtgtgaattgaaggctgttgcaatggctccaagaagagatgaggctgtgtggtgagtttagccgctggatgaaaggccggaagaatgaggtcagcagcgcactgacaccgacacccaaagcttcggctgctgccgctctcatggaaatctcctgggggaagggagagggtccttcctcggtgaaaactggggctgctctagcgagttcctcagaagcgggcaggtcgctagttcctcttccttttcagccctcagtgcccattttgccaataaaaagtcccaaggtgacagtacaagagacgcctttagtgaaggcaaaggaagggacactcccctcctttgctgcctactctcgccctcacttcttgaaatctttggtctcccttcacccactctgtcactctcacaagacaaccatttccaaggactatttccaagcccttttcctcatccccaaacccgcagttttcagctgcccccagttgcctggccaggctgcctcgacggccctattcacgggccccagcctcctcgccgggctggaaggcgacaaccgcgaaaaggagggtgactctcctcggcgggggcttcgggtgacatcacatcctccaaatgcgaaatcaggctccgggccggccgaagggcgcaactttcccccctcggcgccccaccggctcccgcgcgcctcccctcgcgcccgagcttcgagccaagcagcgtcctggggagcgcgtcatggccttaccagtgaccgccttgctcctgccgctggccttgctgctccacgccgccaggccgagccagttccgggtgtcgccgctggatcggacctggaacctgggcgagacagtggagctgaagtgccaggtgctgctgtccaacccgacgtcgggctgctcgtggctcttccagccgcgcggcgccgccgccagtcccaccttcctcctatacctctcccaaaacaagcccaaggcggccgaggggctggacacccagcggttctcgggcaagaggttgggggacaccttcgtcctcaccctgagcgacttccgccgagagaacgagggctactatttctgctcggccctgagcaactccatcatgtacttcagccacttcgtgccggtcttcctgccagcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaccacaggaaccgaagacgtgtttgcaaatgtccccggcctgtggtcaaatcgggagacaagcccagcctttcggcgagatacgtctaaccctgtgcaacagccactacattacttcaaactgagatccttccttttgagggagcaagtccttccctttcattttttccagtcttcctccctgtgtattcattctcatgattattattttagtgggggcggggtgggaaagattactttttctttatgtgtttgacgggaaacaaaactaggtaaaatctacagtacaccacaagggtcacaatactgttgtgcgcacatcgcggtagggcgtggaaaggggcaggccagagctacccgcagagttctcagaatcatgctgagagagctggaggcacccatgccatctcaacctcttccccgcccgttttacaaagggggaggctaaagcccagagacagcttgatcaaaggcacacagcaagtcagggttggagcagtagctggagggaccttgtctcccagctcagggctctttcctccacaccattcaggtctttctttccgaggcccctgtctcagggtgaggtgcttgagtctccaacggcaagggaacaagtacttcttgatacctgggatactgtgcccagagcctcgaggaggtaatgaattaaagaagagaactgcctttggcagagttctataatgtaaacaatatcagactttttttttttataatcaagcctaaaattgtatagacctaaaataaaatgaagtggtgagcttaaccctggaaaatgaatccctctatctctaaagaaaatctctgtgaaacccctatgtggaggcggaattgctctcccagcccttgcattgcagaggggcccatgaaagaggacaggctacccctttacaaatagaatttgagcatcagtgaggttaaactaaggccctcttgaatctctgaatttgagatacaaacatgttcctgggatcactgatgactttttatactttgtaaagacaattgttggagagcccctcacacagccctggcctctgctcaactagcagatacagggatgaggcagacctgactctcttaaggaggctgagagcccaaactgctgtcccaaacatgcacttccttgcttaaggtatggtacaagcaatgcctgcccattggagagaaaaaacttaagtagataaggaaataagaaccactcataattcttcaccttaggaataatctcctgttaatatggtgtacattcttcctgattattttctacacatacatgtaaaatatgtctttcttttttaaatagggttgtactatgctgttatgagtggctttaatgaataaacatttgtagcatcctctttaatgggtaaacagca

SEQ ID NO: 936 - DNA, 1977 bp, Homo sapiens
ccccaccggctcccgcgcgcctcccctcgcgcccgagcttcgagccaagcagcgtcctggggagcgcgtcatggccttaccagtgaccgccttgctcctgccgctggccttgctgctccacgccgccaggccgagccagttccgggtgtcgccgctggatcggacctggaacctgggcgagacagtggagctgaagtgccaggtgctgctgtccaacccgacgtcgggctgctcgtggctcttccagccgcgcggcgccgccgccagtcccaccttcctcctatacctctcccaaaacaagcccaaggcggccgaggggctggacacccagcggttctcgggcaagaggttgggggacaccttcgtcctcaccctgagcgacttccgccgagagaacgagggctactatttctgctcggccctgagcaactccatcatgtacttcagccacttcgtgccggtcttcctgccagcgaagcccaccacgacgccagcgccgcgaccaccaacaccggcgcccaccatcgcgtcgcagcccctgtccctgcgcccagaggcgtgccggccagcggcggggggcgcagggaaccgaagacgtgtttgcaaatgtccccggcctgtggtcaaatcgggagacaagcccagcctttcggcgagatacgtctaaccctgtgcaacagccactacattacttcaaactgagatccttccttttgagggagcaagtccttccctttcattttttccagtcttcctccctgtgtattcattctcatgattattattttagtgggggcggggtgggaaagattactttttctttatgtgtttgacgggaaacaaaactaggtaaaatctacagtacaccacaagggtcacaatactgttgtgcgcacatcgcggtagggcgtggaaaggggcaggccagagctacccgcagagttctcagaatcatgctgagagagctggaggcacccatgccatctcaacctcttccccgcccgttttacaaagggggaggctaaagcccagagacagcttgatcaaaggcacacagcaagtcagggttggagcagtagctggagggaccttgtctcccagctcagggctctttcctccacaccattcaggtctttctttccgaggcccctgtctcagggtgaggtgcttgagtctccaacggcaagggaacaagtacttcttgatacctgggatactgtgcccagagcctcgaggaggtaatgaattaaagaagagaactgcctttggcagagttctataatgtaaacaatatcagactttttttttttataatcaagcctaaaattgtatagacctaaaataaaatgaagtggtgagcttaaccctggaaaatgaatccctctatctctaaagaaaatctctgtgaaacccctatgtggaggcggaattgctctcccagcccttgcattgcagaggggcccatgaaagaggacaggctacccctttacaaatagaatttgagcatcagtgaggttaaactaaggccctcttgaatctctgaatttgagatacaaacatgttcctgggatcactgatgactttttatactttgtaaagacaattgttggagagcccctcacacagccctggcctctgctcaactagcagatacagggatgaggcagacctgactctcttaaggaggctgagagcccaaactgctgtcccaaacatgcacttccttgcttaaggtatggtacaagcaatgcctgcccattggagagaaaaaacttaagtagataaggaaataagaaccactcataattcttcaccttaggaataatctcctgttaatatggtgtacattcttcctgattattttctacacatacatgtaaaatatgtctttcttttttaaatagggttgtactatgctgttatgagtggctttaatgaataaacatttgtagcatcctctttaatgggtaaacagca

SEQ ID NO: 937 - DNA, 3048 bp, Homo sapiens
ctctgtaaaataaatgcgctgggccggatcttttctgagttctcttctcccctacgaattctagatccctcctctgtcctccctgcgccagggaccttcgggcgacccttccctgtacccccaccccaccctctctggaccccgtttctgcctcagtacggcgcgctgagctctgccccctgcccaggccctgaccccctcaggagccgcggtttcctggggtaacagtgggaaacgtgtcggccgtctccgctcaggcgcttgctgtgtacagaaaggctgattcaggcacaccggctctcgtcgccttggtggccctccccagccctcctccgcgcctgctccgggtggcgctccgctgggctcctcgtgcgcctgtccgcgaccgcacccacctcatcctggcacccccatcgtggcatcacgtgttccctcatctgtcctcatggctggcgtgcccctctgcggtgagacctgcagaacaggaattggtgccgggtcagcagccggcgatgaagccggacgaagcctgcaaaccccacccatacgccagcttcacatagctcctatccattgcacagcagcgtggggaagcaccgttctctaccctccaaacaaaagcatgaaccaggtgcagtggctcacgtctgtaatcccagcattttggaggccaaggtggatggatggattccttgagtccaggagttcaagaccagcctgggcaacatggtgaacccccatctctacaaaaatttagccagttttcagctgcccccagttgcctggccaggctgcctcgacggccctattcacgggccccagcctcctcgccgggctggaaggcgacaaccgcgaaaaggagggtgactctcctcggcgggggcttcgggtgacatcacatcctccaaatgcgaaatcaggctccgggccggccgaagggcgcaactttcccccctcggcgccccaccggctcccgcgcgcctcccctcgcgcccgagcttcgagccaagcagcgtcctggggagcgcgtcatggccttaccagtgaccgccttgctcctgccgctggccttgctgctccacgccgccaggccgagccagttccgggtgtcgccgctggatcggacctggaacctgggcgagacagtggagctgaagtgccaggtgctgctgtccaacccgacgtcgggctgctcgtggctcttccagccgcgcggcgccgccgccagtcccaccttcctcctatacctctcccaaaacaagcccaaggcggccgaggggctggacacccagcggttctcgggcaagaggttgggggacaccttcgtcctcaccctgagcgacttccgccgagagaacgagggctactatttctgctcggccctgagcaactccatcatgtacttcagccacttcgtgccggtcttcctgccagcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaccacaggaaccgaagacgtgtttgcaaatgtccccggcctgtggtcaaatcgggagacaagcccagcctttcggcgagatacgtctaaccctgtgcaacagccactacattacttcaaactgagatccttccttttgagggagcaagtccttccctttcattttttccagtcttcctccctgtgtattcattctcatgattattattttagtgggggcggggtgggaaagattactttttctttatgtgtttgacgggaaacaaaactaggtaaaatctacagtacaccacaagggtcacaatactgttgtgcgcacatcgcggtagggcgtggaaaggggcaggccagagctacccgcagagttctcagaatcatgctgagagagctggaggcacccatgccatctcaacctcttccccgcccgttttacaaagggggaggctaaagcccagagacagcttgatcaaaggcacacagcaagtcagggttggagcagtagctggagggaccttgtctcccagctcagggctctttcctccacaccattcaggtctttctttccgaggcccctgtctcagggtgaggtgcttgagtctccaacggcaagggaacaagtacttcttgatacctgggatactgtgcccagagcctcgaggaggtaatgaattaaagaagagaactgcctttggcagagttctataatgtaaacaatatcagactttttttttttataatcaagcctaaaattgtatagacctaaaataaaatgaagtggtgagcttaaccctggaaaatgaatccctctatctctaaagaaaatctctgtgaaacccctatgtggaggcggaattgctctcccagcccttgcattgcagaggggcccatgaaagaggacaggctacccctttacaaatagaatttgagcatcagtgaggttaaactaaggccctcttgaatctctgaatttgagatacaaacatgttcctgggatcactgatgactttttatactttgtaaagacaattgttggagagcccctcacacagccctggcctctgctcaactagcagatacagggatgaggcagacctgactctcttaaggaggctgagagcccaaactgctgtcccaaacatgcacttccttgcttaaggtatggtacaagcaatgcctgcccattggagagaaaaaacttaagtagataaggaaataagaaccactcataattcttcaccttaggaataatctcctgttaatatggtgtacattcttcctgattattttctacacatacatgtaaaatatgtctttcttttttaaatagggttgtactatgctgttatgagtggctttaatgaataaacatttgtagcatcctctttaatgggtaaacagc

SEQ ID NO: 938 - DNA, 597 bp, Homo sapiens
atggccttaccagtgaccgccttgctcctgccgctggccttgctgctccacgccgccaggccgagccagttccgggtgtcgccgctggatcggacctggaacctgggcgagacagtggagctgaagtgccaggtgctgctgtccaacccgacgtcgggctgctcgtggctcttccagccgcgcggcgccgccgccagtcccaccttcctcctatacctctcccaaaacaagcccaaggcggccgaggggctggacacccagcggttctcgggcaagaggttgggggacaccttcgtcctcaccctgagcgacttccgccgagagaacgagggctactatttctgctcggccctgagcaactccatcatgtacttcagccacttcgtgccggtcttcctgccagtgcacacgagggggctggacttcgcctgtgatatctacatctgggcgcccttggccgggacttgtggggtccttctcctgtcactggttatcaccctttactgcaaccacaggaaccgaagacgtgtttgcaaatgtccccggcctgtggtcaaatcgggagacaagcccagcctttcggcgagatacgtctaa

SEQ ID NO: 939 - DNA, 2091 bp, Homo sapiens
gaaatcaggctccgggccggccgaagggcgcaactttcccccctcggcgccccaccggctcccgcgcgcctcccctcgcgcccgagcttcgagccaagcagcgtcctggggagcgcgtcatggccttaccagtgaccgccttgctcctgccgctggccttgctgctccacgccgccaggccgagccagttccgggtgtcgccgctggatcggacctggaacctgggcgagacagtggagctgaagtgccaggtgctgctgtccaacccgacgtcgggctgctcgtggctcttccagccgcgcggcgccgccgccagtcccaccttcctcctatacctctcccaaaacaagcccaaggcggccgaggggctggacaccctgagcgacttccgccgagagaacgagggctactatttctgctcggccctgagcaactccatcatgtacttcagccacttcgtgccggtcttcctgccagcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaccacaggaaccgaagacgtgtttgcaaatgtccccggcctgtggtcaaatcgggagacaagcccagcctttcggcgagatacgtctaaccctgtgcaacagccactacattacttcaaactgagatccttccttttgagggagcaagtccttccctttcattttttccagtcttcctccctgtgtattcattctcatgattattattttagtgggggcggggtgggaaagattactttttctttatgtgtttgacgggaaacaaaactaggtaaaatctacagtacaccacaagggtcacaatactgttgtgcgcacatcgcggtagggcgtggaaaggggcaggccagagctacccgcagagttctcagaatcatgctgagagagctggaggcacccatgccatctcaacctcttccccgcccgttttacaaagggggaggctaaagcccagagacagcttgatcaaaggcacacagcaagtcagggttggagcagtagctggagggaccttgtctcccagctcagggctctttcctccacaccattcaggtctttctttccgaggcccctgtctcagggtgaggtgcttgagtctccaacggcaagggaacaagtacttcttgatacctgggatactgtgcccagagcctcgaggaggtaatgaattaaagaagagaactgcctttggcagagttctataatgtaaacaatatcagactttttttttttataatcaagcctaaaattgtatagacctaaaataaaatgaagtggtgagcttaaccctggaaaatgaatccctctatctctaaagaaaatctctgtgaaacccctatgtggaggcggaattgctctcccagcccttgcattgcagaggggcccatgaaagaggacaggctacccctttacaaatagaatttgagcatcagtgaggttaaactaaggccctcttgaatctctgaatttgagatacaaacatgttcctgggatcactgatgactttttatactttgtaaagacaattgttggagagcccctcacacagccctggcctctgctcaactagcagatacagggatgaggcagacctgactctcttaaggaggctgagagcccaaactgctgtcccaaacatgcacttccttgcttaaggtatggtacaagcaatgcctgcccattggagagaaaaaacttaagtagataaggaaataagaaccactcataattcttcaccttaggaataatctcctgttaatatggtgtacattcttcctgattattttctacacatacatgtaaaatatgtctttcttttttaaatagggttgtactatgctgttatgagtggctttaatgaataaacatttgtagcatcctctttaatgggtaaacagc

SEQ ID NO: 940 - DNA, 2942 bp, Homo sapiens
ctctgtaaaataaatgcgctgggccggatcttttctgagttctcttctcccctacgaattctagatccctcctctgtcctccctgcgccagggaccttcgggcgacccttccctgtacccccaccccaccctctctggaccccgtttctgcctcagtacggcgcgctgagctctgccccctgcccaggccctgaccccctcaggagccgcggtttcctggggtaacagtgggaaacgtgtcggccgtctccgctcaggcgcttgctgtgtacagaaaggctgattcaggcacaccggctctcgtcgccttggtggccctccccagccctcctccgcgcctgctccgggtggcgctccgctgggctcctcgtgcgcctgtccgcgaccgcacccacctcatcctggcacccccatcgtggcatcacgtgttccctcatctgtcctcatggctggcgtgcccctctgcggtgagacctgcagaacaggaattggtgccgggtcagcagccggcgatgaagccggacgaagcctgcaaaccccacccatacgccagcttcacatagctcctatccattgcacagcagcgtggggaagcaccgttctctaccctccaaacaaaagcatgaaccaggtgcagtggctcacgtctgtaatcccagcattttggaggccaaggtggatggatggattccttgagtccaggagttcaagaccagcctgggcaacatggtgaacccccatctctacaaaaatttagccagttttcagctgcccccagttgcctggccaggctgcctcgacggccctattcacgggccccagcctcctcgccgggctggaaggcgacaaccgcgaaaaggagggtgactctcctcggcgggggcttcgggtgacatcacatcctccaaatgcgaaatcaggctccgggccggccgaagggcgcaactttcccccctcggcgccccaccggctcccgcgcgcctcccctcgcgcccgagcttcgagccaagcagcgtcctggggagcgcgtcatggccttaccagtgaccgccttgctcctgccgctggccttgctgctccacgccgccaggccgagccagttccgggtgtcgccgctggatcggacctggaacctgggcgagacagtggagctgaagtgccaggtgctgctgtccaacccgacgtcgggctgctcgtggctcttccagccgcgcggcgccgccgccagtcccaccttcctcctatacctctcccaaaacaagcccaaggcggccgaggggctggacacccagcggttctcgggcaagaggttgggggacaccttcgtcctcaccctgagcgacttccgccgagagaacgagggctactatttctgctcggccctgagcaactccatcatgtacttcagccacttcgtgccggtcttcctgccagcgaagcccaccacgacgccagcgccgcgaccaccaacaccggcgcccaccatcgcgtcgcagcccctgtccctgcgcccagaggcgtgccggccagcggcggggggcgcagggaaccgaagacgtgtttgcaaatgtccccggcctgtggtcaaatcgggagacaagcccagcctttcggcgagatacgtctaaccctgtgcaacagccactacattacttcaaactgagatccttccttttgagggagcaagtccttccctttcattttttccagtcttcctccctgtgtattcattctcatgattattattttagtgggggcggggtgggaaagattactttttctttatgtgtttgacgggaaacaaaactaggtaaaatctacagtacaccacaagggtcacaatactgttgtgcgcacatcgcggtagggcgtggaaaggggcaggccagagctacccgcagagttctcagaatcatgctgagagagctggaggcacccatgccatctcaacctcttccccgcccgttttacaaagggggaggctaaagcccagagacagcttgatcaaaggcacacagcaagtcagggttggagcagtagctggagggaccttgtctcccagctcagggctctttcctccacaccattcaggtctttctttccgaggcccctgtctcagggtgaggtgcttgagtctccaacggcaagggaacaagtacttcttgatacctgggatactgtgcccagagcctcgaggaggtaatgaattaaagaagagaactgcctttggcagagttctataatgtaaacaatatcagactttttttttttataatcaagcctaaaattgtatagacctaaaataaaatgaagtggtgagcttaaccctggaaaatgaatccctctatctctaaagaaaatctctgtgaaacccctatgtggaggcggaattgctctcccagcccttgcattgcagaggggcccatgaaagaggacaggctacccctttacaaatagaatttgagcatcagtgaggttaaactaaggccctcttgaatctctgaatttgagatacaaacatgttcctgggatcactgatgactttttatactttgtaaagacaattgttggagagcccctcacacagccctggcctctgctcaactagcagatacagggatgaggcagacctgactctcttaaggaggctgagagcccaaactgctgtcccaaacatgcacttccttgcttaaggtatggtacaagcaatgcctgcccattggagagaaaaaacttaagtagataaggaaataagaaccactcataattcttcaccttaggaataatctcctgttaatatggtgtacattcttcctgattattttctacacatacatgtaaaatatgtctttcttttttaaatagggttgtactatgctgttatgagtggctttaatgaataaacatttgtagcatcctctttaatgggtaaacagcatccg

SEQ ID NO: 941 - DNA, 1230 bp, Homo sapiens
gaatttccatccagcaatgcaggccatgggaggctgcagcagtgacgctgtcagatcccctttgtgagaataataatttttataacaacgtggctggaggactgatcaggagagagactggtgtgaattgaaggctgttgcaatggctccaagaagagatgaggctgtgtgttttcagctgcccccagttgcctggccaggctgcctcgacggccctattcacgggccccagcctcctcgccgggctggaaggcgacaaccgcgaaaaggagggtgactctcctcggcgggggcttcgggtgacatcacatcctccaaatgcgaaatcaggctccgggccggccgaagggcgcaactttcccccctcggcgccccaccggctcccgcgcgcctcccctcgcgcccgagcttcgagccaagcagcgtcctggggagcgcgtcatggccttaccagtgaccgccttgctcctgccgctggccttgctgctccacgccgccaggccgagccagttccgggtgtcgccgctggatcggacctggaacctgggcgagacagtggagctgaagtgccaggtgctgctgtccaacccgacgtcgggctgctcgtggctcttccagccgcgcggcgccgccgccagtcccaccttcctcctatacctctcccaaaacaagcccaaggcggccgaggggctggacacccagcggttctcgggcaagaggttgggggacaccttcgtcctcaccctgagcgacttccgccgagagaacgagggctactatttctgctcggccctgagcaactccatcatgtacttcagccacttcgtgccggtcttcctgccagcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaccacaggaaccgaagacgtgtttgcaaatgtccccggcctgtggtcaaatcgggagacaagcccagcctttcggcgagatacgtctaaccctgtgcaacagccactacattacttcaaactgagatccttccttttgagggagcaagtccttccctttcattttttcca

SEQ ID NO: 942 - DNA, 759 bp, Homo sapiens
cttggaggttggcggcgcggggctgaaggctagcaaaccgagcgatcatgtcgcacaaacaaatttactattcggacaaatacgacgacgaggagtttgagtatcgacatgtcatgctgcccaaggacatagccaagctggtccctaaaacccatctgatgtctgaatctgaatggaggaatcttggcgttcagcagagtcagggatgggtccattatatgatccatgaaccagaacctcacatcttgctgttccggcgcccactacccaagaaaccaaagaaatgaagctggcaagctacttttcagcctcaagctttacacagctgtccttacttcctaacatctttctgataacattattatgttgccttcttgtttctcactttgatatttaaaagatgttcaatacactgtttgaatgtgctggtaactgctttgcttcttgagtagagccaccaccaccatagcccagccagatgagtgctctgtggacccacagcctaagctgagtgtgaccccagaagccacgatgtgctctgtatccagaacacacttggcagatggaggaagcatctgagtttgagaccatggctgttacagggatcatgtaaacttgctgtttttgttttttcctgccgggtgttgtatgtgtggtgacttgcggatttatgtttcagtgtactggaaactttccattttattcaagaaatctgttcatgttaaaagccttgattaaagaggaagtttttataatcta

SEQ ID NO: 943 - DNA, 820 bp, Homo sapiens
gtgctgttgggagttgcttggaggttggcggcgcggggctgaaggctagcaaaccgagcgatcatgtcgcacaaacaaatttactattcggacaaatacgacgacgaggagtttgagtatcgacatgtcatgctgcccaaggacatagccaagctggtccctaaaacccatctgatgtctgaatctgaatggaggaatcttggcgttcagcagagtcagggatgggtccattatatgatccatgaaccaggtcagtgcactggctaaaaacaaccatatagaactgctacactgagagaatgaaagaataagattgtataacccaaatagggagataggaaatggtttactggttccttccccctccagtcgtgggggatttttttaaaaaaaaactagtgaccaaaaataagactaaaatatctgggaagttcagagacaacctgtcactgaaaaacctcctgtaatctttcattcaatcagagggtattctttttaaggccacatatagcctgatcatagcccctgcctcattctccatcgaaaacattcttggatgtgttctaaataagcaaaggaaagtatatttattgataagacaccagacacccagctgccaggcaaaactaataagggacaccctggggctgtataaacatagcaaaagaactgatattaacaattctgtacttggcagacagtccagacttctgggtctgcttctaaggccatatgcttaagtctttatttagttataaagatctgagtgggtgatagctggggaggtggtagtggaatacactataggttgtacatagaa

SEQ ID NO: 944 - DNA, 912 bp, Homo sapiens
tgaaagcgaggccaaagtgggtgggagcgcgtgctgttgggagttgcttggaggttggcggcgcggggctgaaggctagcaaaccgagcgatcatgtcgcacaaacaaatttactattcggacaaatacgacgacgaggagtttgagtatcggttagtgctggcgcgggagcaatagcgagggtcgtgagctttggccgctgagggcacaaggaattagtaacaggaactgaggcgatagaattggcgcatgcgtacgagacatgtcatgctgcccaaggacatagccaagctggtccctaaaacccatctgatgtctgaatctgaatggaggaatcttggcgttcagcagagtcagggatgggtccattatatgatccatgaaccagaacctcacatcttgctgttccggcgcccactacccaagaaaccaaagaaatgaagctggcaagctacttttcagcctcaagctttacacagctgtccttacttcctaacatctttctgataacattattatgttgccttcttgtttctcactttgatatttaaaagatgttcaatacactgtttgaatgtgctggtaactgctttgcttcttgagtagagccaccaccaccatagcccagccagatgagtgctctgtggacccacagcctaagctgagtgtgaccccagaagccacgatgtgctctgtatccagaacacacttggcagatggaggaagcatctgagtttgagaccatggctgttacagggatcatgtaaacttgctgtttttgttttttcctgccgggtgttgtatgtgtggtgacttgcggatttatgtttcagtgtactggaaactttccattttattcaagaaatctgttcatgttaaaagccttgattaaagaggaagtttttataatct

SEQ ID NO: 945 - DNA, 613 bp, Homo sapiens
agtctccggcgagttgttgcctgggctggacgtggttttgtctgctgcgcccgctcttcgcgctctcgtttcattttctgcagcgcgccagcaggatggcccacaagcagatctactactcggacaagtacttcgacgaacactacgagtaccggcatgttatgttacccagagaactttccaaacaagtacctaaaactcatctgatgtctgaagaggagtggaggagacttggtgtccaacagagtctaggctgggttcattacatgattcatgagccagaaccacatattcttctctttagacgacctcttccaaaagatcaacaaaaatgaagtttatctggggatcgtcaaatctttttcaaatttaatgtatatgtgtatataaggtagtattcagtgaatacttgagaaatgtacaaatctttcatccatacctgtgcatgagctgtattcttcacagcaacagagctcagttaaatgcaactgcaagtaggttactgtaagatgtttaagataaaagttcttccagtcagtttttctcttaagtgcctgtttgagtttactgaaacagtttacttttgttcaataaagtttgtatgttgcattta

SEQ ID NO: 946 - DNA, 1891 bp, Homo sapiens
agcatgacccggcctgaagtagcggcggaacggaagtcgcttgtgtatgaacgcagcggcggacctgtgaggggatccgacttgccggcagaacttacgctgcgggaccccgggcactgttgctgctgcgggagactgtgggctgtttagtgccatgcaccctttacagtgtgtcctccaagtgcagaggtctctggggtggggaccattggcctctgtgtcttggctgtcgctgaggatgtgcagggcacacagcagtctctctagtaccatgtgtcccagtccagagaggcaggaggatggagctcggaaggatttcagctccaggctggctgctggaccgacttttcaacattttttaaaaagtgcctcagctcctcaggagaagctgtcttcagaagtggaagacccacctccctatctcatgatggatgaacttcttggaaggcagagaaaagtctacctcgagacctatggctgccagatgaatgtgaatgacacagagatagcctggtccatcttacagaagagtggctacctgcggaccagtaacctccaagaggcagatgtgattctccttgtcacatgctctatcagggagaaggctgagcagaccatctggaaccgtttacatcagcttaaagccttgaagacaaggcggccccgctcccgggttcctctgaggattggaattctaggctgcatggctgagaggttgaaggaggagattctcaacagagagaaaatggtagatattttggctggtcctgatgcctaccgggaccttccccggctgctggctgttgctgagtcgggccagcaagctgccaacgtgctgctctctctggacgagacctatgctgatgtcatgccagtccagacaagcgccagtgccacgtctgcctttgtgtcaatcatgcgaggctgtgacaacatgtgtagctactgcattgttcctttcacccggggcagggagaggagtcggcctattgcctccattctagaggaagtgaagaagctttctgagcaggttctgcagctgattcatgagagagataacatctgtaaacagatccacctgccagcccagagtggaagcagccgtgtgttggaggccatgcggaggggatattcaagagaagcttatgtggagttagttcaccatattagagaatctattccaggtgtgagcctcagcagcgatttcattgctggcttttgtggtgagacggaggaagatcacgtccagacagtctctttgctccgggaagttcagtacaacatgggcttcctctttgcctacagcatgagacagaagacacgggcatatcataggctgaaggatgatgtcccggaagaggtaaaattaaggcgtttggaggaactcatcactatcttccgagaagaagcaacaaaagccaatcagacctctgtgggctgtacccagttggtgctagtggaagggctcagtaaacgctctgccactgacctgtgtggcaggaatgatggaaaccttaaggtgatcttccctgatgcagagatggaggatgtcaataaccctgggctcagggtcagagcccagcctggggactatgtgctggtgaagatcacctcagccagttctcagacacttaggggacatgttctctgcaggaccactctgagggactcttctgcatattgctgacctgagaggatggcctcagagctgacttgggcaatcctccccaacaggaaggggagacattgcctgccactgaggaaacaggtcatgaaggtggagataagctgcaaggggcgaagcaactttatgtcagtggaaaacgtgtctctttaaagctgctatgtgaacagcttttacagtcattaaatttacctaaactaaggttaa

SEQ ID NO: 947 - DNA, 2122 bp, Homo sapiens
agcatgacccggcctgaagtagcggcggaacggaagtcgcttgtgtatgaacgcagcggcggacctgtgaggggatccgacttgccggcagaacttacgctgcgggaccccgggcactgttgctgctgcgggagactgtgggctgtttagtgccatgcaccctttacagtgtgtcctccaagtgcagaggtctctggggtggggaccattggcctctgtgtcttggctgtcgctgaggatgtgcagggcacacagcagtctctctagtaccatgtgtcccagtccagagaggcaggaggatggagctcggaaggatttcagctccaggctggctgctggaccgacttttcaacattttttaaaaagtgcctcagctcctcaggagaagctgtcttcagaagtggaagacccacctccctatctcatgatggatgaacttcttggaaggcagagaaaagtctacctcgagacctatggctgccagatgaatgtgaatgacacagagatagcctggtccatcttacagaagagtggctacctgcggaccagtaacctccaagaggcagatgtgattctccttgtcacatgctctatcagggagaaggctgagcagaccatctggaaccgtttacatcagcttaaagccttgaagacaaggcggccccgctcccgggttcctctgaggattggaattctaggctgcatggctgagaggttgaaggaggagattctcaacagagagaaaatggtagatattttggctggtcctgatgcctaccgggaccttccccggctgctggctgttgctgagtcgggccagcaagctgccaacgtgctgctctctctggacgagacctatgctgatgtcatgccagtccagacaagcgccagtgccacgtctgcctttgtgtcaatcatgcgaggctgtgacaacatgtgtagctactgcattgttcctttcacccggggcagggagaggagtcggcctattgcctccattctagaggaagtgaagaagctttctgagcaggggctgaaagaagtgacacttcttggtcagaatgttaatagttttcgggacaattcggaggtccagttcaacagtgcagtgcctaccaatctcagtcgtggctttaccaccaactataaaaccaagcaaggaggacttcgttttgctcatcttctggatcaggtctccagagtagatcctgaaatgaggatccgttttacctctccccaccccaaggattttcctgatgaggttctgcagctgattcatgagagagataacatctgtaaacagatccacctgccagcccagagtggaagcagccgtgtgttggaggccatgcggaggggatattcaagagaagcttatgtggagttagttcaccatattagagaatctattccaggtgtgagcctcagcagcgatttcattgctggcttttgtggtgagacggaggaagatcacgtccagacagtctctttgctccgggaagttcagtacaacatgggcttcctctttgcctacagcatgagacagaagacacgggcatatcataggctgaaggatgatgtcccggaagaggtaaaattaaggcgtttggaggaactcatcactatcttccgagaagaagcaacaaaagccaatcagacctctgtgggctgtacccagttggtgctagtggaagggctcagtaaacgctctgccactgacctgtgtggcaggaatgatggaaaccttaaggtgatcttccctgatgcagagatggaggatgtcaataaccctgggctcagggtcagagcccagcctggggactatgtgctggtgaagatcacctcagccagttctcagacacttaggggacatgttctctgcaggaccactctgagggactcttctgcatattgctgacctgagaggatggcctcagagctgacttgggcaatcctccccaacaggaaggggagacattgcctgccactgaggaaacaggtcatgaaggtggagataagctgcaaggggcgaagcaactttatgtcagtggaaaacgtgtctctttaaagctgctatgtgaacagcttttacagtcattaaatttacctaaactaaggttaa

SEQ ID NO: 948 - DNA, 2164 bp, Homo sapiens
agcatgacccggcctgaagtagcggcggaacggaagtcgcttgtgtatgaacgcagcggcggacctgtgaggggatccgacttgccggcagaacttacgctgcgggaccccgggcactgttgctgctgcgggagactgtgggctgtttagtgccatgcaccctttacagtgtgtcctccaagtgcagaggtctctggggtggggaccattggcctctgtgtcttggctgtcgctgaggatgtgcagggcacacagcagtctctctagtaccatgtgtcccagtccagagaggcaggaggatggagctcggaaggatttcagctccaggctggctgctggaccgacttttcaacattttttaaaaagtgcctcagctcctcaggagaagctgtcttcagaagtggaagacccacctccctatctcatgatggatgaacttcttggaaggcagagaaaagtctacctcgagacctatggctgccagatgaatgtgaatgacacagagatagcctggtccatcttacagaagagtggctacctgcggaccagtaacctccaagaggcagatgtgattctccttgtcacatgctctatcagggagaaggctgagcagaccatctggaaccgtttacatcagcttaaagccttgaagacaaggcggccccgctcccgggttcctctgaggattggaattctaggctgcatggctgagaggttgaaggaggagattctcaacagagagaaaatggtagatattttggctggtcctgatgcctaccgggaccttccccggctgctggctgttgctgagtcgggccagcaagctgccaacgtgctgctctctctggacgagacctatgctgatgtcatgccagtccagacaagcgccagtgccacgtctgcctttgtgtcaatcatgcgaggctgtgacaacatgtgtagctactgcattgttcctttcacccggggcagggagaggagtcggcctattgcctccattctagaggaagtgaagaagctttctgagcaggtgttcctcccacctcggcctcccaaagtgttgggattacaggggctgaaagaagtgacacttcttggtcagaatgttaatagttttcgggacaattcggaggtccagttcaacagtgcagtgcctaccaatctcagtcgtggctttaccaccaactataaaaccaagcaaggaggacttcgttttgctcatcttctggatcaggtctccagagtagatcctgaaatgaggatccgttttacctctccccaccccaaggattttcctgatgaggttctgcagctgattcatgagagagataacatctgtaaacagatccacctgccagcccagagtggaagcagccgtgtgttggaggccatgcggaggggatattcaagagaagcttatgtggagttagttcaccatattagagaatctattccaggtgtgagcctcagcagcgatttcattgctggcttttgtggtgagacggaggaagatcacgtccagacagtctctttgctccgggaagttcagtacaacatgggcttcctctttgcctacagcatgagacagaagacacgggcatatcataggctgaaggatgatgtcccggaagaggtaaaattaaggcgtttggaggaactcatcactatcttccgagaagaagcaacaaaagccaatcagacctctgtgggctgtacccagttggtgctagtggaagggctcagtaaacgctctgccactgacctgtgtggcaggaatgatggaaaccttaaggtgatcttccctgatgcagagatggaggatgtcaataaccctgggctcagggtcagagcccagcctggggactatgtgctggtgaagatcacctcagccagttctcagacacttaggggacatgttctctgcaggaccactctgagggactcttctgcatattgctgacctgagaggatggcctcagagctgacttgggcaatcctccccaacaggaaggggagacattgcctgccactgaggaaacaggtcatgaaggtggagataagctgcaaggggcgaagcaactttatgtcagtggaaaacgtgtctctttaaagctgctatgtgaacagcttttacagtcattaaatttacctaaactaaggttaa

SEQ ID NO: 949 - DNA, 1628 bp, Homo sapiens
gtgtatgaacgcagcggcggacctgtgaggggatccgacttgccggcagaacttacgctgcgggaccccgggcactgttgctgctgcgggagactgtgggctgtttagtgccatgcaccctttacagtgtgtcctccaagtgcagaggtctctggggtggggaccattggcctctgtgtcttggctgtcgctgaggatgtgcagggcacacagcagtctctctagtaccatgtgtcccagtccagagaggcaggaggatggagctcggaaggatttcagctccaggctggctgctggaccgacttttcaacattttttaaaaagtgcctcagctcctcaggagaagctgtcttcagaagtggaagacccacctccctatctcatgatggatgaacttcttggaaggcagagaaaagtctacctcgagacctatggctgccagatgaatgtgaatgacacagagatagcctggtccatcttacagaagagtggctacctgcggaccagtaacctccaagaggcagatgtgattctccttgtcacatgctctatcagggagaaggctgagcagaccatctggaaccgtttacatcagcttaaagccttgaagacaaggcggccccgctcccgggttcctctgaggattggaattctaggctgcatggctgagaggttgaaggaggagattctcaacagagagaaaatggtagatattttggctggtcctgatgcctaccgggaccttccccggctgctggctgttgctgagtcgggccagcaagctgccaacgtgctgctctctctggacgagacctatgctgatgtcatgccagtccagacaagcgccagtgccacgtctgcctttgtatattcaagagaagcttatgtggagttagttcaccatattagagaatctattccaggtgtgagcctcagcagcgatttcattgctggcttttgtggtgagacggaggaagatcacgtccagacagtctctttgctccgggaagttcagtacaacatgggcttcctctttgcctacagcatgagacagaagacacgggcatatcataggctgaaggatgatgtcccggaagaggtaaaattaaggcgtttggaggaactcatcactatcttccgagaagaagcaacaaaagccaatcagacctctgtgggctgtacccagttggtgctagtggaagggctcagtaaacgctctgccactgacctgtgtggcaggaatgatggaaaccttaaggtgatcttccctgatgcagagatggaggatgtcaataaccctgggctcagggtcagagcccagcctggggactatgtgctggtgaagatcacctcagccagttctcagacacttaggggacatgttctctgcaggaccactctgagggactcttctgcatattgctgacctgagaggatggcctcagagctgacttgggcaatcctccccaacaggaaggggagacattgcctgccactgaggaaacaggtcatgaaggtggagataagctgcaaggggcgaagcaactttatgtcagtggaaaacgtgtctctttaaagctgctatgtgaacagcttttacagtcattaaatttacctaaactaaggtt

SEQ ID NO: 950 - DNA, 1944 bp, Homo sapiens
cggaagtcgcttgtgtatgaacgcagcggcggacctgtgaggggatccgacttgccggcagaacttacgctgcgggaccccgggcactgttgctgctgcgggagtccagagaggcaggaggatggagctcggaaggatttcagctccaggctggctgctggaccgacttttcaacattttttaaaaagtgcctcagctcctcaggagaagctgtcttcagaagtggaagacccacctccctatctcatgatggatgaacttcttggaaggcagagaaaagtctacctcgagacctatggctgccagatgaatgtgaatgacacagagatagcctggtccatcttacagaagagtggctacctgcggaccagtaacctccaagaggcagatgtgattctccttgtcacatgctctatcagggagaaggctgagcagaccatctggaaccgtttacatcagcttaaagccttgaagacaaggcggccccgctcccgggttcctctgaggattggaattctaggctgcatggctgagaggttgaaggaggagattctcaacagagagaaaatggtagatattttggctggtcctgatgcctaccgggaccttccccggctgctggctgttgctgagtcgggccagcaagctgccaacgtgctgctctctctggacgagacctatgctgatgtcatgccagtccagacaagcgccagtgccacgtctgcctttgtgtcaatcatgcgaggctgtgacaacatgtgtagctactgcattgttcctttcacccggggcagggagaggagtcggcctattgcctccattctagaggaagtgaagaagctttctgagcaggggctgaaagaagtgacacttcttggtcagaatgttaatagttttcgggacaattcggaggtccagttcaacagtgcagtgcctaccaatctcagtcgtggctttaccaccaactataaaaccaagcaaggaggacttcgttttgctcatcttctggatcaggtctccagagtagatcctgaaatgaggatccgttttacctctccccaccccaaggattttcctgatgaggttctgcagctgattcatgagagagataacatctgtaaacagatccacctgccagcccagagtggaagcagccgtgtgttggaggccatgcggaggggatattcaagagaagcttatgtggagttagttcaccatattagagaatctattccaggtgtgagcctcagcagcgatttcattgctggcttttgtggtgagacggaggaagatcacgtccagacagtctctttgctccgggaagttcagtacaacatgggcttcctctttgcctacagcatgagacagaagacacgggcatatcataggctgaaggatgatgtcccggaagaggtaaaattaaggcgtttggaggaactcatcactatcttccgagaagaagcaacaaaagccaatcagacctctgtgggctgtacccagttggtgctagtggaagggctcagtaaacgctctgccactgacctgtgtggcaggaatgatggaaaccttaaggtgatcttccctgatgcagagatggaggatgtcaataaccctgggctcagggtcagagcccagcctggggactatgtgctggtgaagatcacctcagccagttctcagacacttaggggacatgttctctgcaggaccactctgagggactcttctgcatattgctgacctgagaggatggcctcagagctgacttgggcaatcctccccaacaggaaggggagacattgcctgccactgaggaaacaggtcatgaaggtggagataagctgcaaggggcgaagcaactttatgtcagtggaaaacgtgtctctttaaagctgctatgtgaacagcttttacagtcattaaatttacctaaactaaggttaa

SEQ ID NO: 951 - DNA, 1791 bp, Homo sapiens
gtgtatgaacgcagcggcggacctgtgaggggatccgacttgccggcagaacttacgctgcgggaccccgggcactgttgctgctgcgggagactgtgggctgtttagtgccatgcaccctttacagtgtgtcctccaagtgcagaggtctctggggtggggaccattggcctctgtgtcttggctgtcgctgaggatgtgcagggcacacagcagtctctctagtaccatgtgtcccagtccagagaggcaggaggatggagctcggaaggatttcagctccaggctggctgctggaccgacttttcaacattttttaaaaagtgcctcagctcctcaggagaagctgtcttcagaagtggaagacccacctccctatctcatgatggatgaacttcttggaaggcagagaaaagtctacctcgagacctatggctgccagatgaatgtgaatgacacagagatagcctggtccatcttacagaagagtggctacctgcggaccagtaacctccaagaggcagatgtgattctccttgtcacatgctctatcagggagaaggctgagcagaccatctggaaccgtttacatcagcttaaagccttgaagacaaggcggccccgctcccgggttcctctgaggattggaattctaggctgcatggctgagaggttgaaggaggagattctcaacagagagaaaatggtagatattttggctggtcctgatgcctaccgggaccttccccggctgctggctgttgctgagtcgggccagcaagctgccaacgtgctgctctctctggacgagacctatgctgatgtcatgccagtccagacaagcgccagtgccacgtctgcctttgtgtcaatcatgcgaggctgtgacaacatgtgtagctactgcattgttcctttcacccggggcagggagaggagtcggcctattgcctccattctagaggaagtgaagaagctttctgagcaggggctgaaagaagtgacacttcttggtcagaatgttaatagttttcgggacaattcggaggtccagttcaacagtgcagtgcctaccaatctcagtcgtggctttaccaccaactataaaaccaagcaaggaggacttcgttttgctcatcttctggatcaggtctccagagtagatcctgaaatgaggatccgttttacctctccccaccccaaggattttcctgatgaggttctgcagctgattcatgagagagataacatctgtaaacagatccacctgccagcccagagtggaagcagccgtgtgttggaggccatgcggaggggatattcaagagaagcttatgtggagttagttcaccatattagagaatctattccagaagacacgggcatatcataggctgaaggatgatgtcccggaagaggtaaaattaaggcgtttggaggaactcatcactatcttccgagaagaagcaacaaaagccaatcagacctctgtgggctgtacccagttggtgctagtggaagggctcagtaaacgctctgccactgacctgtgtggcaggaatgatggaaaccttaaggtgatcttccctgatgcagagatggaggatgtcaataaccctgggctcagggtcagagcccagcctggggactatgtgctggtgaaggtgaggagtccttttgggcttttggcttgcactgtgaaatgagtgttggtttggatatttgtggtaataaagttttttcctagagacacattttagtaaaataaaaatcccctctcaaccagtacaa

SEQ ID NO: 952 - DNA, 2255 bp, Homo sapiens
ggtgatgggcagaatctgtttacgaaagacgtgacagtgatcgagggagaggttgcgaccatcagttgccaagtcaataagagtgacgactctgtgattcagctactgaatcccaacaggcagaccatttatttcagggacttcaggcctttgaaggacagcaggtttcagttgctgaatttttctagcagtgaactcaaagtatcattgacaaacgtctcaatttctgatgaaggaagatacttttgccagctctataccgatcccccacaggaaagttacaccaccatcacagtcctggtcccaccacgtaatctgatgatcgatatccagaaagacactgcggtggaaggtgaggagattgaagtcaactgcactgctatggccagcaagccagccacgactatcaggtggttcaaagggaacacagagctaaaaggcaaatcggaggtggaagagtggtcagacatgtacactgtgaccagtcagctgatgctgaaggtgcacaaggaggacgatggggtcccagtgatctgccaggtggagcaccctgcggtcactggaaacctgcagacccagcggtatctagaagtacagtataagcctcaagtgcacattcagatgacttatcctctacaaggcttaacccgggaaggggacgcgcttgagttaacatgtgaagccatcgggaagccccagcctgtgatggtaacttgggtgagagtcgatgatgaaatgcctcaacacgccgtactgtctgggcccaacctgttcatcaataacctaaacaaaacagataatggtacataccgctgtgaagcttcaaacatagtggggaaagctcactcggattatatgctgtatgtatacgattcccgagcaggtgaagaaggctcgatcagggcagtggatcatgccgtgatcggtggcgtcgtggcggtggtggtgttcgccatgctgtgcttgctcatcattctggggcgctattttgccagacataaaggtacatacttcactcatgaagccaaaggagccgatgacgcagcagacgcagacacagctataatcaatgcagaaggaggacagaacaactccgaagaaaagaaagagtacttcatctagatcagcctttttgtttcaatgaggtgtccaactggccctatttagatgataaagagacagtgatattggaacttgcgagaaattcgtgtgtttttttatgaatgggtggaaaggtgtgagactgggaaggcttgggatttgctgtgtaaaaaaaaaaaaaatgttctttggaaagtacactctgctgtttgacacctcttttttcgtttgtttgtttgtttaatttttatttcttcctaccaagtcaaacttggatacttggatttagtttcagtagattgcagaaaattctgtgccttgttttttgtttgtttgttgcgttcctttcttttccccctttgtgcacatttatttcctccctctaccccaatttcggattttttccaaaatctcccattttggaatttgcctgctgggattccttagactcttttccttcccttttctgttctagttttttacttttgtttatttttatggtaactgctttctgttccaaattcagtttcataaaaggagaaccagcacagcttagatttcatagttcagaatttagtgtatccataatgcattcttctctgttgtcgtaaagatttgggtgaacaaacaatgaaaactctttgctgctgcccatgtttcaaatacttagagcagtgaagactagaaaattagactgtgattcagaaaatgttctgtttgctgtggaactacattactgtacagggttatctgcaagtgaggtgtgtcacaatgagattgaatttcactgtctttaattctgtatctgtagacggctcagtatagataccctacgctgtccagaaaggtttggggcagaaaggactcctcctttttccatgccctaaacagacctgacaggtgaggtctgttccttttatataagtggacaaattttgagttgccacaggaggggaagtagggaggggggaaatacagttctgctctggttgtttctgttccaaatgattccatccacctttcccaatcggccttacttctcactaatttgtaggaaaaagcaagttcgtctgttgtgcgaatgactgaatgggacagagttgatttttttttttttttcctttgtgcttagttaggaaggcagtaggatgtgg

SEQ ID NO: 953 - DNA, 3517 bp, Homo sapiens
agtctgaggcaggtgcccgacatggcgagtgtagtgctgccgagcggatcccagtgtgcggcggcagcggcggcggcggcgcctcccgggctccggctccggcttctgctgttgctcttctccgccgcggcactgatccccacaggtgatgggcagaatctgtttacgaaagacgtgacagtgatcgagggagaggttgcgaccatcagttgccaagtcaataagagtgacgactctgtgattcagctactgaatcccaacaggcagaccatttatttcagggacttcaggcctttgaaggacagcaggtttcagttgctgaatttttctagcagtgaactcaaagtatcattgacaaacgtctcaatttctgatgaaggaagatacttttgccagctctataccgatcccccacaggaaagttacaccaccatcacagtcctggtcccaccacgtaatctgatgatcgatatccagaaagacactgcggtggaaggtgaggagattgaagtcaactgcactgctatggccagcaagccagccacgactatcaggtggttcaaagggaacacagagctaaaaggcaaatcggaggtggaagagtggtcagacatgtacactgtgaccagtcagctgatgctgaaggtgcacaaggaggacgatggggtcccagtgatctgccaggtggagcaccctgcggtcactggaaacctgcagacccagcggtatctagaagtacagtataagcctcaagtgcacattcagatgacttatcctctacaaggcttaacccgggaaggggacgcgcttgagttaacatgtgaagccatcgggaagccccagcctgtgatggtaacttgggtgagagtcgatgatgaaatgcctcaacacgccgtactgtctgggcccaacctgttcatcaataacctaaacaaaacagataatggtacataccgctgtgaagcttcaaacatagtggggaaagctcactcggattatatgctgtatgtatacgatccccccacaactatccctcctcccacaacaaccaccaccaccaccaccaccaccaccaccaccatccttaccatcatcacagattcccgagcaggtgaagaaggctcgatcagggcagtggatcatgccgtgatcggtggcgtcgtggcggtggtggtgttcgccatgctgtgcttgctcatcattctggggcgctattttgccagacataaaggtacatacttcactcatgaagccaaaggagccgatgacgcagcagacgcagacacagctataatcaatgcagaaggaggacagaacaactccgaagaaaagaaagagtacttcatctagatcagcctttttgtttcaatgaggtgtccaactggccctatttagatgataaagagacagtgatattggaacttgcgagaaattcgtgtgtttttttatgaatgggtggaaaggtgtgagactgggaaggcttgggatttgctgtgtaaaaaaaaaaaaaatgttctttggaaagtacactctgctgtttgacacctcttttttcgtttgtttgtttgtttaatttttatttcttcctaccaagtcaaacttggatacttggatttagtttcagtagattgcagaaaattctgtgccttgttttttgtttgtttgttgcgttcctttcttttccccctttgtgcacatttatttcctccctctaccccaatttcggattttttccaaaatctcccattttggaatttgcctgctgggattccttagactcttttccttcccttttctgttctagttttttacttttgtttatttttatggtaactgctttctgttccaaattcagtttcataaaaggagaaccagcacagcttagatttcatagttcagaatttagtgtatccataatgcattcttctctgttgtcgtaaagatttgggtgaacaaacaatgaaaactctttgctgctgcccatgtttcaaatacttagagcagtgaagactagaaaattagactgtgattcagaaaatgttctgtttgctgtggaactacattactgtacagggttatctgcaagtgaggtgtgtcacaatgagattgaatttcactgtctttaattctgtatctgtagacggctcagtatagataccctacgctgtccagaaaggtttggggcagaaaggactcctcctttttccatgccctaaacagacctgacaggtgaggtctgttccttttatataagtggacaaattttgagttgccacaggaggggaagtagggaggggggaaatacagttctgctctggttgtttctgttccaaatgattccatccacctttcccaatcggccttacttctcactaatttgtaggaaaaagcaagttcgtctgttgtgcgaatgactgaatgggacagagttgatttttttttttttttcctttgtgcttagttaggaaggcagtaggatgtggcctgcatgtactgtatattacagatatttgtcatgctgggatttccaactcgaatctgtgtgaaactttcattccttcagatttggcttgacaaaggcaggaggtacaaaagaagggctggtattgttctcacactggtctgctgtcgctctcagttctcgataggtcagagcagaggtggaaaaacagcatgtacggattttcagttacttaatcaaaactcaaatgtgagtgtttttatctttttacctttcatacactagccttggcctctttcctcagccttaagaaccatctgccaaaaattactgatcctcgcatgatggcagccatagtgcatagctactaaaatcagtgaccttgaacatatcttagatggggagcctcgggaaaaggtagaggagtcacgttaccatttacatgttttaaagaaagaagtgtggggattttcactgaaacgtctaggaaatctagaagtagtcctgaaggacagaaactaaactcttaccatatgtttggtaagactccagactccagctaacagtccctatggaaagatggcatcaaaaaagatagatctatatatatatataaatatatattctattacattttcagtgagtaattttggattttgcaaggtgcatttttactattgttacattatgtggaaaacttatgctgatttatttaagggggaaaaagtgtcaactctttgttatttgaaaacatgtttatttttcttgtctttattttaacctttgatagaaccattgcaatatgggggccttttgggaacggactggtatgtaaaagaaaatccattatcgagcagcattttatttacccctcccctatccctaggcacttaaccaagacaaaaagccacaatgaacatccctttttcaatgaattttataatctgcagctctattccgagcccttagcacccattccgaccatagtataatcatatcaaagggtgagaatcatttagcatgttgttgaaaggttttttttcagttgttcttttt

SEQ ID NO: 954 - DNA, 649 bp, Homo sapiens
agccatcgggaagccccagcctgtgatggtaacttgggtgagagtcgatgatgaaatgcctcaacacgccgtactgtctgggcccaacctgttcatcaataacctaaacaaaacagataatggtacataccgctgtgaagcttcaaacatagtggggaaagctcactcggattatatgctgtatgtatacgatccccccacaactatccctcctcccacaacaaccaccaccaccaccaccaccaccaccaccaccatccttaccatcatcacagacacaacggcgacgacagaaccagcagttcacgattcccgagcaggtgaagaaggctcgatcagggcagtggatcatgccgtgatcggtggcgtcgtggcggtggtggtgttcgccatgctgtgcttgctcatcattctggggcgctattttgccagacataaaggtacatacttcactcatgaagccaaaggagccgatgacgcagcagacgcagacacagctataatcaatgcagaaggaggacagaacaactccgaagaaaagaaagagtacttcatctagatcagcctttttgtttcaatgaggtgtccaactggccctatttagatgataaagagacagtgatattggaacttgcgagaaattcgtgtg

SEQ ID NO: 955 - DNA, 3551 bp, Homo sapiens
ggttgggctcgcggcgctgtgattggtctgcccggactccgcctccagcgcatgtcattagcatctcattagctgtccgctcgggctccggaggcagccaacgccgccagtctgaggcaggtgcccgacatggcgagtgtagtgctgccgagcggatcccagtgtgcggcggcagcggcggcggcggcgcctcccgggctccggctccggcttctgctgttgctcttctccgccgcggcactgatccccacaggtgatgggcagaatctgtttacgaaagacgtgacagtgatcgagggagaggttgcgaccatcagttgccaagtcaataagagtgacgactctgtgattcagctactgaatcccaacaggcagaccatttatttcagggacttcaggcctttgaaggacagcaggtttcagttgctgaatttttctagcagtgaactcaaagtatcattgacaaacgtctcaatttctgatgaaggaagatacttttgccagctctataccgatcccccacaggaaagttacaccaccatcacagtcctggtcccaccacgtaatctgatgatcgatatccagaaagacactgcggtggaaggtgaggagattgaagtcaactgcactgctatggccagcaagccagccacgactatcaggtggttcaaagggaacacagagctaaaaggcaaatcggaggtggaagagtggtcagacatgtacactgtgaccagtcagctgatgctgaaggtgcacaaggaggacgatggggtcccagtgatctgccaggtggagcaccctgcggtcactggaaacctgcagacccagcggtatctagaagtacagtataagcctcaagtgcacattcagatgacttatcctctacaaggcttaacccgggaaggggacgcgcttgagttaacatgtgaagccatcgggaagccccagcctgtgatggtaacttgggtgagagtcgatgatgaaatgcctcaacacgccgtactgtctgggcccaacctgttcatcaataacctaaacaaaacagataatggtacataccgctgtgaagcttcaaacatagtggggaaagctcactcggattatatgctgtatgtatacgattcccgagcaggtgaagaaggctcgatcagggcagtggatcatgccgtgatcggtggcgtcgtggcggtggtggtgttcgccatgctgtgcttgctcatcattctggggcgctattttgccagacataaaggtacatacttcactcatgaagccaaaggagccgatgacgcagcagacgcagacacagctataatcaatgcagaaggaggacagaacaactccgaagaaaagaaagagtacttcatctagatcagcctttttgtttcaatgaggtgtccaactggccctatttagatgataaagagacagtgatattggaacttgcgagaaattcgtgtgtttttttatgaatgggtggaaaggtgtgagactgggaaggcttgggatttgctgtgtaaaaaaaaaaaaaatgttctttggaaagtacactctgctgtttgacacctcttttttcgtttgtttgtttgtttaatttttatttcttcctaccaagtcaaacttggatacttggatttagtttcagtagattgcagaaaattctgtgccttgttttttgtttgtttgttgcgttcctttcttttccccctttgtgcacatttatttcctccctctaccccaatttcggattttttccaaaatctcccattttggaatttgcctgctgggattccttagactcttttccttcccttttctgttctagttttttacttttgtttatttttatggtaactgctttctgttccaaattcagtttcataaaaggagaaccagcacagcttagatttcatagttcagaatttagtgtatccataatgcattcttctctgttgtcgtaaagatttgggtgaacaaacaatgaaaactctttgctgctgcccatgtttcaaatacttagagcagtgaagactagaaaattagactgtgattcagaaaatgttctgtttgctgtggaactacattactgtacagggttatctgcaagtgaggtgtgtcacaatgagattgaatttcactgtctttaattctgtatctgtagacggctcagtatagataccctacgctgtccagaaaggtttggggcagaaaggactcctcctttttccatgccctaaacagacctgacaggtgaggtctgttccttttatataagtggacaaattttgagttgccacaggaggggaagtagggaggggggaaatacagttctgctctggttgtttctgttccaaatgattccatccacctttcccaatcggccttacttctcactaatttgtaggaaaaagcaagttcgtctgttgtgcgaatgactgaatgggacagagttgatttttttttttttttcctttgtgcttagttaggaaggcagtaggatgtggcctgcatgtactgtatattacagatatttgtcatgctgggatttccaactcgaatctgtgtgaaactttcattccttcagatttggcttgacaaaggcaggaggtacaaaagaagggctggtattgttctcacactggtctgctgtcgctctcagttctcgataggtcagagcagaggtggaaaaacagcatgtacggattttcagttacttaatcaaaactcaaatgtgagtgtttttatctttttacctttcatacactagccttggcctctttcctcagccttaagaaccatctgccaaaaattactgatcctcgcatgatggcagccatagtgcatagctactaaaatcagtgaccttgaacatatcttagatggggagcctcgggaaaaggtagaggagtcacgttaccatttacatgttttaaagaaagaagtgtggggattttcactgaaacgtctaggaaatctagaagtagtcctgaaggacagaaactaaactcttaccatatgtttggtaagactccagactccagctaacagtccctatggaaagatggcatcaaaaaagatagatctatatatatatataaatatatattctattacattttcagtgagtaattttggattttgcaaggtgcatttttactattgttacattatgtggaaaacttatgctgatttatttaagggggaaaaagtgtcaactctttgttatttgaaaacatgtttatttttcttgtctttattttaacctttgatagaaccattgcaatatgggggccttttgggaacggactggtatgtaaaagaaaatccattatcgagcagcattttatttacccctcccctatccctaggcacttaaccaagacaaaaagccacaatgaacatccctttttcaatgaattttataatctgcagctctattccgagcccttagcacccattccgaccatagtataatcatatcaaagggtgagaatcatttagcatgttgttgaaaggttttttttcagttgttctttttagaaaaaaag

SEQ ID NO: 956 - DNA, 2176 bp, Homo sapiens
tgcaggtgccgggccgggagcgagcggcggcggcggcggcggcggcaccatgggccgggcccggcgcttccagtggccgctgctgctgctgtgggcggccgcggcggggccaggggcaggacaggaagtacagacagagaacgtgacagtggctgagggtggggtggctgagatcacctgccgtctgcaccagtatgatgggtccatagttgtcatccagaacccagcccggcagaccctcttcttcaatggcacccgtgccttgaaggatgagcgtttccagcttgaggagttctccccacgccgggtgcggatccggctctcagatgcccgcctggaggacgaggggggctatttctgccagctctacacagaagacacccaccaccagattgccacgctcacggtactagtggccccagagaatcctgtggtggaggtccgggagcaggcggtagagggcggcgaggtggagctcagctgcctcgttccgcggtcccgtccggctgccaccctgcgctggtaccgggaccgcaaggagctgaaaggagtgagcagcagccaggaaaatggcaaggtctggagcgtggcaagcacagtacggtttcgtgtggaccgtaaggacgacggtggtatcatcatctgtgaggcgcagaaccaggcgctgccctccggacacagcaagcagacgcagtacgtgctggatgtgcagtactcccccacggcccggattcatgcctcccaagctgtggtgagggagggagacacgctggtgttgacgtgtgctgtcacggggaaccccaggccaaaccagatccgctggaaccgcgggaatgagtctttgccggagagggcggaggccgtgggagagacgctcacgctgccgggtctggtatccgcggataacggcacctacacttgcgaggcgtccaataagcacggccatgcgagggcgctctacgtacttgtggtctacgaccctggtgcggtggtagaggctcagacgtcggttccctatgccattgtgggcggcatcctggcgctgctggtgtttctgatcatatgtgtgctagtgggcatggtctggtgctcggtacggcagaagggttcctatctgacccacgaagccagtggcttggatgaacagggagaagcaagagaagccttcctcaatggcagcgacggacacaagaggaaagaggaattcttcatctgaccctatccccaccccaggcctaggcctgggcctgggctggggtcccccccactgccagctgcaaggaaccagcaaagacatttaccagagtctgggatggtgggcttctccccccaccactaacacctcagacgcttgggcagggatgggggtgttggatgcctggatctctgtaagggccagaagtgagggcccagaggtctgggtcccccagggggcaggggccaaaggtccagaccccccaagtccagtgagggcagtagggattgggttgggggaagataactgggggaaggccagggcccctaggctacaaaaccaggtcttgtggggagggggtcagtttctgggaagggtggggggggcagggaaggggaacacagatttctttgggggtcctagaccccatgccagccattgtaagagttccacagagctctgggcacttctttgcaaagccatgtttgcacggtggggggatgggtggggggagggcgtggaaatagggattctgtgtctttgtgtcataactttgatgggggcagtgagggagacagccccaacccttttctccaatcccccttccccaggttcctgggctccccttctctctaccttctcccccaacgtctgtcccatccatatttgtctctctgtccacccactcctgggggggccttccccatctctcctccaggccccccggggagggggaaaggagtttggggaggattcgtggtcttcatggttttatatataatatattaaaaaatcaaaagtctgtatgaaaatatcagattgcacccccctctccccattcctggcttttgccccctttttcttgttaaaaaacaaaaaacaaaaaacaaaaaaccacacacacattttgtacggggtggggaggggaatggggagggggtttggcaatctcactaaccaccattaaactgaggagagaac

SEQ ID NO: 957 - DNA, 735 bp, Homo sapiens
ggccgccgcactttaagaggctgtgcaggcagacagacctccaggcccgctaggggatccgcgccatggaggccgcccgggactatgcaggagccctcatcaggcccctgacatttatgggatcacagactaagcgagtcctgttcaccccgctcatgcatccagctcgccctttccgggtctccaaccatgacaggagcagccggcgtggggtgatggcaagcagcctgcaggagctcatcagcaagactctggatgccctcgtcatcgctaccggactggtcactctggtgctggaggaagatggcaccgtggtggacacagaagagttctttcagaccttgggagacaacacgcatttcatgatcttggaaaaaggacagaagtggatgccgggcagccagcacgtccccacttgctcgccgccgaagaggtcgggaatagcgagagtcaccttcgacttgtacaggctgaaccccaaggacttcatcggctgccttaacgtgaaggccaccatgtatgagatgtactccgtgtcctacgacatccggtgcacgggactcaagggcctgctgaggagtctgctgcggttcctgtcctactccgcccaggtgacgggacagtttctcatctatctgggcacatacatgctccgggtgctggatgacaaggaagagcggccatccctccggtcacaagccaagggcaggttcacgtgtggatagggatgcaggc

SEQ ID NO: 958 - DNA, 2294 bp, Homo sapiens
gccagcgctgcgaccgcctgcagaaggttgactgcgtggtagggggcccagagcaagccgaaggcaagcacgatggcgctcaccagccggcccacccgcgccccgtgccgcccggagccccagcgggcgccccgcagccgtgccagcgtcacgctgtagcagccgagcatcagcccgaaaggaagcacgaaagcggtcagagtctccaggctcaggtgggcggcggcgtggaccggcgacgggtggcacagctggcatacgcggtccctccacaggtggcggtagacggcggccgggacggcgagcaacagggcggccagccagaccgccagcagcaggcggcgggccagggccgggctgcgcagccgaggcgccaggaaggggcgggtgactgcgaggcagcgctgcaggctgagcaggccggtgagcagcacgctggcgtacatgctgagcgcgcacacgtagtacaccgccttgcagcccgcctggcccagcggccaggcctgccgggtcaggaaggccacaaagagcggcgtgagcagcagcaccgcgccgtcggccagcgccaggtgcagcacaagcgtggccgccagcggtcgcccccgtgcaggccgccagcccgccaagctccacaccacgaagccgttgccaggcagccccagcagcgccgccagcagcaggaaggctgtgcctgtggcccgcgaagtcttccagctcagcagtgtctcgttccctgggggacggtagcagaccgacatccttctgggcctacaggacacagaaaaaaagtggggaagctgggggaccctacaaggatccttggcaggaaagcagggattgtgttcatttgagggtttcactgtcagtgagagtctcagcttccatgcaactgtccatcacggctgcaactgaaatcagagctgggacacagcgcaccagaagctaaagtcttgatgccatcaaaggacatccctgccccattcacatctctgtcacgtccactaatcggcaaaaggagaaaagtgagagaagatgacctaagtgtgactgcagcaggcagctctggaaaatgaagccagagcagtgagccagcccctcctccgaccaaggaggaaggaaagagcagccccagcacaggagagaaccacccagcccagaagttccagggaaggaactctccggtccaccatggagtacctctcagctctgaaccccagtgacttactcaggtcagtatctaatataagctcggagtttggacggagggtctggacctcagctccaccaccccagcgacctttccgtgtctgtgatcacaagcggaccatccggaaaggcctgacagctgccacccgccaggagctgctagccaaagcattggagaccctactgctgaatggagtgctaaccctggtgctagaggaggatggaactgcagtggacagtgaggacttcttccagctgctggaggatgacacgtgcctgatggtgttgcagtctggtcagagctggagccctacaaggagtggagtgctgtcatatggcctgggacgggagaggcccaagcacagcaaggacatcgcccgattcacctttgacgtgtacaagcaaaaccctcgagacctctttggcagcctgaatgtcaaagccacattctacgggctctactctatgagttgtgactttcaaggacttggcccaaagaaagtactcagggagctccttcgttggacctccacactgctgcaaggcctgggccatatgttgctgggaatttcctccacccttcgtcatgcagtggagggggctgagcagtggcagcagaagggccgcctccattcctactaaggggctctgagcttctgcccccagaatcattccaaccgacccactgcaaagactatgacagcatcaaatttcaggacctgcagacagtacaggctagataacccacccaatttccccactgtcctctgatcccctcgtgacagaacctttcagcataacgcctcacatcccaagtctatacccttacctgaagaatgctgttctttcctagccacctttctggcctcccacttgccctgaaaggccaagatcaagatgtcccccaggcatcttgatcccagcctgactgctgctacatctaatcccctaccaatgcctcctgtccctaaactccccagcatactgatgacagccctctctgactttaccttgagatctgtcttcatacccttcccctcaaactaacaaaaacatttccaataaaaatatcaaatatttaccactaa

SEQ ID NO: 959 - DNA, 2409 bp, Homo sapiens
ttgactgcgtggtagggggcccagagcaagccgaaggcaagcacgatggcgctcaccagccggcccacccgcgccccgtgccgcccggagccccagcgggcgccccgcagccgtgccagcgtcacgctgtagcagccgagcatcagcccgaaaggaagcacgaaagcggtcagagtctccaggctcaggtgggcggcggcgtggaccggcgacgggtggcacagctggcatacgcggtccctccacaggtggcggtagacggcggccgggacggcgagcaacagggcggccagccagaccgccagcagcaggcggcgggccagggccgggctgcgcagccgaggcgccaggaaggggcgggtgactgcgaggcagcgctgcaggctgagcaggccggtgagcagcacgctggcgtacatgctgagcgcgcacacgtagtacaccgccttgcagcccgcctggcccagcggccaggcctgccgggtcaggaaggccacaaagagcggcgtgagcagcagcaccgcgccgtcggccagcgccaggtgcagcacaagcgtggccgccagcggtcgcccccgtgcaggccgccagcccgccaagctccacaccacgaagccgttgccaggcagccccagcagcgccgccagcagcaggaaggctgtgcctgtggcccgcgaagtcttccagctcagcagtgtctcgttccctgggggacggtagcagaccgacatccttctgggcctacagcctgcctcttttctgcctgggagtcctgacttccacgaggacccagaccccacctcaaacacaactccttcttggaacccagatcccctgctcccagtcagttgacctgccccactcctggcctccttcccagagctcagtggacacagaaaaaaagtggggaagctgggggaccctacaaggatccttggcaggaaagcagggattgtgttcatttgagggtttcactgtcagtgagagtctcagcttccatgcaactgtccatcacggctgcaactgaaatcagagctgggacacagcgcaccagaagctaaagtcttgatgccatcaaaggacatccctgccccattcacatctctgtcacgtccactaatcggcaaaaggagaaaagtgagagaagatgacctaagtgtgactgcagcaggcagctctggaaaatgaagccagagcagtgagccagcccctcctccgaccaaggaggaaggaaagagcagccccagcacaggagagaaccacccagcccagaagttccagggaaggaactctccggtccaccatggagtacctctcagctctgaaccccagtgacttactcaggtcagtatctaatataagctcggagtttggacggagggtctggacctcagctccaccaccccagcgacctttccgtgtctgtgatcacaagcggaccatccggaaaggcctgacagctgccacccgccaggagctgctagccaaagcattggagaccctactgctgaatggagtgctaaccctggtgctagaggaggatggaactgcagtggacagtgaggacttcttccagctgctggaggatgacacgtgcctgatggtgttgcagtctggtcagagctggagccctacaaggagtggagtgctgtcatatggcctgggacgggagaggcccaagcacagcaaggacatcgcccgattcacctttgacgtgtacaagcaaaaccctcgagacctctttggcagcctgaatgtcaaagccacattctacgggctctactctatgagttgtgactttcaaggacttggcccaaagaaagtactcagggagctccttcgttggacctccacactgctgcaaggcctgggccatatgttgctgggaatttcctccacccttcgtcatgcagtggagggggctgagcagtggcagcagaagggccgcctccattcctactaaggggctctgagcttctgcccccagaatcattccaaccgacccactgcaaagactatgacagcatcaaatttcaggacctgcagacagtacaggctagataacccacccaatttccccactgtcctctgatcccctcgtgacagaacctttcagcataacgcctcacatcccaagtctatacccttacctgaagaatgctgttctttcctagccacctttctggcctcccacttgccctgaaaggccaagatcaagatgtcccccaggcatcttgatcccagcctgactgctgctacatctaatcccctaccaatgcctcctgtccctaaactccccagcatactgatgacagccctctctgactttaccttgagatctgtcttcatacccttcccctcaaactaacaaaaacatttccaataaaaatatcaaatatttaccactaa

SEQ ID NO: 960 - DNA, 3826 bp, Homo sapiens
agcttcgccaaggccccttccggtggagccagcgctgcgaccgcctgcagaaggttgactgcgtggtagggggcccagagcaagccgaaggcaagcacgatggcgctcaccagccggcccacccgcgccccgtgccgcccggagccccagcgggcgccccgcagccgtgccagcgtcacgctgtagcagccgagcatcagcccgaaaggaagcacgaaagcggtcagagtctccaggctcaggtgggcggcggcgtggaccggcgacgggtggcacagctggcatacgcggtccctccacaggtggcggtagacggcggccgggacggcgagcaacagggcggccagccagaccgccagcagcaggcggcgggccagggccgggctgcgcagccgaggcgccaggaaggggcgggtgactgcgaggcagcgctgcaggctgagcaggccggtgagcagcacgctggcgtacatgctgagcgcgcacacgtagtacaccgccttgcagcccgcctggcccagcggccaggcctgccgggtcaggaaggccacaaagagcggcgtgagcagcagcaccgcgccgtcggccagcgccaggtgcagcacaagcgtggccgccagcggtcgcccccgtgcaggccgccagcccgccaagctccacaccacgaagccgttgccaggcagccccagcagcgccgccagcagcaggaaggctgtgcctgtggcccgcgaagtcttccagctcagcagtgtctcgttccctgggggacggtagcagaccgacatccttctgggcctacaggtgggtggaaggcgccacagagggcgttcaggggtggggcaaaaccccacctgtgatgcccgatgagaaggtgccatgcctcctccttacttccctgcagcctgcctcttttctgcctgggagtcctgacttccacgaggacccagaccccacctcaaacacaactccttcttggaacccagatcccctgctcccagtcagttgacctgccccactcctggcctccttcccagagctcagtggtaaacaggcataaagtcatcaccccaggctgtcactatctctaccaccactcctctagtctggcccctccttctttgtccagccccattctagcacatctgggcaaaactggatggtggggtgtaaagggacgtgcacagatctacttaccaagctgggagcaagcaggattgggggcctggagaagctgaaaggttaagcagcagtaggcgaggtgcctactcctgtcctgtgcctatcacatttgcagaggtgacccaaacaactcagtcccccacctgccttatccttgcctgtttccagtctcctggtccggctgagcccctggcctcctacctcctcccacctcttgcctcaggccctgccccagtcactccaccctcagggctctcaccgggctgtcaatgacagcttttccatgtaaggcatggtgctaggttccaggaggaacaggggatgcatggaggcataatggttagggagtcatgacacacaaccatgaagaggccccattaccaggctgcaccaggatacaagacaagaaaggaaaggatgagtagggacatactaagaagcagccctctcctcttggaaaagtcaagcaaaacttggaaatgaagagatttgaggggggcctggcagatggatagagctgggggaagggaaaagaaaggcctctgctcaagtaacagccagaacttgaggttgcttggggagggcaccaggagcactgtcttagtttgggttcttccaaagcagagcttgagctaagggcttgggtacaggtgatcctgtattcttgagctaagggcttgggtacaggtgatcctgtatttgggaggttaactcaggaagtgagggcataaggtaaaacaagagagaggaaagccattaagagtatgttaagtcccttcagtaggccttgggaacctctgagaaaagtatagattgcccaagacaaaagactggcagggtgatcagtccaaagcatttattaggagaatgtacttaatgagtgggctacagcgtatcctcacaacagacagtgagagagagttgttctacctgggtatatccaaaacaagggggtcagggtatggagtttacgagggttcaaggtatttggttcagggccagggccagtttttttcagtgttttgggcaacaacctgaataccttttcaaggctctggcttgggctcaagcctgcaggggaaatgcaactggccaggtcacagggcaatcaagttactctgtgtttctttgtcaggacacagaaaaaaagtggggaagctgggggaccctacaaggatccttggcaggaaagcagggattgtgttcatttgagggtttcactgtcagtgagagtctcagcttccatgcaactgtccatcacggctgcaactgaaatcagagctgggacacagcgcaccagaagctaaagtcttgatgccatcaaaggacatccctgccccattcacatctctgtcacgtccactaatcggcaaaaggagaaaagtgagagaagatgacctaagtgtgactgcagcaggcagctctggaaaatgaagccagagcagtgagccagcccctcctccgaccaaggaggaaggaaagagcagccccagcacaggagagaaccacccagcccagaagttccagggaaggaactctccggtccaccatggagtacctctcagctctgaaccccagtgacttactcaggtcagtatctaatataagctcggagtttggacggagggtctggacctcagctccaccaccccagcgacctttccgtgtctgtgatcacaagcggaccatccggaaaggcctgacagctgccacccgccaggagctgctagccaaagcattggagaccctactgctgaatggagtgctaaccctggtgctagaggaggatggaactgcagtggacagtgaggacttcttccagctgctggaggatgacacgtgcctgatggtgttgcagtctggtcagagctggagccctacaaggagtggagtgctgtcatatggcctgggacgggagaggcccaagcacagcaaggacatcgcccgattcacctttgacgtgtacaagcaaaaccctcgagacctctttggcagcctgaatgtcaaagccacattctacgggctctactctatgagttgtgactttcaaggacttggcccaaagaaagtactcagggagctccttcgttggacctccacactgctgcaaggcctgggccatatgttgctgggaatttcctccacccttcgtcatgcagtggagggggctgagcagtggcagcagaagggccgcctccattcctactaaggggctctgagcttctgcccccagaatcattccaaccgacccactgcaaagactatgacagcatcaaatttcaggacctgcagacagtacaggctagataacccacccaatttccccactgtcctctgatcccctcgtgacagaacctttcagcataacgcctcacatcccaagtctatacccttacctgaagaatgctgttctttcctagccacctttctggcctcccacttgccctgaaaggccaagatcaagatgtcccccaggcatcttgatcccagcctgactgctgctacatctaatcccctaccaatgcctcctgtccctaaactccccagcatactgatgacagccctctctgactttaccttgagatctgtcttcatacccttcccctcaaactaacaaaaacatttccaataaaaatatcaaatattt

SEQ ID NO: 961 - DNA, 1602 bp, Homo sapiens
gagccactcataaactgcagcttctcagagcctgagagccagaaaccgtccccagaaattccctccatagaaataaaaaaacaccagaagtcacatttcatccttttacatggttcccatctaccctcacaacacatgtcatcaccaaagacacacatacaagctccaatggcttttgccaggcaattcttcctccaggaccccatctggcccctccctcatccctccccttggactttgcccttcttactggccaggcaggggggccagagtccaggcttgactcattcccaccttgtcctgggctgagatcccaggtttgtaacagaaaacaccactaaagccccagcacaggagagaaccacccagcccagaagttccagggaaggaactctccggtccaccatggagtacctctcagctctgaaccccagtgacttactcaggtcagtatctaatataagctcggagtttggacggagggtctggacctcagctccaccaccccagcgacctttccgtgtctgtgatcacaagcggaccatccggaaaggcctgacagctgccacccgccaggagctgctagccaaagcattggagaccctactgctgaatggagtgctaaccctggtgctagaggaggatggaactgcagtggacagtgaggacttcttccagctgctggaggatgacacgtgcctgatggtgttgcagtctggtcagagctggagccctacaaggagtggagtgctgtcatatggcctgggacgggagaggcccaagcacagcaaggacatcgcccgattcacctttgacgtgtacaagcaaaaccctcgagacctctttggcagcctgaatgtcaaagccacattctacgggctctactctatgagttgtgactttcaaggacttggcccaaagaaagtactcagggagctccttcgttggacctccacactgctgcaaggcctgggccatatgttgctgggaatttcctccacccttcgtcatgcagtggagggggctgagcagtggcagcagaagggccgcctccattcctactaaggggctctgagcttctgcccccagaatcattccaaccgacccactgcaaagactatgacagcatcaaatttcaggacctgcagacagtacaggctagataacccacccaatttccccactgtcctctgatcccctcgtgacagaacctttcagcataacgcctcacatcccaagtctatacccttacctgaagaatgctgttctttcctagccacctttctggcctcccacttgccctgaaaggccaagatcaagatgtcccccaggcatcttgatcccagcctgactgctgctacatctaatcccctaccaatgcctcctgtccctaaactccccagcatactgatgacagccctctctgactttaccttgagatctgtcttcatacccttcccctcaaactaacaaaaacatttccaataaaaatatcaaatatttaccactaagacttctgactccaatttaaaccaggaaagggatggggtggataccccattttgccctcccccatcaacacccagtcccagatccaaagcc

SEQ ID NO: 962 - DNA, 2034 bp, Homo sapiens
gcgtgaggccgggcccgcgccgccatgaacctagagcggctgcggaagcgcgtccggcagtacctcgaccagcaacagtatcaaagtgctctattttgggcagataaagtagcttcactctctcgtgaaccccaggacatctattggttggctcagtgtctttacctgacagcacaatatcacagagccgcccatgcacttcggtcacgaaaactggacaaattgtatgaagcatgtcgttaccttgcagctaggtgccattatgctgcaaaagagcaccagcaggcccttgatgttcttgacatggaagagcccatcaataaaagattatttgaaaaatacttgaaggacgaaagtggcttcaaagatccttccagcgactgggaaatgtcacagtcttcaataaagagttctatctgtcttctacgcgggaaaatctatgatgctctagataaccgaaccctggctacctacagctacaaagaagctttgaagcttgatgtctactgttttgaagcgttcgatcttttaacatcacatcacatgctgacagcacaagaagaaaaagaacttcttgaatcactaccccttagcaagctgtgtaatgaagaacaggaattgctgcgttttctatttgagaacaaattgaaaaaatataataagcctagtgaaacggtcatccctgaatctgtagatggcttgcaagagaatctggatgtggtagtgtctttagctgagagacattattataactgtgattttaaaatgtgctacaagcttacttctgtagtaatggagaaagatcctttccatgcaagttgtttacctgtacatatagggacgcttgtagagctgaataaagccaatgaacttttctatctttctcataaactggtggatttatatcctagtaatcctgtgtcttggtttgcagtgggatgttactatctcatggtcggtcataaaaatgaacatgccagaagatatctcagcaaagccacaacacttgagaaaacctatggacctgcatggatagcctatggacattcatttgcggtggagagtgagcacgaccaagcgatggctgcttacttcacagcagcacagctgatgaaagggtgtcatttgcctatgctgtatattggattagaatatggtttgaccaataactcaaaactagctgaaaggttcttcagccaagctctgagcattgcaccggaagacccttttgttatgcatgaggtcggcgtggttgcatttcagaatggagaatggaaaacagccgaaaaatggtttcttgatgctttggaaaaaattaaagcaattgggaacgaggtaacagttgacaaatgggaacctttgttgaacaacttggggcatgtctgcagaaaacttaaaaagtatgctgaggccttggattaccaccgtcaggcactggtgttgattcctcagaacgcatccacctactctgctattggatatatccacagtctgatgggcaactttgaaaatgctgtggactacttccacacagcccttggtcttaggcgagatgatacattttctgttacaatgcttggtcattgcatcgaaatgtacattggtgattctgaagcttatattggagcagacattaaagacaaattaaaatgttatgactttgatgtgcatacaatgaagacactaaaaaacattatttcacctccgtgggatttcagggaatttgaagtagaaaaacagactgcagaagaaacggggcttacgccattggaaacctcaaggaaaactccagattccagaccttccttggaagaaacctttgaaattgaaatgaatgaaagtgacatgatgttagagacatctatgtcagaccacagcacgtgactccagtcagtggtcctggtcccactgtcccagtgtaggaacagagacccgccttaagagactggatcgcacacctttgcaacagatgtgttctgattctctgaacctacaaaatagttatacatagtggaataaagaaggtaaaccatc

SEQ ID NO: 963 - DNA, 1991 bp, Homo sapiens
cgccatgaacctagagcggctgcggaagcgcgtccggcagtacctcgaccagcaacagtatcaaagtgctctattttgggcagataaagtagcttcactctctcgtgaaccccaggacatctattggttggctcagtgtctttacctgacagcacaatatcacagagccgcccatgcacttcggtcacgaaaactggacaaattgtatgaagcatgtcgttaccttgcagctaggtgccattatgctgcaaaagagcaccagcaggcccttgatgttcttgacatggaagagcccatcaataaaagattatttgaaaaatacttgaaggacgaaagtggcttcaaagatccttccagcgactgggaaatgtcacagtcttcaataaagagttctatctgtcttctacgcgggaaaatctatgatgctctagataaccgaaccctggctacctacagctacaaagaagctttgaagcttgatgtctactgttttgaagcgttcgatcttttaacatcacatcacatgctgacagcacaagaagaaaaagaacttcttgaatcactaccccttagcaagctgtgtaatgaagaacaggaattgctgcgttttctatttgagaacaaattgaaaaaatataataagcctagtgaaacggtcatccctgaatctgtagatggcttgcaagagaatctggatgtggtagtgtctttagctgagagacattattataactgtgattttaaaatgtgctacaagcttacttctgtagtaatggagaaagatcctttccatgcaagttgtttacctgtacatatagggacgcttgtagagctgaataaagccaatgaacttttctatctttctcataaactggtggatttatatcctagtaatcctgtgtcttggtttgcagtgggatgttactatctcatggtcggtcataaaaatgaacatgccagaagatatctcagcaaagccacaacacttgagaaaacctatggacctgcatggatagcctatggacattcatttgcggtggagagtgagcacgaccaagcgatggctgcttacttcacagcagcacagctgatgaaaggatggaaaacagccgaaaaatggtttcttgatgctttggaaaaaattaaagcaattgggaacgaggtaacagttgacaaatgggaacctttgttgaacaacttggggcatgtctgcagaaaacttaaaaagtatgctgaggccttggattaccaccgtcaggcactggtgttgattcctcagaacgcatccacctactctgctattggatatatccacagtctgatgggcaactttgaaaatgctgtggactacttccacacagcccttggtcttaggcgagatgatacattttctgttacaatgcttggtcattgcatcgaaatgtacattggtgattctgaagcttatattggagcagacattaaagacaaattaaaatgttatgactttgatgtgcatacaatgaagacactaaaaaacattatttcacctccgtgggatttcagggaatttgaagtagaaaaacagactgcagaagaaacggggcttacgccattggaaacctcaaggaaaactccagattccagaccttccttggaagaaacctttgaaattgaaatgaatgaaagtgacatgatgttagagacatctatgtcagaccacagcacgtgactccagtcagtggtcctggtcccactgtcccagtgtaggttagtattccttcacatcctctccatggcttaagaatgtcccacttcctaacgtgactccaaactgcatctctacatttaggaacagagacccgccttaagagactggatcgcacacctttgcaacagatgtgttctgattctctgaacctacaaaatagttatacatagtggaataaagaaggtaaaccatctgttatgtctttttttttcttttccaataaacttttattttggactaa

SEQ ID NO: 964 - DNA, 2203 bp, Homo sapiens
cggcggcggcggctgcaggcacgggcacgggcacggggcggggtgcttagggtgcaggaggcgcgcgcctagcggcggagtgtggcgtgaggccgggcccgcgccgccatgaacctagagcggctgcggaagcgcgtccggcagtacctcgaccagcaacagtatcaaagtgctctattttgggcagataaagtagcttcactctctcgtgaagaaccccaggacatctattggttggctcagtgtctttacctgacagcacaatatcacagagccgcccatgcacttcggtcacgaaaactggacaaattgtatgaagcatgtcgttaccttgcagctaggtgccattatgctgcaaaagagcaccagcaggcccttgatgttcttgacatggaagagcccatcaataaaagattatttgaaaaatacttgaaggacgaaagtggcttcaaagatccttccagcgactgggaaatgtcacagtcttcaataaagagttctatctgtcttctacgcgggaaaatctatgatgctctagataaccgaaccctggctacctacagctacaaagaagctttgaagcttgatgtctactgttttgaagcgttcgatcttttaacatcacatcacatgctgacagcacaagaagaaaaagaacttcttgaatcactaccccttagcaagctgtgtaatgaagaacaggaattgctgcgttttctatttgagaacaaattgaaaaaatataataagcctagtgaaacggtcatccctgaatctgtagatggcttgcaagagaatctggatgtggtagtgtctttagctgagagacattattataactgtgattttaaaatgtgctacaagcttacttctgtagtaatggagaaagatcctttccatgcaagttgtttacctgtacatatagggacgcttgtagagctgaataaagccaatgaacttttctatctttctcataaactggtggatttatatcctagtaatcctgtgtcttggtttgcagtgggatgttactatctcatggtcggtcataaaaatgaacatgccagaagatatctcagcaaagccacaacacttgagaaaacctatggacctgcatggatagcctatggacattcatttgcggtggagagtgagcacgaccaagcgatggctgcttacttcacagcagcacagctgatgaaagggtgtcatttgcctatgctgtatattggattagaatatggtttgaccaataactcaaaactagctgaaaggttcttcagccaagctctgagcattgcaccggaagacccttttgttatgcatgaggtcggcgtggttgcatttcagaatggagaatggaaaacagccgaaaaatggtttcttgatgctttggaaaaaattaaagcaattgggaacgaggtaacagttgacaaatgggaacctttgttgaacaacttggggcatgtctgcagaaaacttaaaaagtatgctgaggccttggattaccaccgtcaggcactggtgttgattcctcagaacgcatccacctactctgctattggatatatccacagtctgatgggcaactttgaaaatgctgtggactacttccacacagcccttggtcttaggcgagatgatacattttctgttacaatgcttggtcattgcatcgaaatgtacattggtgattctgaagcttatattggagcagacattaaagacaaattaaaatgttatgactttgatgtgcatacaatgaagacactaaaaaacattatttcacctccgtgggatttcagggaatttgaagtagaaaaacagactgcagaagaaacggggcttacgccattggaaacctcaaggaaaactccagattccagaccttccttggaagaaacctttgaaattgaaatgaatgaaagtgacatgatgttagagacatctatgtcagaccacagcacgtgactccagtcagtggtcctggtcccactgtcccagtgtaggttagtattccttcacatcctctccatggcttaagaatgtcccacttcctaacgtgactccaaactgcatctctacatttaggaacagagacccgccttaagagactggatcgcacacctttgcaacagatgtgttctgattctctgaacctacaaaatagttatacatagtggaataaagaaggtaaaccatc

SEQ ID NO: 965 - DNA, 2211 bp, Homo sapiens
gagcctgggcagtgcacggggcctgggtggggggtgcgggtgtgggtggggacctgcggccttcgagtccgcggccttcgagtcctggggcggcggcggcggctgcaggcacgggcacgggcacggggcggggtgcttagggtgcaggaggcgcgcgcctagcggcggagtgtggcgtgaggccgggcccgcgccgccatgaacctagagcggctgcggaagcgcgtccggcagtacctcgaccagcaacagtatcaaagtgctctattttgggcagataaagtagcttcactctctcgtgaagaaccccaggacatctattggttggctcagtgtctttacctgacagcacaatatcacagagccgcccatgcacttcggtcacgaaaactggacaaattgtatgaagcatgtcgttaccttgcagctaggtgccattatgctgcaaaagagcaccagcaggcccttgatgttcttgacatggaagagcccatcaataaaagattatttgaaaaatacttgaaggacgaaagtggcttcaaagatccttccagcgactgggaaatgtcacagtcttcaataaagagttctatctgtcttctacgcgggaaaatctatgatgctctagataaccgaaccctggctacctacagctacaaagaagctttgaagcttgatgtctactgttttgaagcgttcgatcttttaacatcacatcacatgctgacagcacaagaagaaaaagaacttcttgaatcactaccccttagcaagctgtgtaatgaagaacaggaattgctgcgttttctatttgagaacaaattgaaaaaatataataagcctagtgaaacggtcatccctgaatctgtagatggcttgcaagagaatctggatgtggtagtgtctttagctgagagacattattataactgtgattttaaaatgtgctacaagcttacttctgtagtaatggagaaagatcctttccatgcaagttgtttacctgtacatatagggacgcttgtagagctgaataaagccaatgaacttttctatctttctcataaactggtggatttatatcctagtaatcctgtgtcttggtttgcagtgggatgttactatctcatggtcggtcataaaaatgaacatgccagaagatatctcagcaaagccacaacacttgagaaaacctatggacctgcatggatagcctatggacattcatttgcggtggagagtgagcacgaccaagcgatggctgcttacttcacagcagcacagctgatgaaagggtgtcatttgcctatgctgtatattggattagaatatggtttgaccaataactcaaaactagctgaaaggttcttcagccaagctctgagcattgcaccggaagacccttttgttatgcatgaggtcggcgtggttgcatttcagaatggagaatggaaaacagccgaaaaatggtttcttgatgctttggaaaaaattaaagcaattgggaacgaggtaacagttgacaaatgggaacctttgttgaacaacttggggcatgtctgcagaaaacttaaaaagtatgctgaggccttggattaccaccgtcaggcactggtgttgattcctcagaacgcatccacctactctgctattggatatatccacagtctgatgggcaactttgaaaatgctgtggactacttccacacagcccttggtcttaggcgagatgatacattttctgttacaatgcttggtcattgcatcgaaatgtacattggtgattctgaagcttatattggagcagacattaaagacaaattaaaatgttatgactttgatgtgcatacaatgaagacactaaaaaacattatttcacctccgtgggatttcagggaatttgaagtagaaaaacagactgcagaagaaacggggcttacgccattggaaacctcaaggaaaactccagattccagaccttccttggaagaaacctttgaaattgaaatgaatgaaagtgacatgatgttagagacatctatgtcagaccacagcacgtgactccagtcagtggtcctggtcccactgtcccagtgtaggaacagagacccgccttaagagactggatcgcacacctttgcaacagatgtgttctgattctctgaacctacaaaatagttatacatagtggaataaagaaggtaaaccatc

SEQ ID NO: 966 - DNA, 2034 bp, Homo sapiens; identical to SEQ ID NO: 962

SEQ ID NO: 967 - DNA, 2156 bp, Homo sapiens
gcggcggcggctgcaggcacgggcacgggcacggggcggggtgcttagggtgcaggaggcgcgcgcctagcggcggagtgtggcgtgaggccgggcccgcgccgccatgaacctagagcggctgcggaagcgcgtccggcagtacctcgaccagcaacagtatcaaagtgctctattttgggcagataaagtagcttcactctctcgtgaaccccaggacatctattggttggctcagtgtctttacctgacagcacaatatcacagagccgcccatgcacttcggtcacgaaaactggacaaattgtatgaagcatgtcgttaccttgcagctaggtgccataagtcgtgagtgatgagcggcacttctgttttccacgtagtatgctgcaaaagagcaccagcaggcccttgatgttcttgacatggaagagcccatcaataaaagattatttgaaaaatacttgaaggacgaaagtggcttcaaagatccttccagcgactgggaaatgtcacagtcttcaataaagagttctatctgtcttctacgcgggaaaatctatgatgctctagataaccgaaccctggctacctacagctacaaagaagctttgaagcttgatgtctactgttttgaagcgttcgatcttttaacatcacatcacatgctgacagcacaagaagaaaaagaacttcttgaatcactaccccttagcaagctgtgtaatgaagaacaggaattgctgcgttttctatttgagaacaaattgaaaaaatataataagcctagtgaaacggtcatccctgaatctgtagatggcttgcaagagaatctggatgtggtagtgtctttagctgagagacattattataactgtgattttaaaatgtgctacaagcttacttctgtagtaatggagaaagatcctttccatgcaagttgtttacctgtacatatagggacgcttgtagagctgaataaagccaatgaacttttctatctttctcataaactggtggatttatatcctagtaatcctgtgtcttggtttgcagtgggatgttactatctcatggtcggtcataaaaatgaacatgccagaagatatctcagcaaagccacaacacttgagaaaacctatggacctgcatggatagcctatggacattcatttgcggtggagagtgagcacgaccaagcgatggctgcttacttcacagcagcacagctgatgaaagggtgtcatttgcctatgctgtatattggattagaatatggtttgaccaataactcaaaactagctgaaaggttcttcagccaagctctgagcattgcaccggaagacccttttgttatgcatgaggtcggcgtggttgcatttcagaatggagaatggaaaacagccgaaaaatggtttcttgatgctttggaaaaaattaaagcaattgggaacgaggtaacagttgacaaatgggaacctttgttgaacaacttggggcatgtctgcagaaaacttaaaaagtatgctgaggccttggattaccaccgtcaggcactggtgttgattcctcagaacgcatccacctactctgctattggatatatccacagtctgatgggcaactttgaaaatgctgtggactacttccacacagcccttggtcttaggcgagatgatacattttctgttacaatgcttggtcattgcatcgaaatgtacattggtgattctgaagcttatattggagcagacattaaagacaaattaaaatgttatgactttgatgtgcatacaatgaagacactaaaaaacattatttcacctccgtgggatttcagggaatttgaagtagaaaaacagactgcagaagaaacggggcttacgccattggaaacctcaaggaaaactccagattccagaccttccttggaagaaacctttgaaattgaaatgaatgaaagtgacatgatgttagagacatctatgtcagaccacagcacgtgactccagtcagtggtcctggtcccactgtcccagtgtaggaacagagacccgccttaagagactggatcgcacacctttgcaacagatgtgttctgattctctgaacctacaaaatagttatacatagtggaataaagaaggtaaaccatc

SEQ ID NO: 968 - DNA, 2140 bp, Homo sapiens
gagcctgggcagtgcacggggcctgggtggggggtgcgggtgtgggtggggacctgcggccttcgagtccgcggccttcgagtcctggggcggcggcggcggctgcaggcacgggcacgggcacggggcggggtgcttagggtgcaggaggcgcgcgcctagcggcggagtgtggcgtgaggccgggcccgcgccgccatgaacctagagcggctgcggaagcgcgtccggcagtacctcgaccagcaacagtatcaaagtgctctattttgggcagataaagtagcttcactctctcgtgaagaaccccaggacatctattggttggctcagtgtctttacctgacagcacaatatcacagagccgcccatgcacttcggtcacgaaaactggacaaattgtatgaagcatgtcgttaccttgcagctaggtgccattatgctgcaaaagagcaccagcaggcccttgatgttcttgacatggaagagcccatcaataaaagattatttgaaaaatacttgaaggacgaaagtggcttcaaagatccttccagcgactgggaaatgtcacagtcttcaataaagagttctatctgtcttctacgcgggaaaatctatgatgctctagataaccgaaccctggctacctacagctacaaagaagctttgaagcttgatgtctactgttttgaagcgttcgatcttttaacatcacatcacatgctgacagcacaagaagaaaaagaacttcttgaatcactaccccttagcaagctgtgtaatgaagaacaggaattgctgcgttttctatttgagaacaaattgaaaaaatataataagcctagtgaaacggtcatccctgaatctgtagatggcttgcaagagaatctggatgtggtagtgtctttagctgagagacattattataactgtgattttaaaatgtgctacaagcttacttctgtagtaatggagaaagatcctttccatgcaagttgtttacctgtacatatagggacgcttgtagagctgaataaagccaatgaacttttctatctttctcataaactggtggatttatatcctagtaatcctgtgtcttggtttgcagtgggatgttactatctcatggtcggtcataaaaatgaacatgccagaagatatctcagcaaagccacaacacttgagaaaacctatggacctgcatggatagcctatggacattcatttgcggtggagagtgagcacgaccaagcgatggctgcttacttcacagcagcacagctgatgaaaggatggaaaacagccgaaaaatggtttcttgatgctttggaaaaaattaaagcaattgggaacgaggtaacagttgacaaatgggaacctttgttgaacaacttggggcatgtctgcagaaaacttaaaaagtatgctgaggccttggattaccaccgtcaggcactggtgttgattcctcagaacgcatccacctactctgctattggatatatccacagtctgatgggcaactttgaaaatgctgtggactacttccacacagcccttggtcttaggcgagatgatacattttctgttacaatgcttggtcattgcatcgaaatgtacattggtgattctgaagcttatattggagcagacattaaagacaaattaaaatgttatgactttgatgtgcatacaatgaagacactaaaaaacattatttcacctccgtgggatttcagggaatttgaagtagaaaaacagactgcagaagaaacggggcttacgccattggaaacctcaaggaaaactccagattccagaccttccttggaagaaacctttgaaattgaaatgaatgaaagtgacatgatgttagagacatctatgtcagaccacagcacgtgactccagtcagtggtcctggtcccactgtcccagtgtaggttagtattccttcacatcctctccatggcttaagaatgtcccacttcctaacgtgactccaaactgcatctctacatttaggaacagagacccgccttaagagactggatcgcacacctttgcaacagatgtgttctgattctctgaacctacaaaatagttatacatagtggaataaagaaggtaaaccatc

SEQ ID NO: 969 - DNA, 1675 bp, Homo sapiens
gaggcgtaagccaggcgtgttaaagccggtcggaactgctccggagggcacgggctccgtaggcaccaactgcaaggacccctccccctgcgggcgctcccatggcacagttcgcgttcgagagtgacctgcactcgctgcttcagctggatgcacccatccccaatgcaccccctgcgcgctggcagcgcaaagccaaggaagccgcaggcccggccccctcacccatgcgggccgccaaccgatcccacagcgccggcaggactccgggccgaactcctggcaaatccagttccaaggttcagaccactcctagcaaacctggcggtgaccgctatatcccccatcgcagtgctgcccagatggaggtggccagcttcctcctgagcaaggagaaccagcctgaaaacagccagacgcccaccaagaaggaacatcagaaagcctgggctttgaacctgaacggttttgatgtagaggaagccaagatccttcggctcagtggaaaaccacaaaatgcgccagagggttatcagaacagactgaaagtactctacagccaaaaggccactcctggctccagccggaagacctgccgttacattccttccctgccagaccgtatcctggatgcgcctgaaatccgaaatgactattacctgaaccttgtggattggagttctgggaatgtactggccgtggcactggacaacagtgtgtacctgtggagtgcaagctctggtgacatcctgcagcttttgcaaatggagcagcctggggaatatatatcctctgtggcctggatcaaagagggcaactacttggctgtgggcaccagcagtgctgaggtgcagctatgggatgtgcagcagcagaaacggcttcgaaatatgaccagtcactctgcccgagtgggctccctaagctggaacagctatatcctgtccagtggttcacgttctggccacatccaccaccatgatgttcgggtagcagaacaccatgtggccacactgagtggccacagccaggaagtgtgtgggctgcgctgggccccagatggacgacatttggccagtggtggtaatgataacttggtcaatgtgtggcctagtgctcctggagagggtggctgggttcctctgcagacattcacccagcatcaaggggctgtcaaggccgtagcatggtgtccctggcagtccaatgtcctggcaacaggagggggcaccagtgatcgacacattcgcatctggaatgtgtgctctggggcctgtctgagtgccgtggatgcccattcccaggtgtgctccatcctctggtctccccattacaaggagctcatctcaggccatggctttgcacagaaccagctagttatttggaagtacccaaccatggccaaggtggctgaactcaaaggtcacacatcccgggtcctgagtctgaccatgagcccagatggggccacagtggcatccgcagcagcagatgagaccctgaggctatggcgctgttttgagttggaccctgcgcggcggcgggagcgggagaaggccagtgcagccaaaagcagcctcatccaccaaggcatccgctgaagaccaacccatcacctcagttgttttttatttttctaataaagtcatgtctcccttcatgttttttttttaaa

SEQ ID NO: 970 - DNA, 1777 bp, Homo sapiens
ggtggtggggctgagccgaggtggggccgtggccagggggagggggtgctaggccggaaggggctgcagccgagggtggccctgattttgtggccggccaggagcgaaggggtccctttctgtcccctgagcaccgtcgcctcctttcctccagggctccgtaggcaccaactgcaaggacccctccccctgcgggcgctcccatggcacagttcgcgttcgagagtgacctgcactcgctgcttcagctggatgcacccatccccaatgcaccccctgcgcgctggcagcgcaaagccaaggaagccgcaggcccggccccctcacccatgcgggccgccaaccgatcccacagcgccggcaggactccgggccgaactcctggcaaatccagttccaaggttcagaccactcctagcaaacctggcggtgaccgctatatcccccatcgcagtgctgcccagatggaggtggccagcttcctcctgagcaaggagaaccagcctgaaaacagccagacgcccaccaagaaggaacatcagaaagcctgggctttgaacctgaacggttttgatgtagaggaagccaagatccttcggctcagtggaaaaccacaaaatgcgccagagggttatcagaacagactgaaagtactctacagccaaaaggccactcctggctccagccggaagacctgccgttacattccttccctgccagaccgtatcctggatgcgcctgaaatccgaaatgactattacctgaaccttgtggattggagttctgggaatgtactggccgtggcactggacaacagtgtgtacctgtggagtgcaagctctggtgacatcctgcagcttttgcaaatggagcagcctggggaatatatatcctctgtggcctggatcaaagagggcaactacttggctgtgggcaccagcagtgctgaggtgcagctatgggatgtgcagcagcagaaacggcttcgaaatatgaccagtcactctgcccgagtgggctccctaagctggaacagctatatcctgtccagtggttcacgttctggccacatccaccaccatgatgttcgggtagcagaacaccatgtggccacactgagtggccacagccaggaagtgtgtgggctgcgctgggccccagatggacgacatttggccagtggtggtaatgataacttggtcaatgtgtggcctagtgctcctggagagggtggctgggttcctctgcagacattcacccagcatcaaggggctgtcaaggccgtagcatggtgtccctggcagtccaatgtcctggcaacaggagggggcaccagtgatcgacacattcgcatctggaatgtgtgctctggggcctgtctgagtgccgtggatgcccattcccaggtgtgctccatcctctggtctccccattacaaggagctcatctcaggccatggctttgcacagaaccagctagttatttggaagtacccaaccatggccaaggtggctgaactcaaaggtcacacatcccgggtcctgagtctgaccatgagcccagatggggccacagtggcatccgcagcagcagatgagaccctgaggctatggcgctgttttgagttggaccctgcgcggcggcgggagcgggagaaggccagtgcagccaaaagcagcctcatccaccaaggcatccgctgaagaccaacccatcacctcagttgttttttatttttctaataaagtcatgtctcccttcatgttttttttttaaa

SEQ ID NO: 971 - DNA, 1627 bp, Homo sapiens
aataggcgctcggagcggagagtttaagaggcgtaagccaggcgtgttaaagccggtcggaactgctccggagggcacgggctccgtaggcaccaactgcaaggacccctccccctgcgggcgctcccatggcacagttcgcgttcgagagtgacctgcactcgctgcttcagctggatgcacccatccccaatgcaccccctgcgcgctggcagcgcaaagccaaggaagccgcaggcccggccccctcacccatgcgggccgccaaccgatcccacagcgccggcaggactccgggccgaactcctggcaaatccagttccaaggttcagaccactcctagcaaggagaaccagcctgaaaacagccagacgcccaccaagaaggaacatcagaaagcctgggctttgaacctgaacggttttgatgtagaggaagccaagatccttcggctcagtggaaaaccacaaaatgcgccagagggttatcagaacagactgaaagtactctacagccaaaaggccactcctggctccagccggaagacctgccgttacattccttccctgccagaccgtatcctggatgcgcctgaaatccgaaatgactattacctgaaccttgtggattggagttctgggaatgtactggccgtggcactggacaacagtgtgtacctgtggagtgcaagctctggtgacatcctgcagcttttgcaaatggagcagcctggggaatatatatcctctgtggcctggatcaaagagggcaactacttggctgtgggcaccagcagtgctgaggtgcagctatgggatgtgcagcagcagaaacggcttcgaaatatgaccagtcactctgcccgagtgggctccctaagctggaacagctatatcctgtccagtggttcacgttctggccacatccaccaccatgatgttcgggtagcagaacaccatgtggccacactgagtggccacagccaggaagtgtgtgggctgcgctgggccccagatggacgacatttggccagtggtggtaatgataacttggtcaatgtgtggcctagtgctcctggagagggtggctgggttcctctgcagacattcacccagcatcaaggggctgtcaaggccgtagcatggtgtccctggcagtccaatgtcctggcaacaggagggggcaccagtgatcgacacattcgcatctggaatgtgtgctctggggcctgtctgagtgccgtggatgcccattcccaggtgtgctccatcctctggtctccccattacaaggagctcatctcaggccatggctttgcacagaaccagctagttatttggaagtacccaaccatggccaaggtggctgaactcaaaggtcacacatcccgggtcctgagtctgaccatgagcccagatggggccacagtggcatccgcagcagcagatgagaccctgaggctatggcgctgttttgagttggaccctgcgcggcggcgggagcgggagaaggccagtgcagccaaaagcagcctcatccaccaaggcatccgctgaagaccaacccatcacctcagttgttttttatttttctaataaagtcatgtctcccttcatgtttttttttt

SEQ ID NO: 972 - DNA, 2128 bp, Homo sapiens
gtttgaatggtcaacgcctgcggctgttgatattcttgctcagaggccgtaactttggccttctgctcagggaagactctgagtccgacgttggcctacccagtcggaaggcagagctgcaatctagttaactacctcctttcccctagatttcctttcattctgctcaagtcttcgcctgtgtccgatccctatctactttctctcctcttgtaggcaagcctcagactccaggcttgagctaggttttgtttttctcctggtgagaattcgaagaccatgtctacggaactcttctcatccacaagagaggaaggaagctctggctcaggacccagttttaggtctaatcaaaggaaaatgttaaacctgctcctggagagagacacttcctttaccgtctgtccagatgtccctagaactccagtgggcaaatttcttggtgattctgcaaacctaagcattttgtctggaggaaccccaaaacgttgcctcgatctttcgaatcttagcagtggggagataactgccactcagcttaccacttctgcagaccttgatgaaactggtcacctggattcttcaggacttcaggaagtgcatttagctgggatgaatcatgaccagcacctaatgaaatgtagcccagcacagcttctttgtagcactccgaatggtttggaccgtggccatagaaagagagatgcaatgtgtagttcatctgcaaataaagaaaatgacaatggaaacttggtggacagtgaaatgaaatatttgggcagtcccattactactgttccaaaattggataaaaatccaaacctaggagaagaccaggcagaagagatttcagatgaattaatggagttttccctgaaagatcaagaagcaaaggtgagcagaagtggcctatatcgctccccgtcgatgccagagaacttgaacaggccaagactgaagcaggtggaaaaattcaaggacaacacaataccagataaagttaaaaaaaagtatttttctggccaaggaaagctcaggaagggcttatgtttaaagaagacagtctctctgtgtgacattactatcactcagatgctggaggaagattctaaccaggggcacctgattggtgatttttccaaggtatgtgcgctgccaaccgtgtcagggaaacaccaagatctgaagtatgtcaacccagaaacagtggctgccttactgtcggggaagttccagggtctgattgagaagttttatgtcattgattgtcgctatccatatgagtatctgggaggacacatccagggagccttaaacttatatagtcaggaagaactgtttaacttctttctgaagaagcccatcgtccctttggacacccagaagagaataatcatcgtgttccactgtgaattctcctcagagaggggcccccgaatgtgccgctgtctgcgtgaagaggacaggtctctgaaccagtatcctgcattgtactacccagagctatatatccttaaaggcggctacagagacttctttccagaatatatggaactgtgtgaaccacagagctactgccctatgcatcatcaggaccacaagactgagttgctgaggtgtcgaagccagagcaaagtgcaggaaggggagcggcagctgcgggagcagattgcccttctggtgaaggacatgagcccatgataacattccagccactggctgctaacaagtcaccaaaagacactgcagaaaccctgagcagaaagaggccttctggatggccaaacccaagattattaaaagatgtctctgcaaaccaacaggctaccaacttgtatccaggcctgggaatggattaggtttcagcagagctgaaagctggtggcagagtcctggagctggctctataaggcagccttgagttgcatagagatttgtattggttcagggaactctggcattccttttcccaactcctcatgtcttctcacaagccagccaactctttctctctgggcttcgggctatgcaagagcgttgtctaccttctttctttgtattttccttctttgtttccccctctttcttttttaaaaatggaaaaataaacactacagaatgagaggtg

SEQ ID NO: 973 - DNA, 1896 bp, Homo sapiens
ggtcaacgcctgcggctgttgatattcttgctcagaggccgtaactttggccttctgctcagggaagactctgagtccgacgttggcctacccagtcggaaggcagagctgcaatctagttaactacctcctttcccctagatttcctttcattctgctcaagtcttcgcctgtgtccgatccctatctactttctctcctcttgtaggcaagcctcagactccaggcttgagctaggttttgtttttctcctggtgagaattcgaagaccatgtctacggaactcttctcatccacaagagaggaaggaagctctggctcaggacccagttttaggtctaatcaaaggaaaatgttaaacctgctcctggagagagacacttcctttaccgtctgtccagatgtccctagaactccagtgggcaaatttcttggtgattctgcaaacctaagcattttgtctgggtcacctggattcttcaggacttcaggaagtgcatttagctgggatgacaatggaaacttggtggacagtgaaatgaaatatttgggcagtcccattactactgttccaaaattggataaaaatccaaacctaggagaagaccaggcagaagagatttcagatgaattaatggagttttccctgaaagatcaagaagcaaaggtgagcagaagtggcctatatcgctccccgtcgatgccagagaacttgaacaggccaagactgaagcaggtggaaaaattcaaggacaacacaataccagataaagttaaaaaaaagtatttttctggccaaggaaagctcaggaagggcttatgtttaaagaagacagtctctctgtgtgacattactatcactcagatgctggaggaagattctaaccaggggcacctgattggtgatttttccaaggtatgtgcgctgccaaccgtgtcagggaaacaccaagatctgaagtatgtcaacccagaaacagtggctgccttactgtcggggaagttccagggtctgattgagaagttttatgtcattgattgtcgctatccatatgagtatctgggaggacacatccagggagccttaaacttatatagtcaggaagaactgtttaacttctttctgaagaagcccatcgtccctttggacacccagaagagaataatcatcgtgttccactgtgaattctcctcagagaggggcccccgaatgtgccgctgtctgcgtgaagaggacaggtctctgaaccagtatcctgcattgtactacccagagctatatatccttaaaggcggctacagagacttctttccagaatatatggaactgtgtgaaccacagagctactgccctatgcatcatcaggaccacaagactgagttgctgaggtgtcgaagccagagcaaagtgcaggaaggggagcggcagctgcgggagcagattgcccttctggtgaaggacatgagcccatgataacattccagccactggctgctaacaagtcaccaaaagacactgcagaaaccctgagcagaaagaggccttctggatggccaaacccaagattattaaaagatgtctctgcaaaccaacaggctaccaacttgtatccaggcctgggaatggattaggtttcagcagagctgaaagctggtggcagagtcctggagctggctctataaggcagccttgagttgcatagagatttgtattggttcagggaactctggcattccttttcccaactcctcatgtcttctcacaagccagccaactctttctctctgggcttcgggctatgcaagagcgttgtctaccttctttctttgtattttccttctttgtttccccctctttcttttttaaaaatggaaaaataaacactacagaatgag

SEQ ID NO: 974 - DNA, 2025 bp, Homo sapiens
ggtcaacgcctgcggctgttgatattcttgctcagaggccgtaactttggccttctgctcagggaagactctgagtccgacgttggcctacccagtcggaaggcagagctgcaatctagttaactacctcctttcccctagatttcctttcattctgctcaagtcttcgcctgtgtccgatccctatctactttctctcctcttgtaggcaagcctcagactccaggcttgagctaggttttgtttttctcctggtgagaattcgaagaccatgtctacggaactcttctcatccacaagagaggaaggaagctctggctcaggacccagttttaggtctaatcaaaggaaaatgttaaacctgctcctggagagagacacttcctttaccgtctgtccagatgtccctagaactccagtgggcaaatttcttggtgattctgcaaacctaagcattttgtctggaggaaccccaaaacgttgcctcgatctttcgaatcttagcagtggggagataactgccactcagcttaccacttctgcagaccttgatgaaactggtcacctggattcttcaggacttcaggaagtgcatttagctgggatgaatcatgaccagcacctaatgaaatgtagcccagacaatggaaacttggtggacagtgaaatgaaatatttgggcagtcccattactactgttccaaaattggataaaaatccaaacctaggagaagaccaggcagaagagatttcagatgaattaatggagttttccctgaaagatcaagaagcaaaggtgagcagaagtggcctatatcgctccccgtcgatgccagagaacttgaacaggccaagactgaagcaggtggaaaaattcaaggacaacacaataccagataaagttaaaaaaaagtatttttctggccaaggaaagctcaggaagggcttatgtttaaagaagacagtctctctgtgtgacattactatcactcagatgctggaggaagattctaaccaggggcacctgattggtgatttttccaaggtatgtgcgctgccaaccgtgtcagggaaacaccaagatctgaagtatgtcaacccagaaacagtggctgccttactgtcggggaagttccagggtctgattgagaagttttatgtcattgattgtcgctatccatatgagtatctgggaggacacatccagggagccttaaacttatatagtcaggaagaactgtttaacttctttctgaagaagcccatcgtccctttggacacccagaagagaataatcatcgtgttccactgtgaattctcctcagagaggggcccccgaatgtgccgctgtctgcgtgaagaggacaggtctctgaaccagtatcctgcattgtactacccagagctatatatccttaaaggcggctacagagacttctttccagaatatatggaactgtgtgaaccacagagctactgccctatgcatcatcaggaccacaagactgagttgctgaggtgtcgaagccagagcaaagtgcaggaaggggagcggcagctgcgggagcagattgcccttctggtgaaggacatgagcccatgataacattccagccactggctgctaacaagtcaccaaaagacactgcagaaaccctgagcagaaagaggccttctggatggccaaacccaagattattaaaagatgtctctgcaaaccaacaggctaccaacttgtatccaggcctgggaatggattaggtttcagcagagctgaaagctggtggcagagtcctggagctggctctataaggcagccttgagttgcatagagatttgtattggttcagggaactctggcattccttttcccaactcctcatgtcttctcacaagccagccaactctttctctctgggcttcgggctatgcaagagcgttgtctaccttctttctttgtattttccttctttgtttccccctctttcttttttaaaaatggaaaaataaacactacagaatgag

SEQ ID NO: 975 - DNA, 1986 bp, Homo sapiens
ggtcaacgcctgcggctgttgatattcttgctcagaggccgtaactttggccttctgctcagggaagactctgagtccgacgttggcctacccagtcggaaggcagagctgcaatctagttaactacctcctttcccctagatttcctttcattctgctcaagtcttcgcctgtgtccgatccctatctactttctctcctcttgtaggcaagcctcagactccaggcttgagctaggttttgtttttctcctggtgagaattcgaagaccatgtctacggaactcttctcatccacaagagaggaaggaagctctggctcaggacccagttttaggtctaatcaaaggaaaatgttaaacctgctcctggagagagacacttcctttaccgtctgtccagatgtccctagaactccagtgggcaaatttcttggtgattctgcaaacctaagcattttgtctgggtcacctggattcttcaggacttcaggaagtgcatttagctgggatgcacagcttctttgtagcactccgaatggtttggaccgtggccatagaaagagagatgcaatgtgtagttcatctgcaaataaagaaaatgacaatggaaacttggtggacagtgaaatgaaatatttgggcagtcccattactactgttccaaaattggataaaaatccaaacctaggagaagaccaggcagaagagatttcagatgaattaatggagttttccctgaaagatcaagaagcaaaggtgagcagaagtggcctatatcgctccccgtcgatgccagagaacttgaacaggccaagactgaagcaggtggaaaaattcaaggacaacacaataccagataaagttaaaaaaaagtatttttctggccaaggaaagctcaggaagggcttatgtttaaagaagacagtctctctgtgtgacattactatcactcagatgctggaggaagattctaaccaggggcacctgattggtgatttttccaaggtatgtgcgctgccaaccgtgtcagggaaacaccaagatctgaagtatgtcaacccagaaacagtggctgccttactgtcggggaagttccagggtctgattgagaagttttatgtcattgattgtcgctatccatatgagtatctgggaggacacatccagggagccttaaacttatatagtcaggaagaactgtttaacttctttctgaagaagcccatcgtccctttggacacccagaagagaataatcatcgtgttccactgtgaattctcctcagagaggggcccccgaatgtgccgctgtctgcgtgaagaggacaggtctctgaaccagtatcctgcattgtactacccagagctatatatccttaaaggcggctacagagacttctttccagaatatatggaactgtgtgaaccacagagctactgccctatgcatcatcaggaccacaagactgagttgctgaggtgtcgaagccagagcaaagtgcaggaaggggagcggcagctgcgggagcagattgcccttctggtgaaggacatgagcccatgataacattccagccactggctgctaacaagtcaccaaaagacactgcagaaaccctgagcagaaagaggccttctggatggccaaacccaagattattaaaagatgtctctgcaaaccaacaggctaccaacttgtatccaggcctgggaatggattaggtttcagcagagctgaaagctggtggcagagtcctggagctggctctataaggcagccttgagttgcatagagatttgtattggttcagggaactctggcattccttttcccaactcctcatgtcttctcacaagccagccaactctttctctctgggcttcgggctatgcaagagcgttgtctaccttctttctttgtattttccttctttgtttccccctctttcttttttaaaaatggaaaaataaacactacagaatgag

SEQ ID NO: 976 - DNA, 1556 bp, Homo sapiens
agaggccgtaactttggccttctgctcagggaagactctgagtccgacgttggcctacccagtcggaaggcagagctgcaatctagttaactacctcctttcccctagatttcctttcattctgctcaagtcttcgcctgtgtccgatccctatctactttctctcctcttgtaggcaagcctcagactccaggcttgaggttttgtttttctcctggtgagaattcgaagaccatgtctacggaactcttctcatccacaagagaggaaggaagctctggctcaggacccagttttaggtctaatcaaaggaaaatgttaaacctgctcctggagagagacacttcctttaccgtctgtccagatgtccctagaactccagtgggcaaatttcttggtgattctgcaaacctaagcattttgtctgggtcacctggattcttcaggacttcaggaagtgcatttagctgggatgacaatggaaacttggtggacagtgaaatgaaatatttgggcagtcccattactactgttccaaaattggataaaaatccaaacctaggagaagaccaggcagaagagatttcagatgaattaatggagttttccctgaaagatcaagaagcaaaggtgagcagaagtggcctatatcgctccccgtcgatgccagagaacttgaacaggccaagactgaagcaggtggaaaaattcaaggacaacacaataccagataaagttaaaaaaaagtatttttctggccaaggaaagctcaggaagggcttatgtttaaagaagacagtctctctgtgtgacattactatcactcagatgctggaggaagattctaaccaggggcacctgattggtgatttttccaaggtatgtgcgctgccaaccgtgtcagggaaacaccaagatctgaagtatgtcaacccagaaacagtggctgccttactgtcggggaagttccagggtctgattgagaagttttatgtcattgattgtcgctatccatatgagtatctgggaggacacatccagggagccttaaacttatatagtcaggaagaactgtttaacttctttctgaagaagcccatcgtccctttggacacccagaagagaataatcatcgtgttccactgtgaattctcctcagagaggggcccccgaatgtgccgctgtctgcgtgaagaggacaggtctctgaaccagtatcctgcattgtactacccagagctatatatccttaaaggcggctacagagacttctttccagaatatatggaactgtgtgaaccacagagctactgccctatgcatcatcaggaccacaagactgagttgctgaggtgtcgaagccagagcaaagtgcaggaaggggagcggcagctgcgggagcagattgcccttctggtgaaggacatgagcccatgataacattccagccactggctgctaacaagtcaccaaaagacactgcagaaaccctgagcagaaagaggccttctggatggccaaacccaagattattaaaagatgtctctgcaaaccaa

SEQ ID NO: 977 - DNA, 1059 bp, Homo sapiens
agaggcgagcggggataggttactgggctggcggaaggtttgaatggtcaacgcctgcggctgttgatattcttgctcagaggccgtaactttggccttctgctcagggaagactctgagtccgacgttggcctacccagtcggaaggcagagctgcaatctagttaactacctcctttcccctagatttcctttcattctgctcaagtcttcgcctgtgtccgatccctatctactttctctcctcttgtaggcaagcctcagactccaggcttgaggttttgtttttctcctggtgagaattcgaagaccatgtctacggaactcttctcatccacaagagaggaaggaagctctggctcaggacccagttttaggtctaatcaaaggaaaatgttaaacctgctcctggagagagacacttcctttaccgtctgtccagatgtccctagaactccagtgggcaaatttcttggtgattctgcaaacctaagcattttgtctggaggaaccccaaaacgttgcctcgatctttcgaatcttagcagtggggagataactgccactcagcttaccacttctgcagaccttgatgaaactggtcacctggattcttcaggacttcaggaagtgcatttagctgggatgaatcatgaccagcacctaatgaaatgtagcccagcacagcttctttgtagcactccgaatggtttggaccgtggccatagaaagagagatgcaatgtgtagttcatctgcaaataaagaaaatgacaatggaaacttggtggacagtgaaatgaaatatttgggcagtcccattactactgttccaaaattggataaaaatccaaacctaggagaagaccaggcagaagagatttcagatgaattaatggagttttccctgaaagatcaagaagcaaaggtgagcagaagtggcctatatcgctccccgtcgatgccagagaacttgaacaggccaagactgaagcaggtggaaaaattcaaggacaacacaataccagataaagttaaaaaaaagtatttttctggccaa

SEQ ID NO: 978 - DNA, 1968 bp, Homo sapiens
gaggtgcccgccccgaggccccagcgccacctgccctccaccacctaccgcggttcctccagctcccagggccgcggccggagcagctctgagcgctcggttcgccccacggtgcccttaaaaggcgctggcgcgaaccaacgagtccctgaggagagtagggggacagctccggctcgcagaatccccccaagccacccatggagggcgcagctccgtgtcgtgtctctctcaaagtgtctctcggacagcgctgttgggaacgagcctggcgctttgatttagggatgggggtggtttcctcactaacgagtcaccccctccaaaatatcgcagaaagtggacggccccagttggaggcacatcttgaaacccgcgggggaggccatgtcggaagaaggttttgtttttctcctggtgagaattcgaagaccatgtctacggaactcttctcatccacaagagaggaaggaagctctggctcaggacccagttttaggtctaatcaaaggaaaatgttaaacctgctcctggagagagacacttcctttaccgtctgtccagatgtccctagaactccagtgggcaaatttcttggtgattctgcaaacctaagcattttgtctggaggaaccccaaaacgttgcctcgatctttcgaatcttagcagtggggagataactgccactcagcttaccacttctgcagaccttgatgaaactggtcacctggattcttcaggacttcaggaagtgcatttagctgggatgaatcatgaccagcacctaatgaaatgtagcccagcacagcttctttgtagcactccgaatggtttggaccgtggccatagaaagagagatgcaatgtgtagttcatctgcaaataaagaaaatgacaatggaaacttggtggacagtgaaatgaaatatttgggcagtcccattactactgttccaaaattggataaaaatccaaacctaggagaagaccaggcagaagagatttcagatgaattaatggagttttccctgaaagatcaagaagcaaaggtgagcagaagtggcctatatcgctccccgtcgatgccagagaacttgaacaggccaagactgaagcaggtggaaaaattcaaggacaacacaataccagataaagttaaaaaaaagtatttttctggccaaggaaagctcaggaagggcttatgtttaaagaagacagtctctctgtgtgacattactatcactcagatgctggaggaagattctaaccaggggcacctgattggtgatttttccaaggtatgtgcgctgccaaccgtgtcagggaaacaccaagatctgaagtatgtcaacccagaaacagtggctgccttactgtcggggaagttccagggtctgattgagaagttttatgtcattgattgtcgctatccatatgagtatctgggaggacacatccagggagccttaaacttatatagtcaggaagaactgtttaacttctttctgaagaagcccatcgtccctttggacacccagaagagaataatcatcgtgttccactgtgaattctcctcagagaggggcccccgaatgtgccgctgtctgcgtgaagaggacaggtctctgaaccagtatcctgcattgtactacccagagctatatatccttaaaggcggctacagagacttctttccagaatatatggaactgtgtgaaccacagagctactgccctatgcatcatcaggaccacaagactgagttgctgaggtgtcgaagccagagcaaagtgcaggaaggggagcggcagctgcgggagcagattgcccttctggtgaaggacatgagcccatgataacattccagccactggctgctaacaagtcaccaaaagacactgcagaaaccctgagcagaaagaggccttctggatggccaaacccaagattattaaaagatgtctctgc

SEQ ID NO: 979 - DNA, 1919 bp, Homo sapiens
agcgccacctgccctccaccacctaccgcggttcctccagctcccagggccgcggccggagcagctctgagcgctcggttcgccccacggtgcccttaaaaggcgctggcgcgaaccaacgagtccctgaggagagtagggggacagctccggctcgcagctccgtgtcgtgtctctctcaaagtgtctctcggacagcgctgttgggaacgagcctggcgctttgatttagggatgggggtggtttcctcactaacgagtcaccccctccaaaatatcgcagaaagtggacggccccagttggaggcacatcttgaaacccgcgggggaggccatgtcggaagaagctaggttttgtttttctcctggtgagaattcgaagaccatgtctacggaactcttctcatccacaagagaggaaggaagctctggctcaggacccagttttaggtctaatcaaaggaaaatgttaaacctgctcctggagagagacacttcctttaccgtctgtccagatgtccctagaactccagtgggcaaatttcttggtgattctgcaaacctaagcattttgtctggaggaaccccaaaacgttgcctcgatctttcgaatcttagcagtggggagataactgccactcagcttaccacttctgcagaccttgatgaaactggtcacctggattcttcaggacttcaggaagtgcatttagctgggatgaatcatgaccagcacctaatgaaatgtagcccagcacagcttctttgtagcactccgaatggtttggaccgtggccatagaaagagagatgcaatgtgtagttcatctgcaaataaagaaaatgacaatggaaacttggtggacagtgaaatgaaatatttgggcagtcccattactactgttccaaaattggataaaaatccaaacctaggagaagaccaggcagaagagatttcagatgaattaatggagttttccctgaaagatcaagaagcaaaggtgagcagaagtggcctatatcgctccccgtcgatgccagagaacttgaacaggccaagactgaagcaggtggaaaaattcaaggacaacacaataccagataaagttaaaaaaaagtatttttctggccaaggaaagctcaggaagggcttatgtttaaagaagacagtctctctgtgtgacattactatcactcagatgctggaggaagattctaaccaggggcacctgattggtgatttttccaaggtatgtgcgctgccaaccgtgtcagggaaacaccaagatctgaagtatgtcaacccagaaacagtggctgccttactgtcggggaagttccagggtctgattgagaagttttatgtcattgattgtcgctatccatatgagtatctgggaggacacatccagggagccttaaacttatatagtcaggaagaactgtttaacttctttctgaagaagcccatcgtccctttggacacccagaagagaataatcatcgtgttccactgtgaattctcctcagagaggggcccccgaatgtgccgctgtctgcgtgaagaggacaggtctctgaaccagtatcctgcattgtactacccagagctatatatccttaaaggcggctacagagacttctttccagaatatatggaactgtgtgaaccacagagctactgccctatgcatcatcaggaccacaagactgagttgctgaggtgtcgaagccagagcaaagtgcaggaaggggagcggcagctgcgggagcagattgcccttctggtgaaggacatgagcccatgataacattccagccactggctgctaacaagtcaccaaaagacactgcagaaaccctgagcagaaagaggccttctggatggccaaacccaagattattaaaagatgtctctgc

SEQ ID NO: 980 - DNA, 1442 bp, Homo sapiens
ggcaagcgccggtggggcggcggcgccagagctgctggagcgctcggggtccccgggcggcggcggcggcgcagaggaggaggcaggcggcggccccggtggctcccccccggacggtgcgcggcccggcccgtctcgcgaactcgcggtggtcgcgcggccccgcgctgctccgaccccgggcccctccgccgccgccatggctcggccgctagtgcccagctcgcagaaggcgctgctgctggagctcaaggggctgcaggaagagccggtcgagggattccgcgtgacactggtggacgagggcgatctatacaactgggaggtggccatcttcgggccccccaacacctactacgagggcggctacttcaaggcgcgcctcaagttccccatcgactacccatactctccaccagcctttcggttcctgaccaagatgtggcaccctaacatctacgagacgggggacgtgtgtatctccatcctccacccgccggtggacgacccccagagcggggagctgccctcagagaggtggaaccccacgcagaacgtcaggaccattctcctgagtgtgatctccctcctgaacgagcccaacaccttctcgcccgcaaacgtggacgcctccgtgatgtacaggaagtggaaagagagcaaggggaaggatcgggagtacacagacatcatccggaagcaggtcctggggaccaaggtggacgcggagcgtgacggcgtgaaggtgcccaccacgctggccgagtactgcgtgaagaccaaggcgccggcgcccgacgagggctcagacctcttctacgacgactactacgaggacggcgaggtggaggaggaggccgacagctgcttcggggacgatgaggatgactctggcacggaggagtcctgacaccaccagaataaacttgccgagtttacctcactagggccggacccgtggctccttagacgacagactacctcacggaggttttgtgctggtccccgtctcctctggttgtttcgttttggctttttctccctccccatgtctgttctgggttttcacgtgcttcagagaagaggggctgccccaccgccactcacgtcactcggggctcggtggacgggcccagggtgggagcggccggcccacctgtcccctcgggaggggagctgagcccgacttctaccggggtcccccagcttccggactggccgcaccccggaggagccacgggggcgctgctgggaacgtgggcggggggccgtttcctgacactaccagcctgggaggcccaggtgtagcggtccgaggggcccggtcctgcctgtcagctccaggtcctggagccacgtccagcacagagtggacggattcaccgtggccgactcttttccctgctttggtttgtttgaaatctaaataaaactactttatg

SEQ ID NO: 981 - DNA, 1452 bp, Homo sapiens
ggcagccgaggagaccccgcgcagtgctgccaacgccccggtggagaagctgaggtcatcatcagatttgaaatatttaaagtggatacaaaactatttcagcaatgcagacaattaagtgtgttgttgtgggcgatggtgctgttggtaaaacatgtctcctgatatcctacacaacaaacaaatttccatcggaatatgtaccgactgtttttgacaactatgcagtcacagttatgattggtggagaaccatatactcttggactttttgatactgcagggcaagaggattatgacagattacgaccgctgagttatccacaaacagatgtatttctagtctgtttttcagtggtctctccatcttcatttgaaaacgtgaaagaaaagtgggtgcctgagataactcaccactgtccaaagactcctttcttgcttgttgggactcaaattgatctcagagatgacccctctactattgagaaacttgccaagaacaaacagaagcctatcactccagagactgctgaaaagctggcccgtgacctgaaggctgtcaagtatgtggagtgttctgcacttacacagagaggtctgaagaatgtgtttgatgaggctatcctagctgccctcgagcctccggaaactcaacccaaaaggaagtgctgtatattctaaactgttttctccttcccttctttgctgctgcttcctgtcccactactgtagaaagatcgtttaaaaacaaaggaataaaaccatcctgtttgaaagcctctgcgtctttttactcaccaccttagagcaacctctgtattagtttttgatcaagaatgcaatatcatataaattttttgtgatcagtagtcaagttggacttgttttaacgttctgctgcttgagttgcctgatgctcagagctttttggtttggattactattgcaaaagggaacttggtctggctttaagaatgtcctcttggagaaaataacaagagttttaacacttctagatcttagttctagatggagaaagtaacacaaacatcattttactcttatgatcaattgttaattgtaattgcatgacaaaccttatggaaaaggggtgacctagtagagtgtaatggggaagggaggattcttttctggttttcctttgtgcggtgaaactttgtgttgctgttgctttggctgtctgtgctgtagtggagtatttgtcagtctggggtggggaagatattgatgtatctgctactgctttatgagttcatttgttacattatcttttaagaataacatccatttaaacagttgacttacagtttgttaatgctgagatgtaaagctgccacctttatattttcctgcttctgattttattgtgagggaaatatacaattgtggttaccttcaaattttgaaattaaaaatatacaaccgtttgtat

SEQ ID NO: 982 - DNA, 2254 bp, Homo sapiens
gtcaggtgcgtgcccctgtccggcagccgaggagaccccgcgcagtgctgccaacgccccggtggagaagctgagacggagtctcactgtgttgcccaggctggagtgcagtggcgccatcttggctcactgcagtgcgcctctgccccccgagttcaagcgattctcctgcctcaggctcctgagtagctgggactacaggtcatcatcagatttgaaatatttaaagtggatacaaaactatttcagcaatgcagacaattaagtgtgttgttgtgggcgatggtgctgttggtaaaacatgtctcctgatatcctacacaacaaacaaatttccatcggaatatgtaccgactgtttttgacaactatgcagtcacagttatgattggtggagaaccatatactcttggactttttgatactgcagggcaagaggattatgacagattacgaccgctgagttatccacaaacagatgtatttctagtctgtttttcagtggtctctccatcttcatttgaaaacgtgaaagaaaagtgggtgcctgagataactcaccactgtccaaagactcctttcttgcttgttgggactcaaattgatctcagagatgacccctctactattgagaaacttgccaagaacaaacagaagcctatcactccagagactgctgaaaagctggcccgtgacctgaaggctgtcaagtatgtggagtgttctgcacttacacagaaaggcctaaagaatgtatttgacgaagcaatattggctgccctggagcctccagaaccgaagaagagccgcaggtgtgtgctgctatgaacatctctccagagccctttctgcacagctggtgtcggcatcatactaaaagcaatgtttaaatcaaactaaagattaaaaattaaaattcgtttttgcaataatgacaaatgccctgcacctacccacatgcactcgtgtgagacaaggcccataggtatggccccccccttccccctcccagtactagttaattttgagtaattgtattgtcagaaaagtgattagtactatttttttttgttgtttcaaaaaaaaaatttttgtgtgtgtgtgttttttttttttttttttttgttgtttaaaagcaaggcatgcttgtggatgactctgtaacagactaattggaattgttgaagctgctccctggttccactctggagagtaatctgggacatcttagtgttttgttttgtttttttccctcctcttttttttgggggggagtgtgtgtggggtttgttttttagtcttgtttttttaattcattaaccagtggttagcccttaaggggaggaggacggattgattccacattccacttcctagatctagtttagaaaacatgttccccatctggtgctcttaggaaggagtatagtaaatgcctcatttaataacatactcctttttgaaagttgccttttctctccacccttgagtagatccagtatttgatgaaactcatgaaagtgggtggagcccatcttgcccctcctcttttctaggacgcactatatgtgactgtgactttcaaggacatttgtttgccatttgctgatttttttgggaagttaatttctaacttctttcactgataaatgaagaaaagtattgcacctttgaaatgcaccaaatgaattgagtttgtaattaaaaaaatttttttccctttcagtcattgtcttatatgcttagcatagatttgcagctcagtagtatatggtgttcctagaatgcagctgaagacctgttatgtagaggaaatacgaggggtggtgctagaagacagacatctgtggaatgattcacatcctctcaagttaggaggatggaggcctgcttcattaagaagctgggggtagggtgggggtggggagaacacttaacaacatggggaccagtcaggggaatccccttatttctgttttgcatatgaggaaccctagagcagccaggtgaggctctctagtttaataaaaatcatggaaagactcttaatgcagactcttcttaagtgttaatagggattttttcagcttattttggttgcagtttccaatttttaaaaatgttgaggtaatctttcccaccttcccaaacctaattcttgtagatgcattagtgttgaaccaatgctttctcatgtctcaattctttgtatatgcattcttttcagatgtattaaacaaacaaaaacccttcac

SEQ ID NO: 983 - DNA, 2148 bp, Homo sapiens
acttccgcgggcacccaactgtgcgtctcctgcgcgctgacgtcaggtgcgtgcccctgtccggcagccgaggagaccccgcgcagtgctgccaacgccccggtggagaagctgaggtcatcatcagatttgaaatatttaaagtggatacaaaactatttcagcaatgcagacaattaagtgtgttgttgtgggcgatggtgctgttggtaaaacatgtctcctgatatcctacacaacaaacaaatttccatcggaatatgtaccgactgtttttgacaactatgcagtcacagttatgattggtggagaaccatatactcttggactttttgatactgcagggcaagaggattatgacagattacgaccgctgagttatccacaaacagatgtatttctagtctgtttttcagtggtctctccatcttcatttgaaaacgtgaaagaaaagtgggtgcctgagataactcaccactgtccaaagactcctttcttgcttgttgggactcaaattgatctcagagatgacccctctactattgagaaacttgccaagaacaaacagaagcctatcactccagagactgctgaaaagctggcccgtgacctgaaggctgtcaagtatgtggagtgttctgcacttacacagaaaggcctaaagaatgtatttgacgaagcaatattggctgccctggagcctccagaaccgaagaagagccgcaggtgtgtgctgctatgaacatctctccagagccctttctgcacagctggtgtcggcatcatactaaaagcaatgtttaaatcaaactaaagattaaaaattaaaattcgtttttgcaataatgacaaatgccctgcacctacccacatgcactcgtgtgagacaaggcccataggtatggccccccccttccccctcccagtactagttaattttgagtaattgtattgtcagaaaagtgattagtactatttttttttgttgtttcaaaaaaaaaatttttgtgtgtgtgtgttttttttttttttttttttgttgtttaaaagcaaggcatgcttgtggatgactctgtaacagactaattggaattgttgaagctgctccctggttccactctggagagtaatctgggacatcttagtgttttgttttgtttttttccctcctcttttttttgggggggagtgtgtgtggggtttgttttttagtcttgtttttttaattcattaaccagtggttagcccttaaggggaggaggacggattgattccacattccacttcctagatctagtttagaaaacatgttccccatctggtgctcttaggaaggagtatagtaaatgcctcatttaataacatactcctttttgaaagttgccttttctctccacccttgagtagatccagtatttgatgaaactcatgaaagtgggtggagcccatcttgcccctcctcttttctaggacgcactatatgtgactgtgactttcaaggacatttgtttgccatttgctgatttttttgggaagttaatttctaacttctttcactgataaatgaagaaaagtattgcacctttgaaatgcaccaaatgaattgagtttgtaattaaaaaaatttttttccctttcagtcattgtcttatatgcttagcatagatttgcagctcagtagtatatggtgttcctagaatgcagctgaagacctgttatgtagaggaaatacgaggggtggtgctagaagacagacatctgtggaatgattcacatcctctcaagttaggaggatggaggcctgcttcattaagaagctgggggtagggtgggggtggggagaacacttaacaacatggggaccagtcaggggaatccccttatttctgttttgcatatgaggaaccctagagcagccaggtgaggctctctagtttaataaaaatcatggaaagactcttaatgcagactcttcttaagtgttaatagggattttttcagcttattttggttgcagtttccaatttttaaaaatgttgaggtaatctttcccaccttcccaaacctaattcttgtagatgcattagtgttgaaccaatgctttctcatgtctcaattctttgtatatgcattcttttcagatgtatt

SEQ ID NO: 984 - DNA, 597 bp, Homo sapiens
cgcggcggggcggtggcaggagggcagctcgctggctgctcgcggcggtgcctgtccgagctcccctccgcgccggccgcgtcctctgggcggggtggccccgagccacggcctccaggctgctcttcctttcggaggtcatcatcagatttgaaatatttaaagtggatacaaaactatttcagcaatgcagacaattaagtgtgttgttgtgggcgatggtgctgttggtaaaacatgtctcctgatatcctacacaacaaacaaatttccatcggaatatgtaccgactgtttttgacaactatgcagtcacagttatgattggtggagaaccatatactcttggactttttgatactgcagggcaagaggattatgacagattacgaccgctgagttatccacaaacagatgtatttctagtctgtttttcagtggtctctccatcttcatttgaaaacgtgaaagaaaagtgggtgcctgagataactcaccactgtccaaagactcctttcttgcttgttgggactcaaattgatctcagagatgacccctctactattgagaaacttgccaagaacaaacagaagcctat

SEQ ID NO: 985 - DNA, 1106 bp, Homo sapiens
agtgctgccaacgccccggtggagaagctgaggtcatcatcagatttgaaatatttaaagtggatacaaaactatttcagcaatgcagacaattaagtgtgttgttgtgggcgatggtgctgttggtaaaacatgtctcctgatatcctacacaacaaacaaatttccatcggaatatgtaccgactatcttgacttctcatgggtaaattatatacactttaaacagctgaaaaatcagtggaaagtcagaaggggtgacacagggtttgcaagaagtgctgggaggcaaaactccagtagacaagattctaacgagtggtggtctcaatttggtgaagtatgccctacatcttggaatgaggtttttgacaactatgcagtcacagttatgattggtggagaaccatatactcttggactttttgatactgcagggcaagaggattatgacagattacgaccgctgagttatccacaaacagatgtatttctagtctgtttttcagtggtctctccatcttcatttgaaaacgtgaaagaaaagtgggtgcctgagataactcaccactgtccaaagactcctttcttgcttgttgggactcaaattgatctcagagatgacccctctactattgagaaacttgccaagaacaaacagaagcctatcactccagagactgctgaaaagctggcccgtgacctgaaggctgtcaagtatgtggagtgttctgcacttacacagaaaggcctaaagaatgtatttgacgaagcaatattggctgccctggagcctccagaaccgaagaagagccgcaggtgtgtgctgctatgaacatctctccagagccctttctgcacagctggtgtcggcatcatactaaaagcaatgtttaaatcaaactaaagattaaaaattaaaattcgtttttgcaataatgacaaatgccctgcacctacccacatgcactcgtgtgagacaaggcccataggtatggccccccccttccccctcccagtactagttaattttgagtaattgtattgtcagaaaagtgattagtactatttttttttgttgtttcaaaaaaaaaatttttgtgtgtg

SEQ ID NO: 986 - DNA, 3072 bp, Homo sapiens
gctttacccagagtcgccctgccgcaatcgcgcgtctttccaccgaggccccggatgtagattccctcccccgttcagtggtcgtggcctcacagcgactctaagacttggggctctctcattggctgtaactcttccactggattggtagcaaaaaaagaggcggtgcccaaggcgaaaggctctgtgactacagccaatcagaatcgaggccgggctttggcgggaggtgggaacgctgtggccattcggatttggcgcgagcgcggctggagtttgctgctgccgctgtgcagtttgttcaggggcttgtggtggtgagtccgagaggctgcgtgtgagagacgtgagaaggatcctgcactgaggaggtggaaagaagaggattgctcgaggaggcctggggtctgtgaggcagcggagctgggtgaaggctgcgggttccggcgaggcctgagctgtgctgtcgtcatgcctcaaacccgatcccaggcacaggctacaatcagttttccaaaaaggaagctgtctcgggcattgaacaaagctaaaaactccagtgatgccaaactagaaccaacaaatgtccaaaccgtaacctgttctcctcgtgtaaaagccctgcctctcagccccaggaaacgtctgggcgatgacaacctatgcaacactccccatttacctccttgttctccaccaaagcaaggcaagaaagagaatggtccccctcactcacatacacttaagggacgaagattggtatttgacaatcagctgacaattaagtctcctagcaaaagagaactagccaaagttcaccaaaacaaaatactttcttcagttagaaaaagtcaagagatcacaacaaattctgagcagagatgtccactgaagaaagaatctgcatgtgtgagactattcaagcaagaaggcacttgctaccagcaagcaaagctggtcctgaacacagctgtcccagatcggctgcctgccagggaaagggagatggatgtcatcaggaatttcttgagggaacacatctgtgggaaaaaagctggaagcctttacctttctggtgctcctggaactggaaaaactgcctgcttaagccggattctgcaagacctcaagaaggaactgaaaggctttaaaactatcatgctgaattgcatgtccttgaggactgcccaggctgtattcccagctattgctcaggagatttgtcaggaagaggtatccaggccagctgggaaggacatgatgaggaaattggaaaaacatatgactgcagagaagggccccatgattgtgttggtattggacgagatggatcaactggacagcaaaggccaggatgtattgtacacgctatttgaatggccatggctaagcaattctcacttggtgctgattggtattgctaataccctggatctcacagatagaattctacctaggcttcaagctagagaaaaatgtaagccacagctgttgaacttcccaccttataccagaaatcagatagtcactattttgcaagatcgacttaatcaggtatctagagatcaggttctggacaatgctgcagttcaattctgtgcccgcaaagtctctgctgtttcaggagatgttcgcaaagcactggatgtttgcaggagagctattgaaattgtagagtcagatgtcaaaagccagactattctcaaaccactgtctgaatgtaaatcaccttctgagcctctgattcccaagagggttggtcttattcacatatcccaagtcatctcagaagttgatggtaacaggatgaccttgagccaagaaggagcacaagattccttccctcttcagcagaagatcttggtttgctctttgatgctcttgatcaggcagttgaaaatcaaagaggtcactctggggaagttatatgaagcctacagtaaagtctgtcgcaaacagcaggtggcggctgtggaccagtcagagtgtttgtcactttcagggctcttggaagccaggggcattttaggattaaagagaaacaaggaaacccgtttgacaaaggtgtttttcaagattgaagagaaagaaatagaacatgctctgaaagataaagctttaattggaaatatcttagctactggattgccttaaattcttctcttacaccccacccgaaagtattcagctggcatttagagagctacagtcttcattttagtgctttacacattcgggcctgaaaacaaatatgaccttttttacttgaagccaatgaattttaatctatagattctttaatattagcacagaataatatctttgggtcttactatttttacccataaaagtgaccaggtagaccctttttaattacattcactacttctaccacttgtgtatctctagccaatgtgcttgcaagtgtacagatctgtgtagaggaatgtgtgtatatttacctcttcgtttgctcaaacatgagtgggtatttttttgtttgttttttttgttgttgttgtttttgaggcgcgtctcaccctgttgcccaggctggagtgcaatggcgcgttctctgctcactacagcacccgcttcccaggttgaagtgattctcttgcctcagcctcccgagtagctgggattacaggtgcccaccaccgcgcccagctaattttttaatttttagtagagacagggttttaccatgttggccaggctggtcttgaactcctgaccctcaagtgatctgcccaccttggcctccctaagtgctgggattataggcgtgagccaccatgctcagccattaaggtattttgttaagaactttaagtttagggtaagaagaatgaaaatgatccagaaaaatgcaagcaagtccacatggagatttggaggacactggttaaagaatttatttctttgtatagtatactatgttcatggtgcagatactacaacattgtggcattttagactcgttgagtttcttgggcactcccaagggcgttggggtcataaggagactataactctacagattgtgaatatatttattttcaagttgca

SEQ ID NO: 987 - DNA, 4969 bp, Homo sapiens
cggcggcctgggtggctactgcccctgctgctgtcgtaggcgaggacggctgttagtgctgctgctgttggttcgtcgcggcggcgaaggaggaggaggaagagggcgaggcgacaagagaagaaggaggcaggcgcggcggcagcggcggcgccccgagccggcggaggcgaggggggggaagatggcggacgtgcttagcgtcctgcgacagtacaacatccagaagaaggagattgtggtgaagggagacgaagtgatcttcggggagttctcctggcccaagaatgtgaagaccaactatgttgtttgggggactggaaaggaaggccaacccagagagtactacacattggattccattttatttctacttaataacgtgcacctttctcatcctgtttatgtccgacgtgcagctactgaaaatattcctgtggttagaagacctgatcgaaaagatctacttggatatctcaatggtgaagcgtcaacatcggcaagtatagacagaagcgctcccttagaaataggtcttcagcgatctactcaagtcaaacgagctgcagatgaagttttagcagaagcaaagaaaccacgaattgaggatgaagagtgtgtgcgccttgataaagagagattggctgcccgtttggagggtcacaaagaagggattgtacagactgaacagattaggtctttgtctgaagctatgtcagtggaaaaaattgctgcaatcaaagccaaaattatggctaagaaaagatctactatcaagactgatctagatgatgacataactgcccttaaacagaggagttttgtggatgctgaggtagatgtgacccgagatattgtcagcagagagagagtatggaggacacgaacaactatcttacaaagcacaggaaagaatttttccaagaacatttttgcaattcttcaatctgtaaaagccagagaagaagggcgtgcacctgaacagcgacctgccccaaatgcagcacctgtggatcccactttgcgcaccaaacagcctatcccagctgcctataacagatacgatcaggaaagattcaaaggaaaagaagaaacggaaggcttcaaaattgacactatgggaacctaccatggtatgacactgaaatctgtaacggagggtgcatctgcccggaagactcagactcctgcagcccagccagtaccaagaccagtttctcaagcaagacctcccccaaatcagaagaaaggatctcgaacacccattatcataattcctgcagctaccacctctttaataaccatgcttaatgcaaaagaccttctacaggacctgaaatttgtcccatcagatgaaaagaagaaacaaggttgtcaacgagaaaatgaaactctaatacaaagaagaaaagaccagatgcaaccagggggcactgcaattagtgttacagtaccttatagagtagtagaccagccccttaaacttatgcctcaagactgggaccgcgttgtagccgtttttgtgcagggtcctgcatggcagttcaaaggttggccatggcttttgcctgatggatcaccagttgatatatttgctaaaattaaagccttccatctgaagtatgatgaagttcgtctggatccaaatgttcagaaatgggatgtaacagtattagaactcagctatcacaaacgtcatttggatagaccagtgttcttacggttttgggaaacattggacaggtacatggtaaagcataaatcgcacttgagattctgaattatttggctcctccatttctggaaattgagactcaagctttatgaatttatcaagaacttaaaaatgaagaaggtcacagattgatcttttataagaccttatttgatgctttgtgcttcaaggagatgatacctgtcatccatataagcaaactttttggcttacaactatttttttaatattagccttctagtctgtaatggaaattgtatattttgatagaagttttttctccattggttaaattagcattacttaaaatttgtttctttagaaaataaatgcaggttataaatgtgtgtatatttagagattataaggctctctgagccatcttctgatttttcattgctctataattctttttactgaaaatactatgttatgaatggtattaaattttagtctctggaacatccaaaaccaagcaaagggatgtgactattttgaatgaatcagaatgtcaacttgtatgtacactatatctacacttactcattatttaaaaagaataatgaaaaatctagatcaattcttcaatttgattgaactgttcagccttttcaagatttctttatttacaaatgattacatttaaatgaatgtacattcttctcactgactttggtgattttgaaacctagaatgatgtgtttctatctgtaatatctttccatttgaaaaaaatctcaaaacacagattaaaaccacaataggctgtagtattttttattttgggagccagagtatgatttgggggaagaatatgtatcagccctattgcagtataactttaagctccttttctctttagtccacttttgattgtaatttttatggtataggattttgaatcttctattttaggcttgtcagtcttggagttcttatcttccattatccctaaatattgataaactcccaggcaccaaagaaaacatttgcttaattgtctgaaaagaaacaagagaaaaacactggtatttttatgtctgtattcaatatggtataaaatataaaaactatattttaacttagtgaaatattttactatttctctacttcagacaaaatgttgcatccaaggtacatcaagtgaccatttgccttgaaccttgatttcactttgttttttttttttccttaaaggcaactaggaagctttactttcctaaagtgtttttgccattggaatttttgctgatcacagtcttatgtcatttttttctctgtttttattcccagcaattttctcctaggttaacatatttttggtgaacgtttaggcctttcataggtattaagctgacattatctagcttcttaatgaaatttaacactgtcacaaaaatgagaagttattattttttaagtgatcacatagttcataccactagtaactagaaaagatatttattcacatgatatttacaaggctcttcagaagggaacagtcagcattttaaattactagattttagcatacttaacaaggtttgaacagattctacccctattttcctccctttttagcgtcttctttccttaaagataaaagaaaactcaaatttgtttacattaggctttcttagcatataaatatatttccaaaataaattacatgttgtgtaaactttctccatgatgaaatagtcaaggaccagaatctgtaatatttttatgtaagattacttgtcaagactactacaagtcagtatgaactaccttcccataaagatttttggtatttgtacttatttatgaactttacttgagacagaatatggttaaaattaggaacatctactttgaatgaggtttatttttctattttgaatttgccttatgtatattcaaaggcttatggaaatactgtaaaggaacattaggaaaaggacaaataggctataaccatctatcttaaaatcagacccttagtataagcacctctttttcttttcctctttgacaatttagtctcttatttaggtccatgtaattaatttcattccattattttttagctgtttattctaaaaaacaaaaattttcagccactcccatttattctcccatgacatggtcctatatagcagtacttaacacagtgccttgcacatagtaggcattcagtaaatacttacatgcatgaatgaataatgtattttcagtgtaacaaatttattataaaagtgtagttcgactcttcttggtcttggagtttgagagtacagaattacagggaatgaagagaggtataagtagatattttaatggaaatgaagtataaattaataacttgacttacccctccataagttactgctaactggagatacccttgtatgcccaacctgtaaaggaaaaagttctatttctatatttataggacattcttctcagtcaaggaacagtaagaaatatgtaggtttcaatcagttgctctcaaccctgactgcattttagaatcatttggagagtttttaaaaatatccatgcctgaatcttgattcccattttcatgtaatttgagacaagacctggtcatcagtattttttttaaagttctccaggtaatttgaatgtgcaggaaggattcagaatcactggtttaatttgttattgaaaacagtaccagtattaaatgtgtttcctcttccttcttttctgtatgtatgtgtggtttttgattttttgttgttgttgttgttttgtggccaccctttgcactagaccatcccttttattggtggtattggcctatattcccattgacaaatgcaatttttaattatttatttaatataggagtattttactgtttaatatttaaacaatgtttaatgtatttcattattaactagtattatagtttgtttttttcccatgtctccataacttttactaacatttgtttttagcagcacaacagtaatccatataaaaacaactaattcataatgaggaaaatctcataatttttaaggcagaaagaagtattaatttttgatctgccatgtagaatgagacaaatacagtttgcttatgaaaggaaagtggcatacttttaaattggtctacacagaaaagtaaaagtaaactattcatttaaataagattcattatctaataaatattgagggaatatttttcctaaataaaaatttttctgactgctaacaaaaa

SEQ ID NO: 988 - DNA, 1157 bp, Homo sapiens
ggcgaaggaggaggaggaagagggcgaggcgacaagagaagaaggaggcaggcgcggcggcagcggcggcgccccgagccggcggaggcgaggggggggaagatggcggacgtgcttagcgtcctgcgacagtacaacatccagaagaaggagattgtggtgaagggagacgaagtgatcttcggggagttctcctggcccaagaatgtgaagaccaactatgttgtttgggggactggaaaggaaggccaacccagagagtactacacattggattccattttatttctacttaataacgtgcacctttctcatcctgtttatgtccgacgtgcagctactgaaaatattcctgtggttagaagacctgatcgaaaagatctacttggatatctcaatggtgaagcgtcaacatcggcaagtatagacagaagcgctcccttagaaataggtcttcagcgatctactcaagtcaaacgagctgcagatgaagttttagcagaagcaaagaaaccacgaattgaggatgaagagtgtgtgcgccttgataaagagagattggctgcccgtttggagggtcacaaagaagggattgtacagactgaacagattaggtctttgtctgaagctatgtcagtggaaaaaattgctgcaatcaaagccaaaattatggctaagaaaagatctactatcaagactgatctagatgatgacataactgcccttaaacagaggagttttgtggatgctgaggtagatgtgacccgagatattgtcagcagagagagagtatggaggacacgaacaactatcttacaaagcacaggaaagaatttttccaagaacatttttgcaattcttcaatctgtaaaagccagagaagaagggcgtgcacctgaacagcgacctgccccaaatgcagcacctgtggatcccactttgcgcaccaaacagcctatcccagctgcctataacagatacgatcaggaaaggatctcgaacacccattatcataattcctgcagctaccacctctttaataaccatgcttaatgcaaaagaccttctacaggacctgaaatttgtcccatcagatgaaaagaagaaacaaggttgtcaacgagaaaatgaaactctaatacaaagaagaaaagacc

SEQ ID NO: 989 - DNA, 2374 bp, Homo sapiens
gctcatgggactcctgcctctcctgggcttggccgctcctgtcttggcaagccccagaccctgccttggatttctttctggcctccaagtgggcgcttggctcctggcacctggcagccttggctgtctccccagccccactgtcctgcctctctgcttgggacccatgggagctgccatctccccagccccagtgctgggatgacaggcatgagccaccacacccagacgagagggcacatttccaactgcattctgaaggcctggtggtgagaaagagcatatagaggtggcacagcccatagcagagatgaggccaaggacaagaagagaatgcaggatgccgctttccacctagaagaagtttaaaacctgcggttccagggttctccagcccctccctttttcacgctccgaagccgagaaggcccaaagcgaagacagagaggacccggaagtagggaaaacctctgagcacgtgatgggggaacacgcgggtgctgtcacgtgatccgacaaacggcctctgcatagtgcagaacattctgctgctcttaaaggtacaggcctcagggtccctgctgtagacggggcgggggagagtacgatgggtggggcgtggtgggtcgtagggcgctcgagatggagcccccagcttccttgatggatcgcggggcgcgagtgccctagacaagccggagctgggaccggcaatcgggcgttgatccttgtcacctgtcgcagaccctcatccctcccgtgggagccccctttggacactctatgaccctggaccctcgggggacctgaacttgatgcgatgggaggctgtgcaggctcgcggcggcgcttttcggattccgagggggaggagaccgtcccggagccccggctccctctgttggaccatcagggcgcgcattggaagaacgcggtgggcttctggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctgctgtgctcctggcggacatcctccccacactcgtcatcaaattgttggctcctcttggccttcacctgctgccctacagcccccgggttctcgtcagtgggatttgtgctgctggaagcttcgtcctggttgccttttctcattctgtggggaccagcctgtgtggtgtggtcttcgctagcatctcatcaggccttggggaggtcaccttcctctccctcactgccttctaccccagggccgtgatctcctggtggtcctcagggactgggggagctgggctgctgggggccctgtcctacctgggcctcacccaggccggcctctcccctcagcagaccctgctgtccatgctgggtatccctgccctgctgctggccagctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagggtctgctgtggtacattgttcccttggtcgtagtttactttgccgagtatttcattaaccagggactttttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggtcagacacccaggcccaccccagagaccctccatgaactgtgctcccagccttcccggcaggtctgggagtagggaagggctgaagccttgtttcccttgcaggggggccagccattgtctcccacttggggagtttcttcctggcatcatgccttctgaataaatgccgattttatccatgga

SEQ ID NO: 990 - DNA, 1301 bp, Homo sapiens
acggcctctgcatagtgcagaacattctgctgctcttaaagaccctcatccctcccgtgggagccccctttggacactctatgaccctggaccctcgggggacctgaacttgatgcgatgggaggctgtgcaggctcgcggcggcgcttttcggattccgagggggaggagaccgtcccggagccccggctccctctgttggaccatcagggcgcgcattggaagaacgcggtgggcttctggctgctgggcctttgcaacaacttctcttatgtggtgatgctgagtgccgcccacgacatccttagccacaagaggacatcgggaaaccagagccatcccccgggttctcgtcagtgggatttgtgctgctggaagcttcgtcctggttgccttttctcattctgtggggaccagcctgtgtgctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagggtctgctgtggtacattgttcccttggtcgtagtttactttgccgagtatttcattaaccagggactttttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggtcagacacccaggcccaccccagagaccctccatgaactgtgctcccagccttcccggcaggtctgggagtagggaagggctgaagccttgtttcccttgcaggggggccagccattgtctcccacttggggagtttcttcctggcatcatgccttctgaataaatgccgattttatccatgg

SEQ ID NO: 991 - DNA, 1619 bp, Homo sapiens
acggcctctgcatagtgcagaacattctgctgctcttaaagaccctcatccctcccgtgggagccccctttggacactctatgaccctggaccctcgggggacctgaacttgatgcgatgggaggctgtgcaggctcgcggcggcgcttttcggattccgagggggaggagaccgtcccggagccccggctccctctgttggaccatcagggcgcgcattggaagaacgcggtgggcttctggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctgctgtgctcctggcggacatcctccccacactcgtcatcaaattgttggctcctcttggccttcacctgctgccctacagcccccgggttctcgtcagtgggatttgtgctgctggaagcttcgtcctggttgccttttctcattctgtggggaccagcctgtgtggtgtggtcttcgctagcatctcatcaggccttggggaggtcaccttcctctccctcactgccttctaccccagggccgtgatctcctggtggtcctcagggactgggggagctgggctgctgggggccctgtcctacctgggcctcacccaggccggcctctcccctcagcagaccctgctgtccatgctgggtatccctgccctgctgctggccagctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaaggttcggatgatggctgggtttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggtcagacacccaggcccaccccagagaccctccatgaactgtgctcccagccttcccggcaggtctgggagtagggaagggctgaagccttgtttcccttgcaggggggccagccattgtctcccacttggggagtttcttcctggcatcatgccttctgaataaatgccgattttatccatgg

SEQ ID NO: 992 - DNA, 1526 bp, Homo sapiens
acggcctctgcatagtgcagaacattctgctgctcttaaagaccctcatccctcccgtgggagccccctttggacactctatgaccctggaccctcgggggacctgaacttgatgcgatgggaggctgtgcaggctcgcggcggcgcttttcggattccgagggggaggagaccgtcccggagccccggctccctctgttggaccatcagggcgcgcattggaagaacgcggtgggcttctggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctgctgtgctcctggcggacatcctccccacactcgtcatcaaattgttggctcctcttggccttcacctgctgccctacagcccccgggttctcgtcagtgggatttgtgctgctggaagcttcgtcctggttgccttttctcattctgtggggaccagcctgtgtggtgtggtcttcgctagcatctcatcaggccttggggaggtcaccttcctctccctcactgccttctaccccagctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagggtctgctgtggtacattgttcccttggtcgtagtttactttgccgagtatttcattaaccagggactttttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggtcagacacccaggcccaccccagagaccctccatgaactgtgctcccagccttcccggcaggtctgggagtagggaagggctgaagccttgtttcccttgcaggggggccagccattgtctcccacttggggagtttcttcctggcatcatgccttctgaataaatgccgattttatccatgg

SEQ ID NO: 993 - DNA, 879 bp, Homo sapiens
acggcctctgcatagtgcagaacattctgctgctcttaaagaccctcatccctcccgtgggagccccctttggacactctatgaccctggaccctcgggggacctgaacttgatgcgatgggaggctgtgcaggctcgcggcggcgcttttcggattccgagggggaggagaccgtcccggagccccggctccctctgttggaccatcagggcgcgcattggaagaacgcggtgggcttctggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctgctgtgctcctggcggacatcctccccacactcgtcatcaaattgttggctcctcttggccttcacctgctgccctacagcccccgggttctcgtcagtgggatttgtgctgctggaagcttcgtcctggttgccttttctcattctgtggggaccagcctgtgtggctccagctccagcctctcccttcgggaaaggtggacagtgttcaagggtctgctgtggtacattgttcccttggtcgtagtttactttgccgagtatttcattaaccagggactttttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagatggagtctcgctctgttgcccaggctggaatgtag

SEQ ID NO: 994 - DNA, 1144 bp, Homo sapiens
gcgttgatccttgtcacctgtcgcagaccctcatccctcccgtgggagccccctttggacactctatgaccctggaccctcgggggacctgaacttgatgcgatgggaggctgtgcaggctcgcggcggcgcttttcggattccgagggggaggagaccgtcccggagccccggctccctctgttggaccatcagggcgcgcattggaagaacgcggtgggcttctggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctcccccgggttctcgtcagtgggatttgtgctgctggaagcttcgtcctggttgccttttctcattctgtggggaccagcctgtgtgctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagggtctgctgtggtacattgttcccttggtcgtagtttactttgccgagtatttcattaaccagggactttttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctgatactcgggatcctcaggacgca

SEQ ID NO: 995 - DNA, 1720 bp, Homo sapiens
gtccctgctgtagacggggcgggggagagtacgatgggtggggcgtggtgggtcgtagggcgctcgagatggagcccccagcttccttgatggatcgcggggcgcgagtgccctagacaagccggagctgggaccggcaatcgggcgttgatccttgtcacctgtcgcagaccctcatccctcccgtgggagccccctttggacactctatgaccctggaccctcgggggacctgaacttgatgcgatgggaggctgtgcaggctcgcggcggcgcttttcggattccgagggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctgctgtgctcctggcggacatcctccccacactcgtcatcaaattgttggctcctcttggccttcacctgctgccctacagcccccgggttctcgtcagtgggatttgtgctgctggaagcttcgtcctggttgccttttctcattctgtggggaccagcctgtgtggtgtggtcttcgctagcatctcatcaggccttggggaggtcaccttcctctccctcactgccttctaccccagggccgtgatctcctggtggtcctcagggactgggggagctgggctgctgggggccctgtcctacctgggcctcacccaggccggcctctcccctcagcagaccctgctgtccatgctgggtatccctgccctgctgctggccagctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagggtctgctgtggtacattgttcccttggtcgtagtttactttgccgagtatttcattaaccagggactttttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggtcagacacccaggcccaccccagagaccctccatgaactgtgctcccagccttcccggcaggtctgggagtagggaagggctgaagccttgtttcccttgcaggggggccagccattgtctcccacttggggagtttcttcctggcatcatgccttctgaataaatgccgattttatccatgg

SEQ ID NO: 996 - DNA, 1827 bp, Homo sapiens
gctgctcttaaaggtacaggcctcagggtccctgctgtagacggggcgggggagagtacgatgggtggggcgtggtgggtcgtagggcgctcgagatggagcccccagcttccttgatggatcgcggggcgcgagtgccctagacaagccggagctgggaccggcaatcgggcgttgatccttgtcacctgtcgcagaccctcatccctcccgtgggagccccctttggacactctatgaccctggaccctcgggggacctgaacttgatgcgatgggaggctgtgcaggctcgcggcggcgcttttcggattccgagggggaggagaccgtcccggagccccggctccctctgttggaccatcagggcgcgcattggaagaacgcggtgggcttctggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctgctgtgctcctggcggacatcctccccacactcgtcatcaaattgttggctcctcttggccttcacctgctgccctacagcccccgggttctcgtcagtgggatttgtgctgctggaagcttcgtcctggttgccttttctcattctgtggggaccagcctgtgtggtgtggtcttcgctagcatctcatcaggccttggggaggtcaccttcctctccctcactgccttctaccccagggccgtgatctcctggtggtcctcagggactgggggagctgggctgctgggggccctgtcctacctgggcctcacccaggccggcctctcccctcagcagaccctgctgtccatgctgggtatccctgccctgctgctggccagctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagggtctgctgtggtacattgttcccttggtcgtagtttactttgccgagtatttcattaaccagggactttttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggtcagacacccaggcccaccccagagaccctccatgaactgtgctcccagccttcccggcaggtctgggagtagggaagggctgaagccttgtttcccttgcaggggggccagccattgtctcccacttggggagtttcttcctggcatcatgccttctgaataaatgccgattttatccatgga

SEQ ID NO: 997 - DNA, 1913 bp, Homo sapiens
ataactggtgctggcaggctactgtctcggtcttgggcgccactgatctaaggtcacggctctgcttgctgctcccacccgctccagtttaaaacctgcggttccagggttctccagcccctccctttttcacgctccgaagccgagaaggcccaaagcgaagacagagaggacccggaagtagggaaaacctctgagcacgtgatgggggaacacgcgggtgctgtcacgtgatccgacaaacggcctctgcatagtgcagaacattctgctgctcttaaagaccctcatccctcccgtgggagccccctttggacactctatgaccctggaccctcgggggacctgaacttgatgcgatgggaggctgtgcaggctcgcggcggcgcttttcggattccgagggggaggagaccgtcccggagccccggctccctctgttggaccatcagggcgcgcattggaagaacgcggtgggcttctggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctgctgtgctcctggcggacatcctccccacactcgtcatcaaattgttggctcctcttggccttcacctgctgccctacagcccccgggttctcgtcagtgggatttgtgctgctggaagcttcgtcctggttgccttttctcattctgtggggaccagcctgtgtggtgtggtcttcgctagcatctcatcaggccttggggaggtcaccttcctctccctcactgccttctaccccagggccgtgatctcctggtggtcctcagggactgggggagctgggctgctgggggccctgtcctacctgggcctcacccaggccggcctctcccctcagcagaccctgctgtccatgctgggtatccctgccctgctgctggccagctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagggtctgctgtggtacattgttcccttggtcgtagtttactttgccgagtatttcattaaccagggactttttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggtcagacacccaggcccaccccagagaccctccatgaactgtgctcccagccttcccggcaggtctgggagtagggaagggctgaagccttgtttcccttgcaggggggccagccattgtctcccacttggggagtttcttcctggcatcatgccttctgaataaatgccgattttatccatgga

SEQ ID NO: 998 - DNA, 1577 bp, Homo sapiens
aaaggtacaggcctcagggtccctgctgtagacggggcgggggagagtacgatgggtggggcgtggtgggtcgtagggcgctcgagatggagcccccagcttccttgatggatcgcggggcgcgagtgccctagacaagccggagctgggaccggcaatcgggcgttgatccttgtcacctgtcgcagaccctcatccctcccgtgggagccccctttggacactctatgaccctggaccctcgggggacctgaacttgatgcgatgggaggctgtgcaggctcgcggcggcgcttttcggattccgagggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctcccccgggttctcgtcagtgggatttgtgctgctggaagcttcgtcctggttgccttttctcattctgtggggaccagcctgtgtggtgtggtcttcgctagcatctcatcaggccttggggaggtcaccttcctctccctcactgccttctaccccagggccgtgatctcctggtggtcctcagggactgggggagctgggctgctgggggccctgtcctacctgggcctcacccaggccggcctctcccctcagcagaccctgctgtccatgctgggtatccctgccctgctgctggccagctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagggtctgctgtggtacattgttcccttggtcgtagtttactttgccgagtatttcattaaccagggactttttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggtcagacacccaggcccaccccagagaccctccatgaactgtgctcccagccttcccggcaggtctgggagtagggaagggctgaagccttgtttcccttgca

SEQ ID NO: 999 - DNA, 1712 bp, Homo sapiens
cctcagggtccctgctgtagacggggcgggggagagtacgatgggtggggcgtggtgggtcgtagggcgctcgagatggagcccccagcttccttgatggatcgcggggcgcgagtgccctagacaagccggagctgggaccggcaatcgggcgttgatccttgtcacctgtcgcagaccctcatccctcccgtgggagccccctttggacactctatgaccctggaccctcgggggacctgaacttgatgcgatgggaggctgtgcaggctcgcggcggcgcttttcggattccgagggctgctgggcctttgcaacaacttctcttatgtggtgatgctgagtgccgcccacgacatccttagccacaagaggacatcgggaaaccagagccatgctgtgctcctggcggacatcctccccacactcgtcatcaaattgttggctcctcttggccttcacctgctgccctacagcccccgggttctcgtcagtgggatttgtgctgctggaagcttcgtcctggttgccttttctcattctgtggggaccagcctgtgtggtgtggtcttcgctagcatctcatcaggccttggggaggtcaccttcctctccctcactgccttctaccccagggccgtgatctcctggtggtcctcagggactgggggagctgggctgctgggggccctgtcctacctgggcctcacccaggccggcctctcccctcagcagaccctgctgtccatgctgggtatccctgccctgctgctggccagctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtgttcaagggtctgctgtggtacattgttcccttggtcgtagtttactttgccgagtatttcattaaccagggactttttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggttatcaatagtctggctgtctatcgtcatcgtgagactgactttggtgtaggagttcgagaccaccctggccaacatggcaaaaccccatctccacaaaaattggataatttgataattatcattattgggtttctgagacgttacacatttaacgttctcttctgcacaagttgcctttgtgtgagtatactaactttctgtagaggtatacttgtaatcacaaataagaataaattat

SEQ ID NO: 1000 - DNA, 1713 bp, Homo sapiens
gccgaggtgctcggtggagtcatggcagtgccctttgtggaagactgggacttggtgcaaaccctgggagaaggtgcctatggagaagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaatagagccagacataggcatgcctgaaccagatgctcagagattcttccatcaactcatggcaggggtggtttatctgcatggtattggaataactcacagggatattaaaccagaaaatcttctgttggatgaaagggataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggagaattgccatgggaccaacccagtgacagctgtcaggagtattctgactggaaagaaaaaaaaacatacctcaacccttggaaaaaaatcgattctgctcctctagctctgctgcataaaatcttagttgagaatccatcagcaagaattaccattccagacatcaaaaaagatagatggtacaacaaacccctcaagaaaggggcaaaaaggccccgagtcacttcaggtggtgtgtcagagtctcccagtggattttctaagcacattcaatccaatttggacttctctccagtaaacagtgcttctagtgaagaaaatgtgaagtactccagttctcagccagaaccccgcacaggtctttccttatgggataccagcccctcatacattgataaattggtacaagggatcagcttttcccagcccacatgtcctgatcatatgcttttgaatagtcagttacttggcaccccaggatcctcacaggttactatatcaacaactgataggagaaacaataaactcattttcaaagtgaatttgttagaaatggatgataaaatattggttgacttccggctttctaagggtgatggattggagttcaagagacacttcctgaagattaaagggaagctgattgatattgtgagcagccagaagatttggcttcctgccacatgatcggaccatcggctctggggaatcctggtgaatatagtgctgctatgttgacattattcttcctagagaagattatcctgtcctgcaaactgcaaatagtagttcctgaagtgttcacttccctgtttatccaaacatcttccaatttattttgtttgttcggcatacaaataatacctatatcttaattgtaagcaaaactttggggaaaggatgaatagaattcatttgattatttcttcatgtgtgtttagtatctgaatttgaaactcatctggtggaaaccaagtttcaggggacatgagttttccagcttttatacacacgtatctcatttttatcaaaacattttgtttaattcaaaaagtacatattccatgttgatttaattct

SEQ ID NO: 1001 - DNA, 1845 bp, Homo sapiens
gcatttggattcctgcagtggtgggcaaaggacagtccgccgaggtgctcggtggagtcatggcagtgccctttgtggaagactgggacttggtgcaaaccctgggagaaggtgcctatggagaagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaatagagccagacataggcatgcctgaaccagatgctcagagattcttccatcaactcatggcaggggtggtttatctgcatggtattggaataactcacagggatattaaaccagaaaatcttctgttggatgaaagggataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggagaattgccatgggaccaacccagtgacagctgtcaggagtattctgactggaaagaaaaaaaaacatacctcaacccttggaaaaaaatcgattctgctcctctagctctgctgcataaaatcttagttgagaatccatcagcaagaattaccattccagacatcaaaaaagatagatggtacaacaaacccctcaagaaaggggcaaaaaggccccgagtcacttcaggtggtgtgtcagagtctcccagtggattttctaagcacattcaatccaatttggacttctctccagtaaacagtgcttctagtgaagaaaatgtgaagtactccagttctcagccagaaccccgcacaggtctttccttatgggataccagcccctcatacattgataaattggtacaagggatcagcttttcccagcccacatgtcctgatcatatgcttttgaatagtcagttacttggcaccccaggatcctcacagaacccctggcagcggttggtcaaaagaatgacacgattctttaccaaattggatgcagacaaatcttatcaatgcctgaaagagacttgtgagaagttgggctatcaatggaagaaaagttgtatgaatcaggttactatatcaacaactgataggagaaacaataaactcattttcaaagtgaatttgttagaaatggatgataaaatattggttgacttccggctttctaagggtgatggattggagttcaagagacacttcctgaagattaaagggaagctgattgatattgtgagcagccagaagatttggcttcctgccacatgatcggaccatcggctctggggaatcctgatggagtttcactcttgtctcccaggctggagtacaatggcatgatctcagcttactgcaacctccgtctcctgggttcaagcgattctcctgcctcagccttccaagtagctgggattacaggtgcccaccaccacacctggctaggttttgtatttttagtagagatggggttttttcatgttggccaggctgatctggaactcctgacctcaagtgatccacctgccttggcctcccaaagtgctgggattttaggtgtgagccacctcgcctggcaagggattctgttcttagtccttgaaaaaataaagttctgaatcttcaa

SEQ ID NO: 1002 - DNA, 2748 bp, Homo sapiens
aaatttgcgttgtaagatttattttggctctccccgcctgttctttgcacattaaaaatgaaaaagtttgtagaactaagctaagcagatggtcttcctgcaaaaagaccgggctgaagtaaagcattgttttggagctggttcacagaaaaaaggcaaaactggttatcctgacttcaagctccaacataaactgctcgctttctccgggaaacttgccccgccacacacacttgactgcgtggccagttctttcgaagcctctcgctcccaacacggagttcctcccatttcttcacagtcggctctcagcagctgctgctggtttctcggctccagcaccacgagtaccgcactctgaggtttacaaagcactctgcttcaccgactgtgatcctcacagtcctgtccggtggcctcacgcaggtggcggtgcagcctttcaggcccagagcggccaggagcgaagcccgcagccccgcctggaagcgcagcgcggtcggtcgcgcgcccctgaggcttggaggcctgggcttcccccagcagcgctcgagcaccgcccagtcgagcctcacaccggatgccacttcatatttgggcccagagctcaattcgcgccgatgcggtccgccgtccttaaatctcttcagccaggatctctccccgactgcaaagcagccctgggcgggagcggcaacatctccacgtcacccttttggagccgccgacattcagaggggcaggacacgggaacgcgcgctgtcttgctttacggcgcgggtgcgcgagtttgcggcagcgtgacgccctcaagttttggcgggaaaagcgctgcatttggattcctgcagtggtgggcaaaggacagtccgccgaggtgctcggtggagtcatggcagtgccctttgtggaagactgggacttggtgcaaaccctgggagaaggtgcctatggagaagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaatagagccagacataggcatgcctgaaccagatgctcagagattcttccatcaactcatggcaggggtggtttatctgcatggtattggaataactcacagggatattaaaccagaaaatcttctgttggatgaaagggataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggagaattgccatgggaccaacccagtgacagctgtcaggagtattctgactggaaagaaaaaaaaacatacctcaacccttggaaaaaaatcgattctgctcctctagctctgctgcataaaatcttagttgagaatccatcagcaagaattaccattccagacatcaaaaaagatagatggtacaacaaacccctcaagaaaggggcaaaaaggccccgagtcacttcaggtggtgtgtcagagtctcccagtggattttctaagcacattcaatccaatttggacttctctccagtaaacagtgcttctagtgaagaaaatgtgaagtactccagttctcagccagaaccccgcacaggtctttccttatgggataccagcccctcatacattgataaattggtacaagggatcagcttttcccagcccacatgtcctgatcatatgcttttgaatagtcagttacttggcaccccaggatcctcacagaacccctggcagcggttggtcaaaagaatgacacgattctttaccaaattggatgcagacaaatcttatcaatgcctgaaagagacttgtgagaagttgggctatcaatggaagaaaagttgtatgaatcaggttactatatcaacaactgataggagaaacaataaactcattttcaaagtgaatttgttagaaatggatgataaaatattggttgacttccggctttctaagggtgatggattggagttcaagagacacttcctgaagattaaagggaagctgattgatattgtgagcagccagaagatttggcttcctgccacatgatcggaccatcggctctggggaatcctggtgaatatagtgctgctatgttgacattattcttcctagagaagattatcctgtcctgcaaactgcaaatagtagttcctgaagtgttcacttccctgtttatccaaacatcttccaatttattttgtttgttcggcatacaaataatacctatatcttaattgtaagcaaaactttggggaaaggatgaatagaattcatttgattatttcttcatgtgtgtttagtatctgaatttgaaactcatctggtggaaaccaagtttcaggggacatgagttttccagcttttatacacacgtatctcatttttatcaaaacattttgtttaattcaaaaagtacatattccatgttgatttaattctaagatgaaccaataaagacataattcttgtga

SEQ ID NO: 1003 - DNA, 1799 bp, Homo sapiens
gatttacacgacaaaatggtcaggtttagaatagttgttcgtggttgaaagacttggataaatgtggatgagatagaaggggaaggcaagagctgttaattttcgtgggcaatcctggggagaggcggggctcagtggcttcactggtgatcttacactctacatcttttctggattcctgccttttacagccgaggtgctcggtggagtcatggcagtgccctttgtggaagactgggacttggtgcaaaccctgggagaaggtgcctatggagaagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaatagagccagacataggcatgcctgaaccagatgctcagagattcttccatcaactcatggcaggggtggtttatctgcatggtattggaataactcacagggatattaaaccagaaaatcttctgttggatgaaagggataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggagaattgccatgggaccaacccagtgacagctgtcaggagtattctgactggaaagaaaaaaaaacatacctcaacccttggaaaaaaatcgattctgctcctctagctctgctgcataaaatcttagttgagaatccatcagcaagaattaccattccagacatcaaaaaagatagatggtacaacaaacccctcaagaaaggggcaaaaaggccccgagtcacttcaggtggtgtgtcagagtctcccagtggattttctaagcacattcaatccaatttggacttctctccagtaaacagtgcttctagtgaagaaaatgtgaagtactccagttctcagccagaaccccgcacaggtctttccttatgggataccagcccctcatacattgataaattggtacaagggatcagcttttcccagcccacatgtcctgatcatatgcttttgaatagtcagttacttggcaccccaggatcctcacagaacccctggcagcggttggtcaaaagaatgacacgattctttaccaaattggatgcagacaaatcttatcaatgcctgaaagagacttgtgagaagttgggctatcaatggaagaaaagttgtatgaatcaggttactatatcaacaactgataggagaaacaataaactcattttcaaagtgaatttgttagaaatggatgataaaatattggttgacttccggctttctaagggtgatggattggagttcaagagacacttcctgaagattaaagggaagctgattgatattgtgagcagccagaagatttggcttcctgccacatgatcggaccatcggctctggggaatcctggttgaggccttggctcctgcctgtagtcccagctacttaggaggctgagagaggaggatcgcgtgaacctggaagtttgaggctgtagtgagctatgattgcaccagtgcactccagcttggatgacaga

SEQ ID NO: 1004 - DNA, 769 bp, Homo sapiens
aggcctgggcttcccccagcagcgctcgagcaccgcccagtcgagcctcacaccggatgccacttcatatttgggcccagagctcaattcgcgccgatgcggtccgccgtccttaaatctcttcagccaggatctctccccgactgcaaagcagccctgggcgggagcggcaacatctccacgtcacccttttggagccgccgacattcagaggggcaggacacgggaacgcgcgctgtcttgctttacggcgcgggtgcgcgagtttgcggcagcgtgacgccctcaagttttggcgggaaaagcgctgcatttggattcctgcagtggtgggcaaaggacagtccgccgaggtgctcggtggagtcatggcagtgccctttgtggaagactgggacttggtgcaaaccctgggagaaggtgcctatggagaagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaatagagccagacataggcatgcctgaaccagatgctcagagattcttccatcaactcatggcaggggtggtttatctgcatggtattggaataactcacagggatattaaaccaga

SEQ ID NO: 1005 - DNA, 562 bp, Homo sapiens
acagtccggtgaggaagggcggccggtagaccgaggtgctcggtggagtcatggcagtgccctttgtggaagactgggacttggtgcaaaccctgggagaaggtgcctatggagaagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaatagagccagacataggcatgcctgaaccagatgctcagagattcttccatcaactcatggcaggggtggtttatctgcatggtattggaataactcacagggatattaaaccagaaaatcttctgttggatgaaagggataacctcaaaatctcagactttggcttggcaacagtatttcggtataataatcgtgagcgtttgttgaacaagatgtgtggtacttt

SEQ ID NO: 1006 - DNA, 661 bp, Homo sapiens
aggacagtccggtgaggaagggcggccgccgaggtgctcggtggagtcatggcagtgccctttgtggaagactgggacttggtgcaaaccctgggagaaggtgcctatggagaagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaatagagccagacataggcatgcctgaaccagatgctcagagattcttccatcaactcatggcaggggtggtttatctgcatggtattggaataactcacagggatattaaaccagaaaatcttctgttggatgaaagggataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggag

SEQ ID NO: 1007 - DNA, 570 bp, Homo sapiens
aagaaccccaaggaagagtcccagcccttcctttcgcctctgggggcagtttggccccgccccggcctttgggacgggtggggctgtggatggggatgggaattggaattgagcaattgggaggaggcgctgccgcaggcgttttctgccccataccgctccctatatcctcttcctctcttccccagacccccacctctccctcctccttccccagtcgttcgccggaaagcatttgtctcccacctcttcataacaacaattaatttcctctggggcctgaggagggcagaatttcaaccttcggtgtgcttgggagtggcgattgtgatttacacgacaaaatggtcaggtttagaatagttgttcgtggttgaaagacttggataaatgtggatgagatagaaggggaaggcaagagctccgaggtgctcggtggagtcatggcagtgccctttgtggaagactgggacttggtgcaaaccctgggagaaggtgcctatggagaagttcaacttgctgtgaatagagtaactgaagaagcagtcgcagtgaagattgtagatatga

SEQ ID NO: 1008 - DNA, 3502 bp, Homo sapiens
gcaattgggaggaggcgctgccgcaggcgttttctgccccataccgctccctatatcctcttcctctcttccccagacccccacctctccctcctccttccccagtcgttcgccggaaagcatttgtctcccacctcttcataacaacaattaatttcctctggggcctgaggagggcagaatttcaaccttcggtgtgcttgggagtggcgattgtgatttacacgacaaaatgccgaggtgctcggtggagtcatggcagtgccctttgtggaagactgggacttggtgcaaaccctgggagaaggtgcctatggagaagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaatagagccagacataggcatgcctgaaccagatgctcagagattcttccatcaactcatggcaggggtggtttatctgcatggtattggaataactcacagggatattaaaccagaaaatcttctgttggatgaaagggataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggagaattgccatgggaccaacccagtgacagctgtcaggagtattctgactggaaagaaaaaaaaacatacctcaacccttggaaaaaaatcgattctgctcctctagctctgctgcataaaatcttagttgagaatccatcagcaagaattaccattccagacatcaaaaaagatagatggtacaacaaacccctcaagaaaggggcaaaaaggccccgagtcacttcaggtggtgtgtcagagtctcccagtggattttctaagcacattcaatccaatttggacttctctccagtaaacagtgcttctagtgaagaaaatgtgaagtactccagttctcagccagaaccccgcacaggtctttccttatgggataccagcccctcatacattgataaattggtacaagggatcagcttttcccagcccacatgtcctgatcatatgcttttgaatagtcagttacttggcaccccaggatcctcacagaacccctggcagcggttggtcaaaagaatgacacgattctttaccaaattggatgcagacaaatcttatcaatgcctgaaagagacttgtgagaagttgggctatcaatggaagaaaagttgtatgaatcaggttactatatcaacaactgataggagaaacaataaactcattttcaaagtgaatttgttagaaatggatgataaaatattggttgacttccggctttctaagggtgatggattggagttcaagagacacttcctgaagattaaagggaagctgattgatattgtgagcagccagaagatttggcttcctgccacatgatcggaccatcggctctggggaatcctggtgaatatagtgctgctatgttgacattattcttcctagagaagattatcctgtcctgcaaactgcaaatagtagttcctgaagtgttcacttccctgtttatccaaacatcttccaatttattttgtttgttcggcatacaaataatacctatatcttaattgtaagcaaaactttggggaaaggatgaatagaattcatttgattatttcttcatgtgtgtttagtatctgaatttgaaactcatctggtggaaaccaagtttcaggggacatgagttttccagcttttatacacacgtatctcatttttatcaaaacattttgtttaattcaaaaagtacatattccatgttgatttaattctaagatgaaccaataaagacataattcttgtgacttttggacagtagatttatcagtctgtgaagcgaagccagcttcaaaacatatccccaagatttgtacttatattttcaaaagggcctggccagttatataaacctgtttttgaattataatgattaattaaaattgcaagtaggtgttttttccagtgtagttagtaaaatacttgtattttacagtgttgcataaactctagtgcttaactaactttactctaaaaattactgttgaacatcttaaatatttttctatattttctactttcatagccatattttaaccttttcaacttactggtgaccaagcttttaggtgataaagaataaaagagggaagggaagagtaaggaagctataagaaaaatagatctgattctttgttcctttacctgttagacttacaaaaagtttgtttttctaataaaatttgtatcaactttggggcatattaggttgaggccttggctcctgcctgtagtcccagctacttaggaggctgagagaggaggatcgcgtgaacctggaagtttgaggctgtagtgagctatgattgcaccagtgcactccagcttggatgacagagtaagaccctacctctaataaaaatttttaaaattgtaaaacattataaaattaatcagttattttaatctgaagccaagaacatgtagaatgttatgattagagtttatcacatattaatgtatactggcaaattgtgttactggagtatacccataggaggaataaattcaaacctgttttatttatttgaacctatttacggtatgcttaagaattgaatcagtataaattctcaaatatgggagaaattttgttcttgagaattatctgagtcattaatatttttcaaaaacagctctcactgacttgaacctcttctgtaagctctaaccttttacctgctttacatttccacttgaatgtctagtaggcatctcttgaccaaaaacagcttttgattcctgttctccaacctgttcctctcctagttttctccatctcagaaatgttacttcctctgcaaagtctttccctgacttatctaaaataataacctcctctgtttgctgtgggaatttgtatagaatggtgggaaaatttcaagtttcatatttggattagctctgacatttatttatctgaacactggtaattgcctcagtaaagacactgataataagtaccttttagagttattttaatctttaatgctttaatgtgtaggaagagtatagtgtcctgttttgcacagaaaggcattctgtaaataataagttgccttaattttcctgtaatgttcattatattgttgtgggaaggtatttactcctattattaaaaataaaaatgtgtaaaatt

SEQ ID NO: 1009 - DNA, 583 bp, Homo sapiens
agtccggtgaggaagggcggccgacccccacctctccctcctccttccccagtcgttcgccggaaagcatttgtctcccacctcttcataacaacaattaatttcctctggggcctgaggagggcagaatttcaaccttcggtgtgcttgggagtggcgattgtgatttacacgacaaaatgccgaggtgctcggtggagtcatggcagtgccctttgtggaagactgggacttggtgcaaaccctgggagaaggtgcctatggagaagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaatagagccagacataggcatgcctgaaccagatgctcagagattcttccatcaactcatggcaggggtggtttatctgcatggtattggaataact

SEQ ID NO: 1010 - DNA, 1568 bp, Homo sapiens
ggattcctgcagtggtgggcaaaggacagtccgccgaggtgctcggtggagtcatggcagtgccctttgtggaagactgggacttggtgcaaaccctgggagaaggtgcctatggagaagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaatagagccagacataggcatgcctgaaccagatgctcagagattcttccatcaactcatggcaggggtggtttatctgcatggtattggaataactcacagggatattaaaccagaaaatcttctgttggatgaaagggataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggagaattgccatgggaccaacccagtgacagctgtcaggagtattctgactggaaagaaaaaaaaacatacctcaacccttggaaaaaaatcgattctgctcctctagctctgctgcataaaatcttagttgagaatccatcagcaagaattaccattccagacatcaaaaaagatagatggtacaacaaacccctcaagaaaggggcaaaaaggccccgagtcacttcaggtggtgtgtcagagtctcccagtggattttctaagcacattcaatccaatttggacttctctccagtaaacagtgcttctagtgaagaaaatgtgaagtactccagttctcagccagaaccccgcacaggtctttccttatgggataccagcccctcatacattgataaattggtacaagggatcagcttttcccagcccacatgtcctgatcatatgcttttgaatagtcagttacttggcaccccaggatcctcacagaacccctggcagcggttggtcaaaagaatgacacgattctttaccaaattggatgcagacaaatcttatcaatgcctgaaagagacttgtgagaagttgggctatcaatggaagaaaagttgtatgaatcagggtgatggattggagttcaagagacacttcctgaagattaaagggaagctgattgatattgtgagcagccagaagatttggcttcctgccacatgatcggaccatcggctctggggaatcctggtgaatatagtgctgctatgttgacattattcttcctagagaagattatcctgtcctgcaaactgcaaatagtagttcctgaagtgttcacttccctgtttatccaaacatcttccaatttattttgtttgttcggcatacaaataatacctatatctt

SEQ ID NO: 1011 - DNA, 1867 bp, Homo sapiens
gtttgtatctgcaggtttagcgccactctgctggctgaggctgcggagagtgtgcggctccaggtgggctcacgcggtcgtgatgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgaatgtgtgaatgacaactactggtttgggagggacaaaagctgtgaatattgctttgatgaaccactgctgaaaagaacagataaataccgaacatacagcaagaaacactttcggattttcagggaagtgggtcctaaaaactcttacattgcatacatagaagatcacagtggcaatggaacctttgtaaatacagagcttgtagggaaaggaaaacgccgtcctttgaataacaattctgaaattgcactgtcactaagcagaaataaagtttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagtaccttcatgaaaacggtattatacaccgtgacttaaagccagagaatgttttactgtcatctcaagaagaggactgtcttataaagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaattaaaaacctgatggaacctg

SEQ ID NO: 1012 - DNA, 1771 bp, Homo sapiens
gcaggtttagcgccactctgctggctgaggctgcggagagtgtgcggctccaggtgggctcacgcggtcgtgatgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgaatgtgtgaatgacaactactggtttgggagggacaaaagctgtgaatattgctttgatgaaccactgctgaaaagaacagataaataccgaacatacagcaagaaacactttcggattttcagggaagtgggtcctaaaaactcttacattgcatacatagaagatcacagtggcaatggaacctttgtaaatacagagcttgtagggaaaggaaaacgccgtcctttgaataacaattctgaaattgcactgtcactaagcagaaataaagtttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaattaaaaacctgatggaacctgg

SEQ ID NO: 1013 - DNA, 835 bp, Homo sapiens
atgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaattaaaaacctgatggaacctgg

SEQ ID NO: 1014 - DNA, 718 bp, Homo sapiens
gcaggtttagcgccactctgctggctgaggctgcggagagtgtgcggctccaggtgggctcacgcggtcgtgatgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttggagatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaattaaaaacctgatggaacctgg

SEQ ID NO: 1015 - DNA, 1796 bp, Homo sapiens
gcaggtttagcgccactctgctggctgaggctgcggagagtgtgcggctccaggtgggctcacgcggtcgtgatgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgaatgtgtgaatgacaactactggtttgggagggacaaaagctgtgaatattgctttgatgaaccactgctgaaaagaacagataaataccgaacatacagcaagaaacactttcggattttcagggaagtgggtcctaaaaactcttacattgcatacatagaagatcacagtggcaatggaacctttgtaaatacagagcttgtagggaaaggaaaacgccgtcctttgaataacaattctgaaattgcactgtcactaagcagaaataaagtttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatgatggaagggggagagctgtttgacaaagtggtggggaataaacgcctgaaagaagctacctgcaagctctatttttaccagatgctcttggctgtgcagtaccttcatgaaaacggtattatacaccgtgacttaaagccagagaatgttttactgtcatctcaagaagaggactgtcttataaagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaattaaaaacctgatggaacctgg

SEQ ID NO: 1016 - DNA, 1585 bp, Homo sapiens
gcaggtttagcgccactctgctggctgaggctgcggagagtgtgcggctccaggtgggctcacgcggtcgtgatgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgtttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagtaccttcatgaaaacggtattatacaccgtgacttaaagccagagaatgttttactgtcatctcaagaagaggactgtcttataaagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaattaaaaacctgatggaacctgg

SEQ ID NO: 1017 - DNA, 1971 bp, Homo sapiens
atctgcaggtttagcgccactctgctggctgaggctgcggagagtgtgcggctccaggtgggctcacgcggtcgtgatgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgagacagagtctggccatgttacccaatctgatcttgaactcctgctgtcatctgatcctcctgcctcagcctcccaaagtgctgggataagaggtgtgaggcaccatccccggccagtttgcagtctaaaatgtgtgaatgacaactactggtttgggagggacaaaagctgtgaatattgctttgatgaaccactgctgaaaagaacagataaataccgaacatacagcaagaaacactttcggattttcagggaagtgggtcctaaaaactcttacattgcatacatagaagatcacagtggcaatggaacctttgtaaatacagagcttgtagggaaaggaaaacgccgtcctttgaataacaattctgaaattgcactgtcactaagcagaaataaagtttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagtaccttcatgaaaacggtattatacaccgtgacttaaagccagagaatgttttactgtcatctcaagaagaggactgtcttataaagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaatt

SEQ ID NO: 1018 - DNA, 1545 bp, Homo sapiens
atgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgaatgtgtgaatgacaactactggtttgggagggacaaaagctgtgaatattgctttgatgaaccactgctgaaaagaacagataaataccgaacatacagcaagaaacactttcggattttcagggaagtgggtcctaaaaactcttacattgcatacatagaagatcacagtggcaatggaacctttgtaaatacagagcttgtagggaaaggaaaacgccgtcctttgaataacaattctgaaattgcactgtcactaagcagaaataaagtttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtga

SEQ ID NO: 1019 - DNA, 1359 bp, Homo sapiens
atgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgtttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagtaccttcatgaaaacggtattatacaccgtgacttaaagccagagaatgttttactgtcatctcaagaagaggactgtcttataaagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtga

SEQ ID NO: 1020 - DNA, 1785 bp, Homo sapiens
atgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgaatgtgtgaatgacaactactggtttgggagggacaaaagctgtgaatattgctttgatgaaccactgctgaaaagaacagataaataccgaacatacagcaagaaacactttcggattttcagggaagtgggtcctaaaaactcttacattgcatacatagaagatcacagtggcaatggaacctttgtaaatacagagcttgtagggaaaggaaaacgccgtcctttgaataacaattctgaaattgcactgtcactaagcagaaataaagtttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagtaccttcatgaaaacggtattatacaccgtgacttaaagccagagaatgttttactgtcatctcaagaagaggactgtcttataaagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaattaaaaacctgatggaacctg

SEQ ID NO: 1021 - DNA, 1959 bp, Homo sapiens
ggagagtgtgcggctccaggtgggctcacgcgatactggatttcaccatggtgcccaggctggtcttgaattcctgggctcaagcaatctacctgcgttggcctcccaaagtgctgggattacagacatgaaccaccacacctggcagaacctttgtatcttgaaagctgtgtaaatacaatcagtgtcgtgatgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgaatgtgtgaatgacaactactggtttgggagggacaaaagctgtgaatattgctttgatgaaccactgctgaaaagaacagataaataccgaacatacagcaagaaacactttcggattttcagggaagtgggtcctaaaaactcttacattgcatacatagaagatcacagtggcaatggaacctttgtaaatacagagcttgtagggaaaggaaaacgccgtcctttgaataacaattctgaaattgcactgtcactaagcagaaataaagtttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagtaccttcatgaaaacggtattatacaccgtgacttaaagccagagaatgttttactgtcatctcaagaagaggactgtcttataaagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaatta

SEQ ID NO: 1022 - DNA, 2560 bp, Homo sapiens
cttccgccagccagatccgtcctcccctctcgcaggccagacctcgacgtgtctctcgcccgggcccgtttcccgaaaccgtcgctcgtaccagtccataaggctgaagtagtctcgagtggggtcaggtgcctgcagcgctcggcactgtgggcagaagaacctgtcctcccgcccggggccccatgggccgccgcagttccaacagcggggataattgcttcccgcctgcgacgcagcatcgcagcttagcggtctccttctgggaacccctgtcggccaaaacccccacacccggagcaaagccccggctctcccccgccacatctggccggcggcctatctagccgtggtcactcgtggggaaaagcaaagagagcgtctaaccagactaatgttgctgattggctggggagtcgagggggcgggatcacccgaggggaacccgggttctaagttccgctctcccttctaaactacaactcccaggaggcattgaggcggcgcctgacggccacatctgctgctcctcattggtccggcggcaggggagggggttttgattggctgagggtggagtttgtatctgcaggtttagcgccactctgctggctgaggctgcggagagtgtgcggctccaggtgggctcacgcggtcgtgatgtctcgggagtcggatgttgaggctcagcagtctcatggcagcagtgcctgttcacagccccatggcagcgttacccagtcccaaggctcctcctcacagtcccagggcatatccagctcctctaccagcacgatgccaaactccagccagtcctctcactccagctctgggacactgagctccttagagacagtgtccactcaggaactctattctattcctgaggaccaagaacctgaggaccaagaacctgaggagcctacccctgccccctgggctcgattatgggcccttcaggatggatttgccaatcttgaatgtgtgaatgacaactactggtttgggagggacaaaagctgtgaatattgctttgatgaaccactgctgaaaagaacagataaataccgaacatacagcaagaaacactttcggattttcagggaagtgggtcctaaaaactcttacattgcatacatagaagatcacagtggcaatggaacctttgtaaatacagagcttgtagggaaaggaaaacgccgtcctttgaataacaattctgaaattgcactgtcactaagcagaaataaagagaaaatacttaaaatctactctctcagctgattttcaaaaatacggcggggcgcggtggctcacgtctttaatcccagcactttgggaggccgaggctggcagatcacctgagtttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagtaccttcatgaaaacggtattatacaccgtgacttaaagccagagaatgttttactgtcatctcaagaagaggactgtcttataaagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtgaactccgtggtttgaacacgaaagaaatgtaccttctttcactctgtcatctttcttttctttgagtctgtttttttatagtttgtattttaattatgggaataattgctttttcacagtcactgatgtacaattaaaaacctgatggaacctgg

SEQ ID NO: 1023 - DNA, 2560 bp, Homo sapiens; identical to SEQ ID NO: 1022

SEQ ID NO: 1024 - DNA, 795 bp, Homo sapiens
agagaggctgagaccaacccagaaaccaccacctctcacgccaaagctcacaccttcagcctccaacatgaaggtctccgcagcacttctgtggctgctgctcatagcagctgccttcagcccccaggggctcgctgggccagcttctgtcccaaccacctgctgctttaacctggccaataggaagataccccttcagcgactagagagctacaggagaatcaccagtggcaaatgtccccagaaagctgtgatcttcaagaccaaactggccaaggatatctgtgccgaccccaagaagaagtgggtgcaggattccatgaagtatctggaccaaaaatctccaactccaaagccataaataatcaccatttttgaaaccaaaccagagcctgagtgttgcctaatttgttttcccttcttacaatgcattctgaggtaacctcattatcagtccaaagggcatgggttttattatatatatatatttttttttttaaaaaaaaaacgtattgcatttaatttattgaggctttaaaacttatcctccatgaatatcagttatttttaaactgtaaagctttgtgcagattctttaccccctgggagccccaattcgatcccctgtcacgtgtgggcaatgttccccctctcctctcttcctccctggaatcttgtaaaggtcctggcaaagatgatcagtatgaaaatgtcattgttcttgtgaacccaaagtgtgactcattaaatggaagtaaatgttgttttaggaatacataaagtatgtgcatattt

SEQ ID NO: 1025 - DNA, 732 bp, Homo sapiens
agactaacccagaaacatccaattctcaaactgaagctcgcactctcgcctccagcatgaaagtctctgccgcccttctgtgcctgctgctcatagcagccaccttcattccccaagggctcgctcagccagatgcaatcaatgccccagtcacctgctgttataacttcaccaataggaagatctcagtgcagaggctcgcgagctatagaagaatcaccagcagcaagtgtcccaaagaagctgtgatcttcaagaccattgtggccaaggagatctgtgctgaccccaagcagaagtgggttcaggattccatggaccacctggacaagcaaacccaaactccgaagacttgaacactcactccacaacccaagaatctgcagctaacttattttcccctagctttccccagacaccctgttttattttattataatgaattttgtttgttgatgtgaaacattatgccttaagtaatgttaattcttatttaagttattgatgttttaagtttatctttcatggtactagtgttttttagatacagagacttggggaaattgcttttcctcttgaaccacagttctacccctgggatgttttgagggtctttgcaagaatcattaatacaaagaattttttttaacattccaatgcattgctaaaatattattgtggaaatgaatattttgtaactattacaccaaataaatatatttttgtacaaaa

SEQ ID NO: 1026 - DNA, 778 bp, Homo sapiens
aaggacacgggcagcagacagtggtcagtcctttcttggctctgctgacactcgagcccacattccgtcacctgctcagaatcatgcaggtctccactgctgcccttgctgtcctcctctgcaccatggctctctgcaaccagttctctgcatcacttgctgctgacacgccgaccgcctgctgcttcagctacacctcccggcagattccacagaatttcatagctgactactttgagacgagcagccagtgctccaagcccggtgtcatcttcctaaccaagcgaagccggcaggtctgtgctgaccccagtgaggagtgggtccagaaatatgtcagcgacctggagctgagtgcctgaggggtccagaagcttcgaggcccagcgacctcggtgggcccagtggggaggagcaggagcctgagccttgggaacatgcgtgtgacctccacagctacctcttctatggactggttgttgccaaacagccacactgtgggactcttcttaacttaaattttaatttatttatactatttagtttttgtaatttattttcgatttcacagtgtgtttgtgattgtttgctctgagagttcccctgtcccctcccccttccctcacaccgcgtctggtgacaaccgagtggctgtcatcagcctgtgtaggcagtcatggcaccaaagccaccagactgacaaatgtgtatcggatgcttttgttcagggctgtgatcggcctggggaaataataaagatgctcttttaaaaggtaaa

SEQ ID NO: 1027 - DNA, 1352 bp, Homo sapiens
atttcagttttcttttccgttttgtgcaatttcacttatgataccggccaatgcttggttgctattttggaaactccccttaggggatgcccctcaactggccctataaagggccagcctgagctgcagaggattcctgcagaggatcaagacagcacgtggacctcgcacagcctctcccacaggtaccatgaaggtctccgcggcagccctcgctgtcatcctcattgctactgccctctgcgctcctgcatctgcctccccatattcctcggacaccacaccctgctgctttgcctacattgcccgcccactgccccgtgcccacatcaaggagtatttctacaccagtggcaagtgctccaacccagcagtcgtctttgtcacccgaaagaaccgccaagtgtgtgccaacccagagaagaaatgggttcgggagtacatcaactctttggagatgagctaggatggagagtccttgaacctgaacttacacaaatttgcctgtttctgcttgctcttgtcctagcttgggaggcttcccctcactatcctaccccacccgctccttgaagggcccagattctaccacacagcagcagttacaaaaaccttccccaggctggacgtggtggctcacgcctgtaatcccagcactttgggaggccaaggtgggtggatcacttgaggtcaggagttcgagaccagcctggccaacatgatgaaaccccatctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaatacaaaaattagccgggcgtggtggcccacgcctgtaatcccagctactcgggaggctaaggcaggaaaattgtttgaacccaggaggtggaggctgcagtgagctgagattgtgccacttcactccagcctgggtgacaaagtgagactccgtcacaacaacaacaacaaaaagcttccccaactaaagcctagaagagcttctgaggcgctgctttgtcaaaaggaagtctctaggttctgagctctggctttgccttggctttgccagggctctgtgaccaggaaggaagtcagcatgcctctagaggcaaggaggggaggaacactgcactcttaagcttccgccgtctcaacccctcacaggagcttactggcaaacatgaaaaatcggcttaccattaaagttctcaatgcaaccataaa

SEQ ID NO: 1028 - DNA, 1244 bp, Homo sapiens
tggatgagggaaaggaggtaagatctgtaatgaataagcaggaactttgaagactcagtgactcacctctcccacaggtaccatgaaggtctccgcggcagccctcgctgtcatcctcattgctactgccctctgcgctcctgcatctgcctccccatattcctcggacaccacaccctgctgctttgcctacattgcccgcccactgccccgtgcccacatcaaggagtatttctacaccagtggcaagtgctccaacccagcagtcgtctttgtcacccgaaagaaccgccaagtgtgtgccaacccagagaagaaatgggttcgggagtacatcaactctttggagatgagctaggatggagagtccttgaacctgaacttacacaaatttgcctgtttctgcttgctcttgtcctagcttgggaggcttcccctcactatcctaccccacccgctccttgaagggcccagattctaccacacagcagcagttacaaaaaccttccccaggctggacgtggtggctcacgcctgtaatcccagcactttgggaggccaaggtgggtggatcacttgaggtcaggagttcgagaccagcctggccaacatgatgaaaccccatctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaatacaaaaattagccgggcgtggtggcccacgcctgtaatcccagctactcgggaggctaaggcaggaaaattgtttgaacccaggaggtggaggctgcagtgagctgagattgtgccacttcactccagcctgggtgacaaagtgagactccgtcacaacaacaacaacaaaaagcttccccaactaaagcctagaagagcttctgaggcgctgctttgtcaaaaggaagtctctaggttctgagctctggctttgccttggctttgccagggctctgtgaccaggaaggaagtcagcatgcctctagaggcaaggaggggaggaacactgcactcttaagcttccgccgtctcaacccctcacaggagcttactggcaaacatgaaaaatcggcttaccattaaagttctcaatgcaaccataaa

SEQ ID NO: 1029 - DNA, 804 bp, Homo sapiens
agcagaggggctgagaccaaaccagaaacctccaattctcatgtggaagcccatgccctcaccctccaacatgaaagcctctgcagcacttctgtgtctgctgctcacagcagctgctttcagcccccaggggcttgctcagccagttgggattaatacttcaactacctgctgctacagatttatcaataagaaaatccctaagcagaggctggagagctacagaaggaccaccagtagccactgtccccgggaagctgtaatcttcaagaccaaactggacaaggagatctgtgctgaccccacacagaagtgggtccaggactttatgaagcacctggacaagaaaacccaaactccaaagctttgaacattcatgactgaactgaaaacaagccatgacttgagaaacaaataatttgtataccctgtcctttctcagagtggttctgagattattttaatctaattctaaggaatatgagctttatgtaataatgtgaatcatggtttttcttagtagattttaaaagttattaatattttaatttaatcttccatggattttggtgggttttgaacataaagccttggatgtatatgtcatctcagtgctgtaaaaactgtgggatgctcctcccttctctacctcatgggggtattgtataagtccttgcaagaatcagtgcaaagatttgctttaattgttaagatatgatgtccctatggaagcatattgttattatataattacatatttgcatatgtatgactcccaaattttcacataaaatagatttttgt

SEQ ID NO: 1030 - DNA, 810 bp, Homo sapiens
agcagaggggctgagaccaaaccagaaacctccaattctcatgtggaagcccatgccctcaccctccaacatgaaagcctctgcagcacttctgtgtctgctgctcacagcagctgctttcagcccccaggggcttgctcagccagttgggattaatacttcaactacctgctgctacagatttatcaataagaaaatccctaagcagaggctggagagctacagaaggaccaccagtagccactgtccccgggaagctgtaatcttcaagaccaaactggacaaggagatctgtgctgaccccacacagaagtgggtccaggactttatgaagcacctggacaagaaaacccaaactccaaagctttgaacattcatgactgaactgaaaacaagccatgacttgagaaacaaataatttgtataccctgtcctttctcagagtggttctgagattattttaatctaattctaaggaatatgagctttatgtaataatgtgaatcatggtttttcttagtagattttaaaagttattaatattttaatttaatcttccatggattttggtgggttttgaacataaagccttggatgtatatgtcatctcagtgctgtaaaaactgtgggatgctcctcccttctctacctcatgggggtattgtataagtccttgcaagaatcagtgcaaagatttgctttaattgttaagatatgatgtccctatggaagcatattgttattatataattacatatttgcatatgtatgactcccaaattttcacataaaatagatttttgtataaca

SEQ ID NO: 1031 - DNA, 696 bp, Homo sapiens
agaggggctgagaccaaaccagaaacctccaattctcatgtggaagcccatgccctcaccctccaacatgaaagcctctgcagcacttctgtgtctgctgctcacagcagctgctttcagcccccaggggcttgctcagccagaaagacccaggacacaccctcaatggacttttcttcttgttgtttcattgcagttgggattaatacttcaactacctgctgctacagatttatcaataagaaaatccctaagcagaggctggagagctacagaaggaccaccagtagccactgtccccgggaagctgtaatcttcaagaccaaactggacaaggagatctgtgctgaccccacacagaagtgggtccaggactttatgaagcacctggacaagaaaacccaaactccaaagctttgaacattcatgactgaactgaaaacaagccatgacttgagaaacaaataatttgtataccctgtcctttctcagagtggttctgagattattttaatctaattctaaggaatatgagctttatgtaataatgtgaatcatggtttttcttagtagattttaaaagttattaatattttaatttaatcttccatggattttggtgggttttgaacataaagccttggatgtatatgtcatctcagtgctgtaaaaactgtgggatgctcctcccttctc

SEQ ID NO: 1032 - DNA, 687 bp, Homo sapiens
agaggggctgagaccaaaccagaaacctccaattctcatgtggaagcccatgccctcaccctccaacatgaaagcctctgcagcacttctgtgtctgctgctcacagcagctgctttcagcccccaggggcttgctcagccagcttcaagaccaaactggacaaggagatctgtgctgaccccacacagaagtgggtccaggactttatgaagcacctggacaagaaaacccaaactccaaagctttgaacattcatgactgaactgaaaacaagccatgacttgagaaacaaataatttgtataccctgtcctttctcagagtggttctgagattattttaatctaattctaaggaatatgagctttatgtaataatgtgaatcatggtttttcttagtagattttaaaagttattaatattttaatttaatcttccatggattttggtgggttttgaacataaagccttggatgtatatgtcatctcagtgctgtaaaaactgtgggatgctcctcccttctctacctcatgggggtattgtataagtccttgcaagaatcagtgcaaagatttgctttaattgttaagatatgatgtccctatggaagcatattgttattatataattacatatttgcatatgtatgactcccaaattttcacataaaatagatttttgtataa

SEQ ID NO: 1033 - DNA, 1173 bp, Homo sapiens
gagacattcctcaattgcttagacatattctgagcctacagcagaggaacctccagtctcagcaccatgaatcaaactgccattctgatttgctgccttatctttctgactctaagtggcattcaaggagtacctctctctagaactgtacgctgtacctgcatcagcattagtaatcaacctgttaatccaaggtctttagaaaaacttgaaattattcctgcaagccaattttgtccacgtgttgagatcattgctacaatgaaaaagaagggtgagaagagatgtctgaatccagaatcgaaggccatcaagaatttactgaaagcagttagcaaggaaaggtctaaaagatctccttaaaaccagaggggagcaaaatcgatgcagtgcttccaaggatggaccacacagaggctgcctctcccatcacttccctacatggagtatatgtcaagccataattgttcttagtttgcagttacactaaaaggtgaccaatgatggtcaccaaatcagctgctactactcctgtaggaaggttaatgttcatcatcctaagctattcagtaataactctaccctggcactataatgtaagctctactgaggtgctatgttcttagtggatgttctgaccctgcttcaaatatttccctcacctttcccatcttccaagggtactaaggaatctttctgctttggggtttatcagaattctcagaatctcaaataactaaaaggtatgcaatcaaatctgctttttaaagaatgctctttacttcatggacttccactgccatcctcccaaggggcccaaattctttcagtggctacctacatacaattccaaacacatacaggaaggtagaaatatctgaaaatgtatgtgtaagtattcttatttaatgaaagactgtacaaagtagaagtcttagatgtatatatttcctatattgttttcagtgtacatggaataacatgtaattaagtactatgtatcaatgagtaacaggaaaattttaaaaatacagatagatatatgctctgcatgttacataagataaatgtgctgaatggttttcaaaataaaaatgaggtactctcctggaaatattaagaaagactatctaaatgttgaaagatcaaaaggttaataaagtaattataact

SEQ ID NO: 1034 - DNA, 1857 bp, Homo sapiens
actttcactctccgtcagccgcattgcccgctcggcgtccggcccccgacccgcgctcgtccgcccgcccgcccgcccgcccgcgccatgaacgccaaggtcgtggtcgtgctggtcctcgtgctgaccgcgctctgcctcagcgacgggaagcccgtcagcctgagctacagatgcccatgccgattcttcgaaagccatgttgccagagccaacgtcaagcatctcaaaattctcaacactccaaactgtgcccttcagattgtagcccggctgaagaacaacaacagacaagtgtgcattgacccgaagctaaagtggattcaggagtacctggagaaagctttaaacaagtaagcacaacagccaaaaaggactttccgctagacccactcgaggaaaactaaaaccttgtgagagatgaaagggcaaagacgtgggggagggggccttaaccatgaggaccaggtgtgtgtgtggggtgggcacattgatctgggatcgggcctgaggtttgccagcatttagaccctgcatttatagcatacggtatgatattgcagcttatattcatccatgccctgtacctgtgcacgttggaacttttattactggggtttttctaagaaagaaattgtattatcaacagcattttcaagcagttagttccttcatgatcatcacaatcatcatcattctcattctcattttttaaatcaacgagtacttcaagatctgaatttggcttgtttggagcatctcctctgctcccctggggagtctgggcacagtcaggtggtggcttaacagggagctggaaaaagtgtcctttcttcagacactgaggctcccgcagcagcgcccctcccaagaggaaggcctctgtggcactcagataccgactggggctgggcgccgccactgccttcacctcctctttcaacctcagtgattggctctgtgggctccatgtagaagccactattactgggactgtgctcagagacccctctcccagctattcctactctctccccgactccgagagcatgcttaatcttgcttctgcttctcatttctgtagcctgatcagcgccgcaccagccgggaagagggtgattgctggggctcgtgccctgcatccctctcctcccagggcctgccccacagctcgggccctctgtgagatccgtctttggcctcctccagaatggagctggccctctcctggggatgtgtaatggtccccctgcttacccgcaaaagacaagtctttacagaatcaaatgcaattttaaatctgagagctcgctttgagtgactgggttttgtgattgcctctgaagcctatgtatgccatggaggcactaacaaactctgaggtttccgaaatcagaagcgaaaaaatcagtgaataaaccatcatcttgccactaccccctcctgaagccacagcagggtttcaggttccaatcagaactgttggcaaggtgacatttccatgcataaatgcgatccacagaaggtcctggtggtatttgtaactttttgcaaggcatttttttatatatatttttgtgcacatttttttttacgtttctttagaaaacaaatgtatttcaaaatatatttatagtcgaacaattcatatatttgaagtggagccatatgaatgtcagtagtttatacttctctattatctcaaactactggcaatttgtaaagaaatatatatgatatataaatgtgattgcagcttttcaatgttagccacagtgtattttttcacttgtactaaaattgtatcaaatgtgacattatatgcactagcaataaaatgctaattgtttcatggta

SEQ ID NO: 1035 - DNA, 470 bp, Homo sapiens
cccgcgctcgtccgcccgcccgcccgcccgcccgcgccatgaacgccaaggtcgtggtcgtgctggtcctcgtgctgaccgcgctctgcctcagcgacgggaagcccgtcagcctgagctacagatgcccatgccgattcttcgaaagccatgttgccagagccaacgtcaagcatctcaaaattctcaacactccaaactgtgcccttcagattgtagcccggctgaagaacaacaacagacaagtgtgcattgacccgaagctaaagtggattcaggagtacctggagaaagctttaaacaaggggcgcagagaagaaaaagtggggaaaaaagaaaagataggaaaaaagaagcgacagaagaagagaaaggctgcccagaaaaggaaaaactagttatctgccacctcgagatggaccacagttcacttgctctcggcgctttgtaaatttgctcgatcctcctcc

SEQ ID NO: 1036 - DNA, 3532 bp, Homo sapiens
actttcactctccgtcagccgcattgcccgctcggcgtccggcccccgacccgcgctcgtccgcccgcccgcccgcccgcccgcgccatgaacgccaaggtcgtggtcgtgctggtcctcgtgctgaccgcgctctgcctcagcgacgggaagcccgtcagcctgagctacagatgcccatgccgattcttcgaaagccatgttgccagagccaacgtcaagcatctcaaaattctcaacactccaaactgtgcccttcagattgtagcccggctgaagaacaacaacagacaagtgtgcattgacccgaagctaaagtggattcaggagtacctggagaaagctttaaacaagaggttcaagatgtgagagggtcagacgcctgaggaacccttacagtaggagcccagctctgaaaccagtgttagggaagggcctgccacagcctcccctgccagggcagggccccaggcattgccaagggctttgttttgcacactttgccatattttcaccatttgattatgtagcaaaatacatgacatttatttttcatttagtttgattattcagtgtcactggcgacacgtagcagcttagactaaggccattattgtacttgccttattagagtgtctttccacggagccactcctctgactcagggctcctgggttttgtattctctgagctgtgcaggtggggagactgggctgagggagcctggccccatggtcagccctagggtggagagccaccaagagggacgcctgggggtgccaggaccagtcaacctgggcaaagcctagtgaaggcttctctctgtgggatgggatggtggagggccacatgggaggctcacccccttctccatccacatgggagccgggtctgcctcttctgggagggcagcagggctaccctgagctgaggcagcagtgtgaggccagggcagagtgagacccagccctcatcccgagcacctccacatcctccacgttctgctcatcattctctgtctcatccatcatcatgtgtgtccacgactgtctccatggccctgcaaaaggactctcaggaccaaagctttcatgtaaactgtgcaccaagcaggaaatgaaaatgtcttgtgttacctgaaaacactgtgcacatctgtgtcttgtttggaatattgtccattgtccaatcctatgtttttgttcaaagccagcgtcctcctctgtgaccaatgtcttgatgcatgcactgttccccctgtgcagccgctgagcgaggagatgctccttgggccctttgagtgcagtcctgatcagagccgtggtcctttggggtgaactaccttggttcccccactgatcacaaaaacatggtgggtccatgggcagagcccaagggaattcggtgtgcaccagggttgaccccagaggattgctgccccatcagtgctccctcacatgtcagtaccttcaaactagggccaagcccagcactgcttgaggaaaacaagcattcacaacttgtttttggtttttaaaacccagtccacaaaataaccaatcctggacatgaagattctttcccaattcacatctaacctcatcttcttcaccatttggcaatgccatcatctcctgccttcctcctgggccctctctgctctgcgtgtcacctgtgcttcgggcccttcccacaggacatttctctaagagaacaatgtgctatgtgaagagtaagtcaacctgcctgacatttggagtgttccccttccactgagggcagtcgatagagctgtattaagccacttaaaatgttcacttttgacaaaggcaagcacttgtgggtttttgttttgtttttcattcagtcttacgaatacttttgccctttgattaaagactccagttaaaaaaaattttaatgaagaaagtggaaaacaaggaagtcaaagcaaggaaactatgtaacatgtaggaagtaggaagtaaattatagtgatgtaatcttgaattgtaactgttcttgaatttaataatctgtagggtaattagtaacatgtgttaagtattttcataagtatttcaaattggagcttcatggcagaaggcaaacccatcaacaaaaattgtcccttaaacaaaaattaaaatcctcaatccagctatgttatattgaaaaaatagagcctgagggatctttactagttataaagatacagaactctttcaaaaccttttgaaattaacctctcactataccagtataattgagttttcagtggggcagtcattatccaggtaatccaagatattttaaaatctgtcacgtagaacttggatgtacctgcccccaatccatgaaccaagaccattgaattcttggttgaggaaacaaacatgaccctaaatcttgactacagtcaggaaaggaatcatttctatttctcctccatgggagaaaatagataagagtagaaactgcagggaaaattatttgcataacaattcctctactaacaatcagctccttcctggagactgcccagctaaagcaatatgcatttaaatacagtcttccatttgcaagggaaaagtctcttgtaatccgaatctctttttgctttcgaactgctagtcaagtgcgtccacgagctgtttactagggatccctcatctgtccctccgggacctggtgctgcctctacctgacactcccttgggctccctgtaacctcttcagaggccctcgctgccagctctgtatcaggacccagaggaaggggccagaggctcgttgactggctgtgtgttgggattgagtctgtgccacgtgtttgtgctgtggtgtgtccccctctgtccaggcactgagataccagcgaggaggctccagagggcactctgcttgttattagagattacctcctgagaaaaaaggttccgcttggagcagaggggctgaatagcagaaggttgcacctcccccaaccttagatgttctaagtctttccattggatctcattggacccttccatggtgtgatcgtctgactggtgttatcaccgtgggctccctgactgggagttgatcgcctttcccaggtgctacacccttttccagctggatgagaatttgagtgctctgatccctctacagagcttccctgactcattctgaaggagccccattcctgggaaatattccctagaaacttccaaatcccctaagcagaccactgataaaaccatgtagaaaatttgttattttgcaacctcgctggactctcagtctctgagcagtgaatgattcagtgttaaatgtgatgaatactgtattttgtattgtttcaattgcatctcccagataatgtgaaaatggtccaggagaaggccaattcctatacgcagcgtgctttaaaaaataaataagaaacaactctttgagaaacaacaatttctactttgaagtcataccaatgaaaaaatgtatatgcacttataattttcctaataaagttctgtactcaaatgta

SEQ ID NO: 1037 - DNA, 1052 bp, Homo sapiens
ccccgacccgcgctcgtccgcccgcccgcccgcccgcccgcgccatgaacgccaaggtcgtggtcgtgctggtcctcgtgctgaccgcgctctgcctcagcgacgggaagcccgtcagcctgagctacagatgcccatgccgattcttcgaaagccatgttgccagagccaacgtcaagcatctcaaaattctcaacactccaaactgtgcccttcagattgtagcccggctgaagaacaacaacagacaagtgtgcattgacccgaagctaaagtggattcaggagtacctggagaaagctttaaacaacctgatcagcgccgcaccagccgggaagagggtgattgctggggctcgtgccctgcatccctctcctcccagggcctgccccacagctcgggccctctgtgagatccgtctttggcctcctccagaatggagctggccctctcctggggatgtgtaatggtccccctgcttacccgcaaaagacaagtctttacagaatcaaatgcaattttaaatctgagagctcgctttgagtgactgggttttgtgattgcctctgaagcctatgtatgccatggaggcactaacaaactctgaggtttccgaaatcagaagcgaaaaaatcagtgaataaaccatcatcttgccactaccccctcctgaagccacagcagggtttcaggttccaatcagaactgttggcaaggtgacatttccatgcataaatgcgatccacagaaggtcctggtggtatttgtaactttttgcaaggcatttttttatatatatttttgtgcacatttttttttacgtttctttagaaaacaaatgtatttcaaaatatatttatagtcgaacaattcatatatttgaagtggagccatatgaatgtcagtagtttatacttctctattatctcaaactactggcaatttgtaaagaaatatatatgatatataaatgtgattgcagcttttcaatgttagccacagtgtattttttcacttgtactaaaattgtatcaaatgtgacattatatgca

SEQ ID NO: 1038 - DNA, 618 bp, Homo sapiens
ccccgacccgcgctcgtccgcccgcccgcccgcccgcccgcgccatgaacgccaaggtcgtggtcgtgctggtcctcgtgctgaccgcgctctgcctcagcgacgggaagcccgtcagcctgagctacagatgcccatgccgattcttcgaaagccatgttgccagagccaacgtcaagcatctcaaaattctcaacactccaaactgtgcccttcagattgtagcccggctgaagaacaacaacagacaagtgtgcattgacccgaagctaaagtggattcaggagtacctggagaaagctttaaacaattgctagaatatggctgtacggcaatgctgagacatcacgctgagcgagagtggacatcctcattttattcctacccttaccgtggatctctcctgtgcttcaccactcagtataatgctggctgagctcttctgacaaataccttccaagatgtgaggaaaacacacgtaggtgcagttgttgaattgtatgatctgccactgaagtaattagtgtgataattacttggattttctcctttaacaaattattgttataaattatattaatatatgtcatgctaataaattatttccatattcctagg

SEQ ID NO: 1039 - DNA, 1203 bp, Homo sapiens
gagaagatgtttgaaaaaactgactctgctaatgagcctggactcagagctcaagtctgaactctacctccagacagaatgaagttcatctcgacatctctgcttctcatgctgctggtcagcagcctctctccagtccaaggtgttctggaggtctattacacaagcttgaggtgtagatgtgtccaagagagctcagtctttatccctagacgcttcattgatcgaattcaaatcttgccccgtgggaatggttgtccaagaaaagaaatcatagtctggaagaagaacaagtcaattgtgtgtgtggaccctcaagctgaatggatacaaagaatgatggaagtattgagaaaaagaagttcttcaactctaccagttccagtgtttaagagaaagattccctgatgctgatatttccactaagaacacctgcattcttcccttatccctgctctggattttagttttgtgcttagttaaatcttttccaggaaaaagaacttccccatacaaataagcatgagactatgtaaaaataaccttgcagaagctgatggggcaaactcaagcttcttcactcacagcaccctatatacacttggagtttgcattcttattcatcagggaggaaagtttctttgaaaatagttattcagttataagtaatacaggattattttgattatatacttgttgtttaatgtttaaaatttcttagaaaacaatggaatgagaatttaagcctcaaatttgaacatgtggcttgaattaagaagaaaattatggcatatattaaaagcaggcttctatgaaagactcaaaaagctgcctgggaggcagatggaacttgagcctgtcaagaggcaaaggaatccatgtagtagatatcctctgcttaaaaactcactacggaggagaattaagtcctacttttaaagaatttctttataaaatttactgtctaagattaatagcattcgaagatccccagacttcatagaatactcagggaaagcatttaaagggtgatgtacacatgtatcctttcacacatttgccttgacaaacttctttcactcacatctttttcactgactttttttgtggggggcggggccggggggactctggtatctaattctttaatgattcctataaatctaatgacattcaataaagttgagcaaacattttacttaa

SEQ ID NO: 1040 - DNA, 1718 bp, Homo sapiens
aggcagctcctcccagccacccaccccaccaattcccatcctcccgcccccctccaccaaccccttctttccacactgccccctgagttcagggaatttccccagcatcccaaagcttgagtttcctgccagtcgggagggatgaatgcagataaagggagtgcagaaggcacgaggaaaccaaagtgctctgtatcctccagtctccgcgcctccacccagctcaggaacccgcgaaccctctcttgaccactatgagcctcccgtccagccgcgcggcccgtgtcccgggtccttcgggctccttgtgcgcgctgctcgcgctgctgctcctgctgacgccgccggggcccctcgccagcgctggtcctgtctctgctgtgctgacagagctgcgttgcacttgtttacgcgttacgctgagagtaaaccccaaaacgattggtaaactgcaggtgttccccgcaggcccgcagtgctccaaggtggaagtggtagcctccctgaagaacgggaagcaagtttgtctggacccggaagccccttttctaaagaaagtcatccagaaaattttggacagtggaaacaagaaaaactgagtaacaaaaaagaccatgcatcataaaattgcccagtcttcagcggagcagttttctggagatccctggacccagtaagaataagaaggaagggttggtttttttccattttctacatggattccctactttgaagagtgtgggggaaagcctacgcttctccctgaagtttacagctcagctaatgaagtactaatatagtatttccactatttactgttattttacctgataagttattgaaccctttggcaattgaccatattgtgagcaaagaatcactggttattagtctttcaatgaatattgaattgaagataactattgtatttctatcatacattccttaaagtcttaccgaaaaggctgtggatttcgtatggaaataatgttttattagtgtgctgttgagggaggtatcctgttgttcttactcactcttctcataaaataggaaatattttagttctgtttcttggggaatatgttactctttaccctaggatgctatttaagttgtactgtattagaacactgggtgtgtcataccgttatctgtgcagaatatatttccttattcagaatttctaaaaatttaagttctgtaagggctaatatattctcttcctatggttttagacgtttgatgtcttcttagtatggcataatgtcatgatttactcattaaactttgattttgtatgctattttttcactataggatgactataattctggtcactaaatatacactttagatagatgaagaagcccaaaaacagataaattcctgattgctaatttacatagaaatgtattctcttggttttttaaataaaagcaaaattaacaatgatctgtgctctgaaagttttgaaaatatatttgaacaatttgaatataaattcatcatttagtcctcaaaatatatatagcattgctaagattttcagatatctattgtggatcttttaaaggttttgaccattttgttatgaggaattatacatgtatcacattcactatattaaaattgcacttttattttttcctgtgtgtcatgttggtttttggtacttgtattgtcatttggagaaacaataaaagatttctaaacca

SEQ ID NO: 1041 - DNA, 2740 bp, Homo sapiens
atccaatacaggagtgacttggaactccattctatcactatgaagaaaagtggtgttcttttcctcttgggcatcatcttgctggttctgattggagtgcaaggaaccccagtagtgagaaagggtcgctgttcctgcatcagcaccaaccaagggactatccacctacaatccttgaaagaccttaaacaatttgccccaagcccttcctgcgagaaaattgaaatcattgctacactgaagaatggagttcaaacatgtctaaacccagattcagcagatgtgaaggaactgattaaaaagtgggagaaacaggtcagccaaaagaaaaagcaaaagaatgggaaaaaacatcaaaaaaagaaagttctgaaagttcgaaaatctcaacgttctcgtcaaaagaagactacataagagaccacttcaccaataagtattctgtgttaaaaatgttctattttaattataccgctatcattccaaaggaggatggcatataatacaaaggcttattaatttgactagaaaatttaaaacattactctgaaattgtaactaaagttagaaagttgattttaagaatccaaacgttaagaattgttaaaggctatgattgtctttgttcttctaccacccaccagttgaatttcatcatgcttaaggccatgattttagcaatacccatgtctacacagatgttcacccaaccacatcccactcacaacagctgcctggaagagcagccctaggcttccacgtactgcagcctccagagagtatctgaggcacatgtcagcaagtcctaagcctgttagcatgctggtgagccaagcagtttgaaattgagctggacctcaccaagctgctgtggccatcaacctctgtatttgaatcagcctacaggcctcacacacaatgtgtctgagagattcatgctgattgttattgggtatcaccactggagatcaccagtgtgtggctttcagagcctcctttctggctttggaagccatgtgattccatcttgcccgctcaggctgaccactttatttctttttgttcccctttgcttcattcaagtcagctcttctccatcctaccacaatgcagtgcctttcttctctccagtgcacctgtcatatgctctgatttatctgagtcaactcctttctcatcttgtccccaacaccccacagaagtgctttcttctcccaattcatcctcactcagtccagcttagttcaagtcctgcctcttaaataaacctttttggacacacaaattatcttaaaactcctgtttcacttggttcagtaccacatgggtgaacactcaatggttaactaattcttgggtgtttatcctatctctccaaccagattgtcagctccttgagggcaagagccacagtatatttccctgtttcttccacagtgcctaataatactgtggaactaggttttaataattttttaattgatgttgttatgggcaggatggcaaccagaccattgtctcagagcaggtgctggctctttcctggctactccatgttggctagcctctggtaacctcttacttattatcttcaggacactcactacagggaccagggatgatgcaacatccttgtctttttatgacaggatgtttgctcagcttctccaacaataagaagcacgtggtaaaacacttgcggatattctggactgtttttaaaaaatatacagtttaccgaaaatcatataatcttacaatgaaaaggactttatagatcagccagtgaccaaccttttcccaaccatacaaaaattccttttcccgaaggaaaagggctttctcaataagcctcagctttctaagatctaacaagatagccaccgagatccttatcgaaactcattttaggcaaatatgagttttattgtccgtttacttgtttcagagtttgtattgtgattatcaattaccacaccatctcccatgaagaaagggaacggtgaagtactaagcgctagaggaagcagccaagtcggttagtggaagcatgattggtgcccagttagcctctgcaggatgtggaaacctccttccaggggaggttcagtgaattgtgtaggagaggttgtctgtggccagaatttaaacctatactcactttcccaaattgaatcactgctcacactgctgatgatttagagtgctgtccggtggagatcccacccgaacgtcttatctaatcatgaaactccctagttccttcatgtaacttccctgaaaaatctaagtgtttcataaatttgagagtctgtgacccacttaccttgcatctcacaggtagacagtatataactaacaaccaaagactacatattgtcactgacacacacgttataatcatttatcatatatatacatacatgcatacactctcaaagcaaataatttttcacttcaaaacagtattgacttgtataccttgtaatttgaaatattttctttgttaaaatagaatggtatcaataaatagaccattaatcagaaaacagatcttgattttttttctcttgaatgtacccttcaactgttgaatgtttaatagtaaatcttatatgtccttatttactttttagctttctctcaaataaagtgtaacactagttgagataacacatgaaagctctttaaagggtcgatcgggaacaggaaaaaaaacctatggaaaatatgacaacac

SEQ ID NO: 1042 - DNA, 2879 bp, Homo sapiens
aggaagtgcaggttcaaaacattcagagacagaaggtggatagacaaatctccaccttcagactggtaggctcctccagaagccatcagacaggaagatgtgaaaatccccagcactcatcccagaatcactaagtggcacctgtcctgggccaaagtcccaggacagacctcattgttcctctgtgggaatacctccccaggagggcatcctggatttcccccttgcaacccaggtcagaagtttcatcgtcaaggttgtttcatcttttttttcctgtctaacagctctgactaccacccaaccttgaggcacagtgaagacatcggtggccactccaataacagcaggtcacagctgctcttctggaggtgtcctacaggtgaaaagcccagcgacccagtcaggatttaagtttacctcaaaaatggaagattttaacatggagagtgacagctttgaagatttctggaaaggtgaagatcttagtaattacagttacagctctaccctgcccccttttctactagatgccgccccatgtgaaccagaatccctggaaatcaacaagtattttgtggtcattatctatgccctggtattcctgctgagcctgctgggaaactccctcgtgatgctggtcatcttatacagcagggtcggccgctccgtcactgatgtctacctgctgaacctagccttggccgacctactctttgccctgaccttgcccatctgggccgcctccaaggtgaatggctggatttttggcacattcctgtgcaaggtggtctcactcctgaaggaagtcaacttctatagtggcatcctgctactggcctgcatcagtgtggaccgttacctggccattgtccatgccacacgcacactgacccagaagcgctacttggtcaaattcatatgtctcagcatctggggtctgtccttgctcctggccctgcctgtcttacttttccgaaggaccgtctactcatccaatgttagcccagcctgctatgaggacatgggcaacaatacagcaaactggcggatgctgttacggatcctgccccagtcctttggcttcatcgtgccactgctgatcatgctgttctgctacggattcaccctgcgtacgctgtttaaggcccacatggggcagaagcaccgggccatgcgggtcatctttgctgtcgtcctcatcttcctgctctgctggctgccctacaacctggtcctgctggcagacaccctcatgaggacccaggtgatccaggagacctgtgagcgccgcaatcacatcgaccgggctctggatgccaccgagattctgggcatccttcacagctgcctcaaccccctcatctacgccttcattggccagaagtttcgccatggactcctcaagattctagctatacatggcttgatcagcaaggactccctgcccaaagacagcaggccttcctttgttggctcttcttcagggcacacttccactactctctaagacctcctgcctaagtgcagccccgtggggttcctcccttctcttcacagtcacattccaagcctcatgtccactggttcttcttggtctcagtgtcaatgcagcccccattgtggtcacaggaagtagaggaggccacgttcttactagtttcccttgcatggtttagaaagcttgccctggtgcctcaccccttgccataattactatgtcatttgctggagctctgcccatcctgcccctgagcccatggcactctatgttctaagaagtgaaaatctacactccagtgagacagctctgcatactcattaggatggctagtatcaaaagaaagaaaatcaggctggccaacggggtgaaaccctgtctctactaaaaatacaaaaaaaaaaaaaaattagccgggcgtggtggtgagtgcctgtaatcacagctacttgggaggctgagatgggagaatcacttgaacccgggaggcagaggttgcagtgagccgagattgtgcccctgcactccagcctgagcgacagtgagactctgtctcagtccatgaagatgtagaggagaaactggaactctcgagcgttgctgggggggattgtaaaatggtgtgaccactgcagaagacagtatggcagctttcctcaaaacttcagacatagaattaacacatgatcctgcaattccacttataggaattgacccacaagaaatgaaagcagggacttgaacccatatttgtacaccaatattcatagcagcttattcacaagacccaaaaggcagaagcaacccaaatgttcatcaatgaatgaatgaatggctaagcaaaatgtgatatgtacctaacgaagtatccttcagcctgaaagaggaatgaagtactcatacatgttacaacacggacgaaccttgaaaactttatgctaagtgaaataagccagacatcaacagataaatagtttatgattccacctacatgaggtactgagagtgaacaaatttacagagacagaaagcagaacagtgattaccagggactgaggggaggggagcatgggaagtgacggtttaatgggcacagggtttatgtttaggatgttgaaaaagttctgcagataaacagtagtgatagttgtaccgcaatgtgacttaatgccactaaattgacacttaaaaatggtttaaatggtcaattttgttatgtatattttatatcaatttaaaaaaaaacctgagccccaaaaggtattttaatcaccaaggctgattaaaccaaggctagaaccacctgcctatattttttgttaaatgatttcattcaatatcttttttttaataaaccatttttacttgggtgtttata

SEQ ID NO: 1043 - DNA, 585 bp, Homo sapiens
gcagtgtctttgttgagcagcagaggggagctctgactaccacccaaccttgaggcacagtgaagacatcggtggccactccaataacagcaggtcacagctgctcttctggaggtgtcctacaggtgaaaagcccagcgacccagtcaggatttaagtttacctcaaaaatggaagattttaacatggagagtgacagctttgaagatttctggaaaggtgaagatcttagtaattacagttacagctctaccctgcccccttttctactagatgccgccccatgtgaaccagaatccctggaaatcaacaagtattttgtggtcattatctatgccctggtattcctgctgagcctgctgggaaactccctcgtgatgctggtcatcttatacagcagggtcggccgctccgtcactgatgtctacctgctgaacctagccttggccgacctactctttgccctgaccttgcccatctgggccgcctccaaggtgaatggctggatttttggcacattcctgtgcaaggtggtctcactcctgaaggaagtcaacttctatagtggcatcctgctactggcct

SEQ ID NO: 1044 - DNA, 223 bp, Homo sapiens
gacctggttctccttgctgagttctctaccttctgtcctgacttgcatgctctccctctggaacctgaagctgacccataatgcctgggagcatgagctcacccatacacctccagcccacccccagcacagctgagcactggattatccacagtcaggatttaagtttacctcaaaaatggaagattttaacatggagagtgacagctttgaagatttctgg

SEQ ID NO: 1045 - DNA, 621 bp, Homo sapiens
gttctcaccaccacctccctttcataggtcacagctgctcttctggaggtgtcctacaggtgaaaagcccagcgacccagtcaggatttaagtttacctcaaaaatggaagattttaacatggagagtgacagctttgaagatttctggaaaggtgaagatcttagtaattacagttacagctctaccctgcccccttttctactagatgccgccccatgtgaaccagaatccctggaaatcaacaagtattttgtggtcattatctatgccctggtattcctgctgagcctgctgggaaactccctcgtgatgctggtcatcttatacagcagggtcggccgctccgtcactgatgtctacctgctgaacctagccttggccgacctactctttgccctgaccttgcccatctgggccgcctccaaggtgaatggctggatttttggcacattcctgtgcaaggtggtctcactcctgaaggaagtcaacttctatagtggcatcctgctactggcctgcatcagtgtggaccgttacctggccattgtccatgccacacgcacactgacccagaagcgctacttggtcaaattcatatgtctcagcatctggggtctgt

SEQ ID NO: 1046 - DNA, 262 bp, Homo sapiens
ggggaggtgaggaagtggagagagcagctgtggtggctgaagggtgctaggacagagggagcatgataaagccataactctgactaccacccaaccttgaggcacagtgaagacatcggtggccactccaataacagcaggtcacagctgctcttctggaggtgtcctacaggtgaaaagcccagcgacccagtcaggatttaagtttacctcaaaaatggaagattttaacatggagagtgacagctttgaagatttctgg

SEQ ID NO: 1047 - DNA, 813 bp, Homo sapiens
taagcagtggtgatagctgagaatatgcagccgttttctccttcctgggtacagtgctattctgcctagagctctgactaccacccaaccttgaggcacagtgaagacatcggtggccactccaataacagcaggtcacagctgctcttctggaggtgtcctacaggtgaaaagcccagcgacccagtcaggatttaagtttacctcaaaaatggaagattttaacatggagagtgacagctttgaagatttctggaaaggtgaagatcttagtaattacagttacagctctaccctgcccccttttctactagatgccgccccatgtgaaccagaatccctggaaatcaacaagtattttgtggtcattatctatgccctggtattcctgctgagcctgctgggaaactccctcgtgatgctggtcatcttatacagcagggtcggccgctccgtcactgatgtctacctgctgaacctagccttggccgacctactctttgccctgaccttgcccatctgggccgcctccaaggtgaatggctggatttttggcacattcctgtgcaaggtggtctcactcctgaaggaagtcaacttctatagtggcatcctgctactggcctgcatcagtgtggaccgttacctggccattgtccatgccacacgcacactgacccagaagcgctacttggtcaaattcatatgtctcagcatctggggtctgtccttgctcctggccctgcctgtcttacttttccgaaggaccgtctactcatccaatgttagcccagcctgctatgaggacatggg

SEQ ID NO: 1048 - DNA, 597 bp, Homo sapiens
aaaacattcagagacagaaggtggatagacaaatctccaccttcagactgctctgactaccacccaaccttgaggcacagtgaagacatcggtggccactccaataacagcaggtcacagctgctcttctggaggtgtcctacaggtgaaaagcccagcgacccagtcaggatttaagtttacctcaaaaatggaagattttaacatggagagtgacagctttgaagatttctggaaaggtgaagatcttagtaattacagttacagctctaccctgcccccttttctactagatgccgccccatgtgaaccagaatccctggaaatcaacaagtattttgtggtcattatctatgccctggtattcctgctgagcctgctgggaaactccctcgtgatgctggtcatcttatacagcagggtcggccgctccgtcactgatgtctacctgctgaacctagccttggccgacctactctttgccctgaccttgcccatctgggccgcctccaaggtgaatggctggatttttggcacattcctgtgcaaggtggtctcactcctgaaggaagtcaacttctatagtggcatcctgct

SEQ ID NO: 1049 - DNA, 1682 bp, Homo sapiens
cgcggccagaaacttcagtttgttggctgcggcagcaggtagcaaagtgacgccgagggcctgagtgctccagtagccaccgcatctggagaaccagcggttaccatggaggggatcagtatatacacttcagataactacaccgaggaaatgggctcaggggactatgactccatgaaggaaccctgtttccgtgaagaaaatgctaatttcaataaaatcttcctgcccaccatctactccatcatcttcttaactggcattgtgggcaatggattggtcatcctggtcatgggttaccagaagaaactgagaagcatgacggacaagtacaggctgcacctgtcagtggccgacctcctctttgtcatcacgcttcccttctgggcagttgatgccgtggcaaactggtactttgggaacttcctatgcaaggcagtccatgtcatctacacagtcaacctctacagcagtgtcctcatcctggccttcatcagtctggaccgctacctggccatcgtccacgccaccaacagtcagaggccaaggaagctgttggctgaaaaggtggtctatgttggcgtctggatccctgccctcctgctgactattcccgacttcatctttgccaacgtcagtgaggcagatgacagatatatctgtgaccgcttctaccccaatgacttgtgggtggttgtgttccagtttcagcacatcatggttggccttatcctgcctggtattgtcatcctgtcctgctattgcattatcatctccaagctgtcacactccaagggccaccagaagcgcaaggccctcaagaccacagtcatcctcatcctggctttcttcgcctgttggctgccttactacattgggatcagcatcgactccttcatcctcctggaaatcatcaagcaagggtgtgagtttgagaacactgtgcacaagtggatttccatcaccgaggccctagctttcttccactgttgtctgaaccccatcctctatgctttccttggagccaaatttaaaacctctgcccagcacgcactcacctctgtgagcagagggtccagcctcaagatcctctccaaaggaaagcgaggtggacattcatctgtttccactgagtctgagtcttcaagttttcactccagctaacacagatgtaaaagacttttttttatacgataaataacttttttttaagttacacatttttcagatataaaagactgaccaatattgtacagtttttattgcttgttggatttttgtcttgtgtttctttagtttttgtgaagtttaattgacttatttatataaattttttttgtttcatattgatgtgtgtctaggcaggacctgtggccaagttcttagttgctgtatgtctcgtggtaggactgtagaaaagggaactgaacattccagagcgtgtagtgaatcacgtaaagctagaaatgatccccagctgtttatgcatagataatctctccattcccgtggaacgtttttcctgttcttaagacgtgattttgctgtagaagatggcacttataaccaaagcccaaagtggtatagaaatgctggtttttcagttttcaggagtgggttgatttcagcacctacagtgtacagtcttgtattaagttgttaataaaagtacatgttaaact

SEQ ID NO: 1050 - DNA, 1895 bp, Homo sapiens
ttttttttcttccctctagtgggcggggcagaggagttagccaagatgtgactttgaaaccctcagcgtctcagtgcccttttgttctaaacaaagaattttgtaattggttctaccaaagaaggatataatgaagtcactatgggaaaagatggggaggagagttgtaggattctacattaattctcttgtgcccttagcccactacttcagaatttcctgaagaaagcaagcctgaattggttttttaaattgctttaaaaattttttttaactgggttaatgcttgctgaattggaagtgaatgtccattcctttgcctcttttgcagatatacacttcagataactacaccgaggaaatgggctcaggggactatgactccatgaaggaaccctgtttccgtgaagaaaatgctaatttcaataaaatcttcctgcccaccatctactccatcatcttcttaactggcattgtgggcaatggattggtcatcctggtcatgggttaccagaagaaactgagaagcatgacggacaagtacaggctgcacctgtcagtggccgacctcctctttgtcatcacgcttcccttctgggcagttgatgccgtggcaaactggtactttgggaacttcctatgcaaggcagtccatgtcatctacacagtcaacctctacagcagtgtcctcatcctggccttcatcagtctggaccgctacctggccatcgtccacgccaccaacagtcagaggccaaggaagctgttggctgaaaaggtggtctatgttggcgtctggatccctgccctcctgctgactattcccgacttcatctttgccaacgtcagtgaggcagatgacagatatatctgtgaccgcttctaccccaatgacttgtgggtggttgtgttccagtttcagcacatcatggttggccttatcctgcctggtattgtcatcctgtcctgctattgcattatcatctccaagctgtcacactccaagggccaccagaagcgcaaggccctcaagaccacagtcatcctcatcctggctttcttcgcctgttggctgccttactacattgggatcagcatcgactccttcatcctcctggaaatcatcaagcaagggtgtgagtttgagaacactgtgcacaagtggatttccatcaccgaggccctagctttcttccactgttgtctgaaccccatcctctatgctttccttggagccaaatttaaaacctctgcccagcacgcactcacctctgtgagcagagggtccagcctcaagatcctctccaaaggaaagcgaggtggacattcatctgtttccactgagtctgagtcttcaagttttcactccagctaacacagatgtaaaagacttttttttatacgataaataacttttttttaagttacacatttttcagatataaaagactgaccaatattgtacagtttttattgcttgttggatttttgtcttgtgtttctttagtttttgtgaagtttaattgacttatttatataaattttttttgtttcatattgatgtgtgtctaggcaggacctgtggccaagttcttagttgctgtatgtctcgtggtaggactgtagaaaagggaactgaacattccagagcgtgtagtgaatcacgtaaagctagaaatgatccccagctgtttatgcatagataatctctccattcccgtggaacgtttttcctgttcttaagacgtgattttgctgtagaagatggcacttataaccaaagcccaaagtggtatagaaatgctggtttttcagttttcaggagtgggttgatttcagcacctacagtgtacagtcttgtattaagttgttaataaaagtacatgttaaactta

SEQ ID NO: 1051 - DNA, 1347 bp, Homo sapiens
agtttgttggctgcggcagcaggtagcaaagtgacgccgagggcctgagtgctccagtagccaccgcatctggagaaccagcggttaccatggaggggatcagtatatacacttcagataactacaccgaggaaatgggctcaggggactatgactccatgaaggaaccctgtttccgtgaagaaaatgctaatttcaataaaatcttcctgcccaccatctactccatcatcttcttaactggcattgtgggcaatggattggtcatcctggtcatgggttaccagaagaaactgagaagcatgacggacaagtacaggctgcacctgtcagtggccgacctcctctttgtcatcacgcttcccttctgggcagttgatgccgtggcaaactggtactttgggaacttcctatgcaaggcagtccatgtcatctacacagtcaacctctacagcagtgtcctcatcctggatccctgccctcctgctgactattcccgacttcatctttgccaacgtcagtgaggcagatgacagatatatctgtgaccgcttctaccccaatgacttgtgggtggttgtgttccagtttcagcacatcatggttggccttatcctgcctggtattgtcatcctgtcctgctattgcattatcatctccaagctgtcacactccaagggccaccagaagcgcaaggccctcaagaccacagtcatcctcatcctggctttcttcgcctgttggctgccttactacattgggatcagcatcgactccttcatcctcctggaaatcatcaagcaagggtgtgagtttgagaacactgtgcacaagtggatttccatcaccgaggccctagctttcttccactgttgtctgaaccccatcctctatgctttccttggagccaaatttaaaacctctgcccagcacgcactcacctctgtgagcagagggtccagcctcaagatcctctccaaaggaaagcgaggtggacattcatctgtttccactgagtctgagtcttcaagttttcactccagctaacacagatgtaaaagacttttttttatacgataaataacttttttttaagttacacatttttcagatataaaagactgaccaatattgtacagtttttattgcttgttggatttttgtcttgtgtttctttagtttttgtgaagtttaattgacttatttatataaattttttttgtttcatattgatgtgtgtctaggcaggacctgtggccaagttcttagttgctgtatgtctcgtggtaggactgtagaaaagggaactgaacattccagagcgtgtagtgaatcacgtaaagctag

SEQ ID NO: 1052 - DNA, 4025 bp, Homo sapiens
tcccagatggatccaccccagacttttcaaagaagacacctccttcatcttgtgttctaaaaccttgcaagttcaggaagaaaccatctgcatccatattgaaaacctgacacaatgtatgcagcaggctcagtgtgagtgaactggaggcttctctacaacatgacccaaaggagcattgcaggtcctatttgcaacctgaagtttgtgactctcctggttgccttaagttcagaactcccattcctgggagctggagtacagcttcaagacaatgggtataatggattgctcattgcaattaatcctcaggtacctgagaatcagaacctcatctcaaacattaaggaaatgataactgaagcttcattttacctatttaatgctaccaagagaagagtatttttcagaaatataaagattttaatacctgccacatggaaagctaataataacagcaaaataaaacaagaatcatatgaaaaggcaaatgtcatagtgactgactggtatggggcacatggagatgatccatacaccctacaatacagagggtgtggaaaagagggaaaatacattcatttcacacctaatttcctactgaatgataacttaacagctggctacggatcacgaggccgagtgtttgtccatgaatgggcccacctccgttggggtgtgttcgatgagtataacaatgacaaacctttctacataaatgggcaaaatcaaattaaagtgacaaggtgttcatctgacatcacaggcatttttgtgtgtgaaaaaggtccttgcccccaagaaaactgtattattagtaagctttttaaagaaggatgcacctttatctacaatagcacccaaaatgcaactgcatcaataatgttcatgcaaagtttatcttctgtggttgaattttgtaatgcaagtacccacaaccaagaagcaccaaacctacagaaccagatgtgcagcctcagaagtgcatgggatgtaatcacagactctgctgactttcaccacagctttcccatgaatgggactgagcttccacctcctcccacattctcgcttgtacaggctggtgacaaagtggtctgtttagtgctggatgtgtccagcaagatggcagaggctgacagactccttcaactacaacaagccgcagaattttatttgatgcagattgttgaaattcataccttcgtgggcattgccagtttcgacagcaaaggagagatcagagcccagctacaccaaattaacagcaatgatgatcgaaagttgctggtttcatatctgcccaccactgtatcagctaaaacagacatcagcatttgttcagggcttaagaaaggatttgaggtggttgaaaaactgaatggaaaagcttatggctctgtgatgatattagtgaccagcggagatgataagcttcttggcaattgcttacccactgtgctcagcagtggttcaacaattcactccattgccctgggttcatctgcagccccaaatctggaggaattatcacgtcttacaggaggtttaaagttctttgttccagatatatcaaactccaatagcatgattgatgctttcagtagaatttcctctggaactggagacattttccagcaacatattcagcttgaaagtacaggtgaaaatgtcaaacctcaccatcaattgaaaaacacagtgactgtggataatactgtgggcaacgacactatgtttctagttacgtggcaggccagtggtcctcctgagattatattatttgatcctgatggacgaaaatactacacaaataattttatcaccaatctaacttttcggacagctagtctttggattccaggaacagctaagcctgggcactggacttacaccctgaacaatacccatcattctctgcaagccctgaaagtgacagtgacctctcgcgcctccaactcagctgtgcccccagccactgtggaagcctttgtggaaagagacagcctccattttcctcatcctgtgatgatttatgccaatgtgaaacagggattttatcccattcttaatgccactgtcactgccacagttgagccagagactggagatcctgttacgctgagactccttgatgatggagcaggtgctgatgttataaaaaatgatggaatttactcgaggtattttttctcctttgctgcaaatggtagatatagcttgaaagtgcatgtcaatcactctcccagcataagcaccccagcccactctattccagggagtcatgctatgtatgtaccaggttacacagcaaacggtaatattcagatgaatgctccaaggaaatcagtaggcagaaatgaggaggagcgaaagtggggctttagccgagtcagctcaggaggctccttttcagtgctgggagttccagctggcccccaccctgatgtgtttccaccatgcaaaattattgacctggaagctgtaaaagtagaagaggaattgaccctatcttggacagcacctggagaagactttgatcagggccaggctacaagctatgaaataagaatgagtaaaagtctacagaatatccaagatgactttaacaatgctattttagtaaatacatcaaagcgaaatcctcagcaagctggcatcagggagatatttacgttctcaccccaaatttccacgaatggacctgaacatcagccaaatggagaaacacatgaaagccacagaatttatgttgcaatacgagcaatggataggaactccttacagtctgctgtatctaacattgcccaggcgcctctgtttattccccccaattctgatcctgtacctgccagagattatcttatattgaaaggagttttaacagcaatgggtttgataggaatcatttgccttattatagttgtgacacatcatactttaagcaggaaaaagagagcagacaagaaagagaatggaacaaaattattataaataaatatccaaagtgtcttccttcttagatataagacccatggccttcgactacaaaaacatactaacaaagtcaaattaacatcaaaactgtattaaaatgcattgagtttttgtacaatacagataagatttttacatggtagatcaacaaattctttttgggggtagattagaaaacccttacactttggctatgaacaaataataaaaattattctttaaagtaatgtctttaaaggcaaagggaagggtaaagtcggaccagtgtcaaggaaagtttgttttattgaggtggaaaaatagccccaagcagagaaaaggagggtaggtctgcattataactgtctgtgtgaagcaatcatttagttactttgattaatttttcttttctccttatctgtgcagaacaggttgcttgtttacaactgaagatcatgctatattttatatatgaagcccctaatgcaaagctctttacctcttgctattttgttatatatattacagatgaaatctcactgctaatgctcagagatcttttttcactgtaagaggtaacctttaacaatatgggtattacctttgtctcttcataccggttttatgacaaaggtctattgaatttatttgtttgtaagtttctactcccatcaaagcagctttctaagttattgccttggttattatggatgatagttatagcccttataatgccttaactaaggaagaaaagatgttattctgagtttgttttaatacatatatgaacatatagttttattcaattaaaccaaagaagaggtcagcagggagatactaacctttggaaatgattagctggctctgttttttggttaaataagagtctttaatcctttctccatcaagagttacttaccaagggcaggggaagggggatatagaggtcacaaggaaataaaaatcatctttcatctttaattttactccttcctcttatttttttaaaagattatcgaacaataaaatcatttgcctttttaattaaa

SEQ ID NO: 1053 - DNA, 585 bp, Homo sapiens
tcccagatggatccaccccagacttttcaaagaagacacctccttcatcttgtgttctaaaaccttgcaagttcaggaagaaaccatctgcatccatattgaaaacctgacacaatgtatgcagcaggctcagtgtgagtgaactggaggcttctctacaacatgacccaaaggagcattgcaggtcctatttgcaacctgaagtttgtgactctcctggttgccttaagttcagaactcccattcctgggagctggagtacagcttcaagacaatgggtataatggattgctcattgcaattaatcctcaggtacctgagaatcagaacctcatctcaaacattaaggaaatgataactgaagcttcattttacctatttaatgctaccaagagaagagtatttttcagaaatataaagattttaatacctgccacatggaaagctaataataacagcaaaataaaacaagaatcatatgaaaaggcaaatgtcatagtgactgactggtatggggcacatggagatgatcagggtgtggaaaagagggaaaatacattcatttcacacctaatttcctactga

SEQ ID NO: 1054 - DNA, 2713 bp, Homo sapiens
attgttagagacctgtcattgatagcagttgctagttgctgccttttaagagctcgttgattcctctgcaaggtggtgcagcatcctctgtcccttcattcatttcagatctactcaggtctccctgtaaacagatctctcggatcaataagcatgaatgacgaagactacagcaccatctatgacacaatccaaaatgagaggacgtatgaggttccagaccagccagaagaaaatgaaagtccccattatgatgatgtccatgagtacttaaggccagaaaatgatttatatgccactcagctgaatacccatgagtatgattttgtgtcagtctataccattaagggtgaagagaccagcttggcctctgtccagtcagaagacagaggctacctcctgcctgatgagatatactctgaactccaggaggctcatccaggtgagccccaggaggacaggggcatctcaatggaagggttatattcatcaacccaggaccagcaactctgcgcagcagaactccaggagaatgggagtgtgatgaaggaagatctgccttctccttcaagcttcaccattcagcacagtaaggccttctctaccaccaagtattcctgctattctgatgctgaaggtttggaagaaaaggagggagctcacatgaaccctgagatttacctctttgtgaaggctggaatcgatggagaaagcatcggcaactgtcctttctctcagcgcctcttcatgatcctctggctgaaaggagtcgtgttcaatgtcaccactgtggatctgaaaagaaagccagctgacctgcacaacctagcccccggcacgcacccgcccttcctgaccttcaacggggacgtgaagacagacgtcaataagatcgaggagttcctggaggagaccttgacccctgaaaagtaccccaaactggctgcaaaacaccgggaatccaacacagcgggcatcgacatcttttccaagttttctgcctacatcaaaaataccaagcagcagaacaatgctgctcttgaaagaggcctaaccaaggctctaaagaaattggatgactacctgaacacccctctaccagaggagattgacgccaacacttgtggggaagacaaggggtcccggcgcaagttcctggatggggatgagctgaccctggctgactgcaatctgttgcccaagctccatgtggtcaagattgtggccaagaaataccgcaactatgatatcccggctgagatgacaggcctgtggcggtacctcaagaacgcctatgcccgtgatgagttcaccaacacctgtgcagctgacagtgagatcgagttggcctacgctgatgtcgccaaacgcctcagccgatcctgagcacagccattttgccccatccccgctgcagaaggactcaaccactcccctaagactccagcttcatagactcctctgtatcactgccttgaggcgcactttttataatcaagcctcatcttgctggtatcatgggaactccagcctgctatctttcatgaaggtcagcaccatccctggcctcctcacataggaatctagcagaaatgatagacacagtccacctttcggccggccagcctgatctgggctcagcatgtttggggtcagtcagtgttggagagcccacatatgggattgccactagcttcttctgccaatatcaaaataccttctcagatgctttagaaacatgcaacaccaactccttttctaccctcctctccgtccatacctacaaggccaaggacaaacgccatcttcatccttcttagaaagagatctattaccccattaggggagacagagagagtgaatggaggagtaccgagctggctatggacttgggtgtctggcaaacacagcttcagtctcactacttctgacactctggttattgggcactaagggccagactggaaagtcacttgagacacattctcagtttgttgcagtgccaggaatgctgcgctgctgctgctgcgcacctggcccatgctgtccctggcttccatgccgtccaggccctgccagaaaaggaaattggcatgcaattctaaactgcagtgactgggatgggaggggaggggagcagtgttgatgccaaaatacccacggggtctaccagccatggggtttgcttgcttaggagtagttgtttcagaggtgattacaggcctgggtttgactgtgcttaccaatgagtggtttttgagctatgagaaagtggatgggagtgggaggaggagagatgggtgaagacaaaagagttctttatgagcctcgatgttccctggtaaacttttaaaaaggccttctctcatgatctaagtcttggactggtggcatcatgtaactgctaaccttacagtaaaaacccaagaatgggtcaaaaatgtcttcccagtttctccaagctgcttctggaatgcaggtctgtcggctgggtgctctccagcagctgctcctgcctgattcaactgtagcctgtaatgggtaaaagccacatttaggaggtggtctgatcatagaacaccttaggaagaaagtccatgagactttctgactaggaaaccatgtggtttgaacttgaagaaaaatgtagacccatctgggttaattttcctacaatctgactcaactgccaggtgaaaaaaaaaaggaaaaa

SEQ ID NO: 1055 - DNA, 2390 bp, Homo sapiens
cggatcctgtgacacctccgggcagcccggcacttgttgctcccacgacctgttgtcattcccttaacccggctttccccgtggccccccgcctcctcccggcttcgctccttttcatgtgagcatctgggacactgatctctcagaccccgctgctcgggctggagaatagatggttttgtgaaaaattaaacaccgccctgaagaggagccccgctgggcagcggcaggagcgcagagtgctggcccaggtgctgcagaggtggcgcctccccggcccgggacggtagccccgggcgccaacggcatgacagactcggcgacagctaacggggacgacagggaccccgagatcgagctctttgtgaaggctggaatcgatggagaaagcatcggcaactgtcctttctctcagcgcctcttcatgatcctctggctgaaaggagtcgtgttcaatgtcaccactgtggatctgaaaagaaagccagctgacctgcacaacctagcccccggcacgcacccgcccttcctgaccttcaacggggacgtgaagacagacgtcaataagatcgaggagttcctggaggagaccttgacccctgaaaagtaccccaaactggctgcaaaacaccgggaatccaacacagcgggcatcgacatcttttccaagttttctgcctacatcaaaaataccaagcagcagaacaatgctgctcttgaaagaggcctaaccaaggctctaaagaaattggatgactacctgaacacccctctaccagaggagattgacgccaacacttgtggggaagacaaggggtcccggcgcaagttcctggatggggatgagctgaccctggctgactgcaatctgttgcccaagctccatgtggtcaagattgtggccaagaaataccgcaactatgatatcccggctgagatgacaggcctgtggcggtacctcaagaacgcctatgcccgtgatgagttcaccaacacctgtgcagctgacagtgagatcgagttggcctacgctgatgtcgccaaacgcctcagccgatcctgagcacagccattttgccccatccccgctgcagaaggactcaaccactcccctaagactccagcttcatagactcctctgtatcactgccttgaggcgcactttttataatcaagcctcatcttgctggtatcatgggaactccagcctgctatctttcatgaaggtcagcaccatccctggcctcctcacataggaatctagcagaaatgatagacacagtccacctttcggccggccagcctgatctgggctcagcatgtttggggtcagtcagtgttggagagcccacatatgggattgccactagcttcttctgccaatatcaaaataccttctcagatgctttagaaacatgcaacaccaactccttttctaccctcctctccgtccatacctacaaggccaaggacaaacgccatcttcatccttcttagaaagagatctattaccccattaggggagacagagagagtgaatggaggagtaccgagctggctatggacttgggtgtctggcaaacacagcttcagtctcactacttctgacactctggttattgggcactaagggccagactggaaagtcacttgagacacattctcagtttgttgcagtgccaggaatgctgcgctgctgctgctgcgcacctggcccatgctgtccctggcttccatgccgtccaggccctgccagaaaaggaaattggcatgcaattctaaactgcagtgactgggatgggaggggaggggagcagtgttgatgccaaaatacccacggggtctaccagccatggggtttgcttgcttaggagtagttgtttcagaggtgattacaggcctgggtttgactgtgcttaccaatgagtggtttttgagctatgagaaagtggatgggagtgggaggaggagagatgggtgaagacaaaagagttctttatgagcctcgatgttccctggtaaacttttaaaaaggccttctctcatgatctaagtcttggactggtggcatcatgtaactgctaaccttacagtaaaaacccaagaatgggtcaaaaatgtcttcccagtttctccaagctgcttctggaatgcaggtctgtcggctgggtgctctccagcagctgctcctgcctgattcaactgtagcctgtaatgggtaaaagccacatttaggaggtggtctgatcatagaacaccttaggaagaaagtccatgagactttctgactaggaaaccatgtggtttgaacttgaagaaaaatgtagacccatctgggttaattttcctacaatctgactcaactgccaggtgaaaaaaaaaaggaaaaa

SEQ ID NO: 1056 - DNA, 1990 bp, Homo sapiens
gcagcccggcacttgttgctcccacgacctgttgtcattcccttaacccggctttccccgtggccccccgcctcctcccggcttcgctccttttcatgtgagcatctgggacactgatctctcagaccccgctgctcgggctggagaatagatggttttgtgaaaaattaaacaccgccctgaagaggagccccgctgggcagcggcaggagcgcagagtgctggcccaggtgctgcagaggtggcgcctccccggcccgggacggtagccccgggcgccaacggcatgacagactcggcgacagctaacggggacgacagggaccccgagatcgagctctttgtgaaggctggaatcgatggagaaagcatcggcaactgtcctttctctcagcgcctcttcatgatcctctggctgaaaggagtcgtgttcaatgtcaccactgtggatctgaaaagaaagccagctgacctgcacaacctagcccccggcacgcacccgcccttcctgaccttcaacggggacgtgaagacagacgtcaataagatcgaggagttcctggaggagaccttgacccctgaaaagtaccccaaactggctgcaaaacaccgggaatccaacacagcgggcatcgacatcttttccaagttttctgcctacatcaaaaataccaagcagcagaacaatgctgctcttgaaagaggcctaaccaaggctctaaagaaattggatgactacctgaacacccctctaccagaggagattgacgccaacacttgtggggaagacaaggggtcccggcgcaagttcctggatggggatgagctgaccctggctgactgcaatctgttgcccaagctccatgtggtcaaggaacaagtaccactgaaagggatgatataattccagctcagtcacactgtgtcagagtgatacaatgcaaagatcaggagacccgagttccggtcctgtatttgctgccaactagcagcatgagctgaggcacatcatttaatctttttggaattcatttttctcatgcctagaagaacagaagtggattgtattccttcttgccttcttttcctttcttctttccctccttctttccttttctcttgctcaaacatgtattcactaccactcaaaaaccatttgttgaacaaagcaaacaaatgaatctcccaagccttgggcttcatcctgtgatttcctcaattcccacctgccttaaattactcagtgaagccctgtccttggagaaaattcagtgggtggttaacccagagaagctggagatcaaaaagaagatggccaatgaaagaacaaaggccagcccttggcccctatctctttggatttctgctgatccagcttatcagatcccagaaacctggcaaacctctaaagttcacaaagagcgaaggggaagccaagtcaggcctccagtttggcttcggatgccaaaacttaatctgggctgtgggagctaactgttttcatatgaaagagcaaattcagaacatgagcatggaagtccctgcgaacgtcagatctccgtgtgcatccttacccccttgctgctttcatgctcactctcctcttgcgtggctcgctttcaggtttatctccatccctggaagcagagttgctctggcccaggctctccatgagagtttggcttgaacattcattgtctggccccctcctagttctcatctcccaaagtcaagccaatgtgtgaagaaatgaccagctcagcagccaaggcccagggtgcacaggtcttcgttgggagaggcatctgcaggcctttccttgctcactgggatccttgcctagcatagtgacgatgttcagccctggagacaaacaagaaggggaacaccaacatcaatagaagtatatatttacaaattgcatttctgctgtattgaaactaacattctgccctttaaaatcctgaaaataaaatttcagtatgaaatg

SEQ ID NO: 1057 - DNA, 6580 bp, Homo sapiens
attttccccccttcggccgcggcgaggaggagccggagcgggagtgacaccgagccggacccagcgcgacctgcggcggctccgggtgactcgggccagtgtagaggtcctcaggccgccggcaggagcagctgggccaattccctggccgggagcggaaggggatggcgtcgggcctgggctccccgtccccctgctcggcgggcagtgaggaggaggatatggatgcacttttgaacaacagcctgcccccaccccacccagaaaatgaagaggacccagaagaggatttgtcagaaacagagactccaaagctcaagaagaagaaaaagcctaagaaacctcgggaccctaaaatccctaagagcaagcgccaaaaaaaggagcgtatgctcttatgccggcagctgggggacagctctggggaggggccagagtttgtggaggaggaggaagaggtggctctgcgctcagacagtgagggcagcgactatactcctggcaagaagaagaagaagaagcttggacctaagaaagagaagaagagcaaatccaagcggaaggaggaggaggaggaggaggatgatgatgatgattcaaaggagcctaaatcatctgctcagctcctggaagactggggcatggaagacattgaccacgtgttctcagaggaggattatcgaaccctcaccaactacaaggccttcagccagtttgtcagacccctcattgctgccaaaaatcccaagattgctgtctccaagatgatgatggttttgggtgcaaaatggcgggagttcagtaccaataaccccttcaaaggcagttctggggcatcagtggcagctgcggcagcagcagcggtagctgtggtggagagcatggtgacagccactgaggttgcaccaccacctccccctgtggaggtgcctatccgcaaggccaagaccaaggagggcaaaggtcccaatgctcggaggaagcccaagggcagccctcgtgtacctgatgccaagaagcctaaacccaagaaagtagctcccctgaaaatcaagctgggaggttttggttccaagcgtaagagatcctcgagtgaggatgatgacttagatgtggaatctgacttcgatgatgccagtatcaatagctattctgtttctgatggttccaccagccgtagtagccgcagccgcaagaaactccgaaccactaaaaagaaaaagaaaggcgaggaggaggtgactgctgtggatggttatgagacagaccaccaggactattgcgaggtgtgccagcaaggcggtgagatcatcctgtgtgatacctgtccccgtgcttaccacatggtctgcctggatcccgacatggagaaggctcccgagggcaagtggagctgcccacactgcgagaaggaaggcatccagtgggaagctaaagaggacaattcggagggtgaggagatcctggaagaggttgggggagacctcgaagaggaggatgaccaccatatggaattctgtcgggtctgcaaggatggtggggaactgctctgctgtgatacctgtccttcttcctaccacatccactgcctgaatcccccacttccagagatccccaacggtgaatggctctgtccccgttgtacgtgtccagctctgaagggcaaagtgcagaagatcctaatctggaagtggggtcagccaccatctcccacaccagtgcctcggcctccagatgctgatcccaacacgccctccccaaagcccttggaggggcggccagagcggcagttctttgtgaaatggcaaggcatgtcttactggcactgctcctgggtttctgaactgcagctggagctgcactgtcaggtgatgttccgaaactatcagcggaagaatgatatggatgagccaccttctggggactttggtggtgatgaagagaaaagccgaaagcgaaagaacaaggaccctaaatttgcagagatggaggaacgcttctatcgctatgggataaaacccgagtggatgatgatccaccgaatcctcaaccacagtgtggacaagaagggccacgtccactacttgatcaagtggcgggacttaccttacgatcaggcttcttgggagagtgaggatgtggagatccaggattacgacctgttcaagcagagctattggaatcacagggagttaatgaggggtgaggaaggccgaccaggcaagaagctcaagaaggtgaagcttcggaagttggagaggcctccagaaacgccaacagttgatccaacagtgaagtatgagcgacagccagagtacctggatgctacaggtggaaccctgcacccctatcaaatggagggcctgaattggttgcgcttctcctgggctcagggcactgacaccatcttggctgatgagatgggccttgggaaaactgtacagacagcagtcttcctgtattccctttacaaggagggtcattccaaaggccccttcctagtgagcgcccctctttctaccatcatcaactgggagcgggagtttgaaatgtgggctccagacatgtatgtcgtaacctatgtgggtgacaaggacagccgtgccatcatccgagagaatgagttctcctttgaagacaatgccattcgtggtggcaagaaggcctcccgcatgaagaaagaggcatctgtgaaattccatgtgctgctgacatcctatgaattgatcaccattgacatggctattttgggctctattgattgggcctgcctcatcgtggatgaagcccatcggctgaagaacaatcagtctaagttcttccgggtattgaatggttactcactccagcacaagctgttgctgactgggacaccattacaaaacaatctggaagagttgtttcatctgctcaactttctcacccccgagaggttccacaatttggaaggttttttggaggagtttgctgacattgccaaggaggaccagataaaaaaactgcatgacatgctggggccgcacatgttgcggcggctcaaagccgatgtgttcaagaacatgccctccaagacagaactaattgtgcgtgtggagctgagccctatgcagaagaaatactacaagtacatcctcactcgaaattttgaagcactcaatgcccgaggtggtggcaaccaggtgtctctgctgaatgtggtgatggatcttaagaagtgctgcaaccatccatacctcttccctgtggctgcaatggaagctcctaagatgcctaatggcatgtatgatggcagtgccctaatcagagcatctgggaaattattgctgctgcagaaaatgctcaagaaccttaaggagggtgggcatcgtgtactcatcttttcccagatgaccaagatgctagacctgctagaggatttcttggaacatgaaggttataaatacgaacgcatcgatggtggaatcactgggaacatgcggcaagaggccattgaccgcttcaatgcaccgggtgctcagcagttctgcttcttgctttccactcgagctgggggccttggaatcaatctggccactgctgacacagttattatctatgactctgactggaacccccataatgacattcaggcctttagcagagctcaccggattgggcaaaataaaaaggtaatgatctaccggtttgtgacccgtgcgtcagtggaggagcgcatcacgcaggtggcaaagaagaaaatgatgctgacgcatctagtggtgcggcctgggctgggctccaagactggatctatgtccaaacaggagcttgatgatatcctcaaatttggcactgaggaactattcaaggatgaagccactgatggaggaggagacaacaaagagggagaagatagcagtgttatccactacgatgataaggccattgaacggctgctagaccgtaaccaggatgagactgaagacacagaattgcagggcatgaatgaatatttgagctcattcaaagtggcccagtatgtggtacgggaagaagaaatgggggaggaagaggaggtagaacgggaaatcattaaacaggaagaaagtgtggatcctgactactgggagaaattgctgcggcaccattatgagcagcagcaagaagatctagcccgaaatctgggcaaaggaaaaagaatccgtaaacaggtcaactacaatgatggctcccaggaggaccgaggtgtgtgtggccggccccgccccccacccatgggccgttccactagagcagtgggccccgctcatctgccctctctccctccagattggcaggacgaccagtccgacaaccagtccgattactcagtggcttcagaggaaggtgatgaagactttgatgaacgttcagaagctccccgtaggcccagtcgtaagggcctgcggaatgataaagataagccattgcctcctctgttggcccgtgttggtgggaatattgaagtacttggttttaatgctcgtcagcgaaaagcctttcttaatgcaattatgcgatatggtatgccacctcaggatgcttttactacccagtggcttgtaagagacctgcgaggcaaatcagagaaagagttcaaggcatatgtctctcttttcatgcggcatttatgtgagccgggggcagatggggctgagacctttgctgatggtgtcccccgagaaggcctgtctcgccagcatgtccttactagaattggtgttatgtctttgattcgcaagaaggttcaggagtttgaacatgttaatgggcgctggagcatgcctgaactggctgaggtggaggaaaacaagaagatgtcccagccagggtcaccctccccaaaaactcctacaccctccactccaggggacacgcagcccaacactcctgcacctgtcccacctgctgaagatgggataaaaatagaggaaaatagcctcaaagaagaagagagcatagaaggagaaaaggaggttaaatctacagcccctgagactgccattgagtgtacacaggcccctgcccctgcctcagaggatgaaaaggtcgttgttgaaccccctgagggagaggagaaagtggaaaaggcagaggtgaaggagagaacagaggaacctatggagacagagcccaaaggtgctgctgatgtagagaaggtggaggaaaagtcagcaatagatctgacccctattgtggtagaagacaaagaagagaagaaagaagaagaagagaaaaaagaggtgatgcttcagaatggagagacccccaaggacctgaatgatgagaaacagaagaaaaatattaaacaacgtttcatgtttaacattgcagatggtggttttactgagttgcactccctttggcagaatgaagagcgggcagccacagttaccaagaagacttatgagatctggcatcgacggcatgactactggctgctagccggcattataaaccatggctatgcccggtggcaagacatccagaatgacccacgctatgccatcctcaatgagcctttcaagggtgaaatgaaccgtggcaatttcttagagatcaagaataaatttctagctcgaaggtttaagctcttagaacaagctctggtgattgaggaacagctgcgccgggctgcttacttgaacatgtcagaagacccttctcacccttccatggccctcaacacccgctttgctgaggtggagtgtttggcggaaagtcatcagcacctgtccaaggagtcaatggcaggaaacaagccagccaatgcagtcctgcacaaagttctgaaacagctggaagaactgctgagtgacatgaaagctgatgtgactcgactcccagctaccattgcccgaattcccccagttgctgtgaggttacagatgtcagagcgtaacattctcagccgcctggcaaaccgggcacccgaacctaccccacagcaggtagcccagcagcagtgaagatgcagactgataccacctccaccgctgagcagtgaccttcctcactttctcttgtcccagcttctcccctgggggcctgagagaccctcaccttccttctgcccatcttccatgttgtaaaggaacagccccagtgcactgggggaggggagggagtgaggggcagtggtgcccttcctgcagaagagacatgcagcagtagcgctggcgccatctgcaggagctggcgggctggccttctggaccctggcttctccccactgtaacgcctgttacacacaaactgttgtgggttcctgccaggcttgaagaaaatgatctgaattttttcctccttttggttttattttgttggtttattttgtgttttcttttctcctttttggggggtattcagagtgggctgggcccctgggcgagacacagctacctctgttggcatctttttaataccaggaacccagcggctctagccactgagcggctaaatgaaataaagtggaaaaaaaaaaaaaggaaaaaaccaaaagcataaaaaaccacagcaaatttcttgatgaaaattgaaaataaaagtttccttgtatttt

SEQ ID NO: 1058 - DNA, 6496 bp, Homo sapiens
attttccccccttcggccgcggcgaggaggagccggagcgggagtgacaccgagccggacccagcgcgacctgcggcggctccgggtgactcgggccagtgtagaggtcctcaggccgccggcaggagcagctgggccaattccctggccgggagcggaaggggatggcgtcgggcctgggctccccgtccccctgctcggcgggcagtgaggaggaggatatggatgcacttttgaacaacagcctgcccccaccccacccagaaaatgaagaggacccagaagaggatttgtcagaaacagagactccaaagctcaagaagaagaaaaagcctaagaaacctcgggaccctaaaatccctaagagcaagcgccaaaaaaaggagcgtatgctcttatgccggcagctgggggacagctctggggaggggccagagtttgtggaggaggaggaagaggtggctctgcgctcagacagtgagggcagcgactatactcctggcaagaagaagaagaagaagcttggacctaagaaagagaagaagagcaaatccaagcggaaggaggaggaggaggaggaggatgatgatgatgattcaaaggagcctaaatcatctgctcagctcctggaagactggggcatggaagacattgaccacgtgttctcagaggaggattatcgaaccctcaccaactacaaggccttcagccagtttgtcagacccctcattgctgccaaaaatcccaagattgctgtctccaagatgatgatggttttgggtgcaaaatggcgggagttcagtaccaataaccccttcaaaggcagttctggggcatcagtggcagctgcggcagcagcagcggtagctgtggtggagagcatggtgacagccactgaggttgcaccaccacctccccctgtggaggtgcctatccgcaaggccaagaccaaggagggcaaaggtcccaatgctcggaggaagcccaagggcagccctcgtgtacctgatgccaagaagcctaaacccaagaaagtagctcccctgaaaatcaagctgggaggttttggttccaagcgtaagagatcctcgagtgaggatgatgacttagatgtggaatctgacttcgatgatgccagtatcaatagctattctgtttctgatggttccaccagccgtagtagccgcagccgcaagaaactccgaaccactaaaaagaaaaagaaaggcgaggaggaggtgactgctgtggatggttatgagacagaccaccaggactattgcgaggtgtgccagcaaggcggtgagatcatcctgtgtgatacctgtccccgtgcttaccacatggtctgcctggatcccgacatggagaaggctcccgagggcaagtggagctgcccacactgcgagaaggaaggcatccagtgggaagctaaagaggacaattcggagggtgaggagatcctggaagaggttgggggagacctcgaagaggaggatgaccaccatatggaattctgtcgggtctgcaaggatggtggggaactgctctgctgtgatacctgtccttcttcctaccacatccactgcctgaatcccccacttccagagatccccaacggtgaatggctctgtccccgttgtacgtgtccagctctgaagggcaaagtgcagaagatcctaatctggaagtggggtcagccaccatctcccacaccagtgcctcggcctccagatgctgatcccaacacgccctccccaaagcccttggaggggcggccagagcggcagttctttgtgaaatggcaaggcatgtcttactggcactgctcctgggtttctgaactgcagctggagctgcactgtcaggtgatgttccgaaactatcagcggaagaatgatatggatgagccaccttctggggactttggtggtgatgaagagaaaagccgaaagcgaaagaacaaggaccctaaatttgcagagatggaggaacgcttctatcgctatgggataaaacccgagtggatgatgatccaccgaatcctcaaccacagtgtggacaagaagggccacgtccactacttgatcaagtggcgggacttaccttacgatcaggcttcttgggagagtgaggatgtggagatccaggattacgacctgttcaagcagagctattggaatcacagggagttaatgaggggtgaggaaggccgaccaggcaagaagctcaagaaggtgaagcttcggaagttggagaggcctccagaaacgccaacagttgatccaacagtgaagtatgagcgacagccagagtacctggatgctacaggtggaaccctgcacccctatcaaatggagggcctgaattggttgcgcttctcctgggctcagggcactgacaccatcttggctgatgagatgggccttgggaaaactgtacagacagcagtcttcctgtattccctttacaaggagggtcattccaaaggccccttcctagtgagcgcccctctttctaccatcatcaactgggagcgggagtttgaaatgtgggctccagacatgtatgtcgtaacctatgtgggtgacaaggacagccgtgccatcatccgagagaatgagttctcctttgaagacaatgccattcgtggtggcaagaaggcctcccgcatgaagaaagaggcatctgtgaaattccatgtgctgctgacatcctatgaattgatcaccattgacatggctattttgggctctattgattgggcctgcctcatcgtggatgaagcccatcggctgaagaacaatcagtctaagttcttccgggtattgaatggttactcactccagcacaagctgttgctgactgggacaccattacaaaacaatctggaagagttgtttcatctgctcaactttctcacccccgagaggttccacaatttggaaggttttttggaggagtttgctgacattgccaaggaggaccagataaaaaaactgcatgacatgctggggccgcacatgttgcggcggctcaaagccgatgtgttcaagaacatgccctccaagacagaactaattgtgcgtgtggagctgagccctatgcagaagaaatactacaagtacatcctcactcgaaattttgaagcactcaatgcccgaggtggtggcaaccaggtgtctctgctgaatgtggtgatggatcttaagaagtgctgcaaccatccatacctcttccctgtggctgcaatggaagctcctaagatgcctaatggcatgtatgatggcagtgccctaatcagagcatctgggaaattattgctgctgcagaaaatgctcaagaaccttaaggagggtgggcatcgtgtactcatcttttcccagatgaccaagatgctagacctgctagaggatttcttggaacatgaaggttataaatacgaacgcatcgatggtggaatcactgggaacatgcggcaagaggccattgaccgcttcaatgcaccgggtgctcagcagttctgcttcttgctttccactcgagctgggggccttggaatcaatctggccactgctgacacagttattatctatgactctgactggaacccccataatgacattcaggcctttagcagagctcaccggattgggcaaaataaaaaggtaatgatctaccggtttgtgacccgtgcgtcagtggaggagcgcatcacgcaggtggcaaagaagaaaatgatgctgacgcatctagtggtgcggcctgggctgggctccaagactggatctatgtccaaacaggagcttgatgatatcctcaaatttggcactgaggaactattcaaggatgaagccactgatggaggaggagacaacaaagagggagaagatagcagtgttatccactacgatgataaggccattgaacggctgctagaccgtaaccaggatgagactgaagacacagaattgcagggcatgaatgaatatttgagctcattcaaagtggcccagtatgtggtacgggaagaagaaatgggggaggaagaggaggtagaacgggaaatcattaaacaggaagaaagtgtggatcctgactactgggagaaattgctgcggcaccattatgagcagcagcaagaagatctagcccgaaatctgggcaaaggaaaaagaatccgtaaacaggtcaactacaatgatggctcccaggaggaccgagattggcaggacgaccagtccgacaaccagtccgattactcagtggcttcagaggaaggtgatgaagactttgatgaacgttcagaagctccccgtaggcccagtcgtaagggcctgcggaatgataaagataagccattgcctcctctgttggcccgtgttggtgggaatattgaagtacttggttttaatgctcgtcagcgaaaagcctttcttaatgcaattatgcgatatggtatgccacctcaggatgcttttactacccagtggcttgtaagagacctgcgaggcaaatcagagaaagagttcaaggcatatgtctctcttttcatgcggcatttatgtgagccgggggcagatggggctgagacctttgctgatggtgtcccccgagaaggcctgtctcgccagcatgtccttactagaattggtgttatgtctttgattcgcaagaaggttcaggagtttgaacatgttaatgggcgctggagcatgcctgaactggctgaggtggaggaaaacaagaagatgtcccagccagggtcaccctccccaaaaactcctacaccctccactccaggggacacgcagcccaacactcctgcacctgtcccacctgctgaagatgggataaaaatagaggaaaatagcctcaaagaagaagagagcatagaaggagaaaaggaggttaaatctacagcccctgagactgccattgagtgtacacaggcccctgcccctgcctcagaggatgaaaaggtcgttgttgaaccccctgagggagaggagaaagtggaaaaggcagaggtgaaggagagaacagaggaacctatggagacagagcccaaaggtgctgctgatgtagagaaggtggaggaaaagtcagcaatagatctgacccctattgtggtagaagacaaagaagagaagaaagaagaagaagagaaaaaagaggtgatgcttcagaatggagagacccccaaggacctgaatgatgagaaacagaagaaaaatattaaacaacgtttcatgtttaacattgcagatggtggttttactgagttgcactccctttggcagaatgaagagcgggcagccacagttaccaagaagacttatgagatctggcatcgacggcatgactactggctgctagccggcattataaaccatggctatgcccggtggcaagacatccagaatgacccacgctatgccatcctcaatgagcctttcaagggtgaaatgaaccgtggcaatttcttagagatcaagaataaatttctagctcgaaggtttaagctcttagaacaagctctggtgattgaggaacagctgcgccgggctgcttacttgaacatgtcagaagacccttctcacccttccatggccctcaacacccgctttgctgaggtggagtgtttggcggaaagtcatcagcacctgtccaaggagtcaatggcaggaaacaagccagccaatgcagtcctgcacaaagttctgaaacagctggaagaactgctgagtgacatgaaagctgatgtgactcgactcccagctaccattgcccgaattcccccagttgctgtgaggttacagatgtcagagcgtaacattctcagccgcctggcaaaccgggcacccgaacctaccccacagcaggtagcccagcagcagtgaagatgcagactgataccacctccaccgctgagcagtgaccttcctcactttctcttgtcccagcttctcccctgggggcctgagagaccctcaccttccttctgcccatcttccatgttgtaaaggaacagccccagtgcactgggggaggggagggagtgaggggcagtggtgcccttcctgcagaagagacatgcagcagtagcgctggcgccatctgcaggagctggcgggctggccttctggaccctggcttctccccactgtaacgcctgttacacacaaactgttgtgggttcctgccaggcttgaagaaaatgatctgaattttttcctccttttggttttattttgttggtttattttgtgttttcttttctcctttttggggggtattcagagtgggctgggcccctgggcgagacacagctacctctgttggcatctttttaataccaggaacccagcggctctagccactgagcggctaaatgaaataaagtggaaaaaaaaaaaaaggaaaaaaccaaaagcataaaaaaccacagcaaatttcttgatgaaaattgaaaataaaagtttccttgtatttt

SEQ ID NO: 1059 - DNA, 6434 bp, Homo sapiens
attttccccccttcggccgcggcgaggaggagccggagcgggagtgacaccgagccggacccagcgcgacctgcggcggctccgggtgactcgggccagtgtagaggtcctcaggccgccggcaggagcagctgggccaattccctggccgggagcggaaggggcagtgaggaggaggatatggatgcacttttgaacaacagcctgcccccaccccacccagaaaatgaagaggacccagaagaggatttgtcagaaacagagactccaaagctcaagaagaagaaaaagcctaagaaacctcgggaccctaaaatccctaagagcaagcgccaaaaaaaggagctgggggacagctctggggaggggccagagtttgtggaggaggaggaagaggtggctctgcgctcagacagtgagggcagcgactatactcctggcaagaagaagaagaagaagcttggacctaagaaagagaagaagagcaaatccaagcggaaggaggaggaggaggaggaggatgatgatgatgattcaaaggagcctaaatcatctgctcagctcctggaagactggggcatggaagacattgaccacgtgttctcagaggaggattatcgaaccctcaccaactacaaggccttcagccagtttgtcagacccctcattgctgccaaaaatcccaagattgctgtctccaagatgatgatggttttgggtgcaaaatggcgggagttcagtaccaataaccccttcaaaggcagttctggggcatcagtggcagctgcggcagcagcagcggtagctgtggtggagagcatggtgacagccactgaggttgcaccaccacctccccctgtggaggtgcctatccgcaaggccaagaccaaggagggcaaaggtcccaatgctcggaggaagcccaagggcagccctcgtgtacctgatgccaagaagcctaaacccaagaaagtagctcccctgaaaatcaagctgggaggttttggttccaagcgtaagagatcctcgagtgaggatgatgacttagatgtggaatctgacttcgatgatgccagtatcaatagctattctgtttctgatggttccaccagccgtagtagccgcagccgcaagaaactccgaaccactaaaaagaaaaagaaaggcgaggaggaggtgactgctgtggatggttatgagacagaccaccaggactattgcgaggtgtgccagcaaggcggtgagatcatcctgtgtgatacctgtccccgtgcttaccacatggtctgcctggatcccgacatggagaaggctcccgagggcaagtggagctgcccacactgcgagaaggaaggcatccagtgggaagctaaagaggacaattcggagggtgaggagatcctggaagaggttgggggagacctcgaagaggaggatgaccaccatatggaattctgtcgggtctgcaaggatggtggggaactgctctgctgtgatacctgtccttcttcctaccacatccactgcctgaatcccccacttccagagatccccaacggtgaatggctctgtccccgttgtacgtgtccagctctgaagggcaaagtgcagaagatcctaatctggaagtggggtcagccaccatctcccacaccagtgcctcggcctccagatgctgatcccaacacgccctccccaaagcccttggaggggcggccagagcggcagttctttgtgaaatggcaaggcatgtcttactggcactgctcctgggtttctgaactgcagctggagctgcactgtcaggtgatgttccgaaactatcagcggaagaatgatatggatgagccaccttctggggactttggtggtgatgaagagaaaagccgaaagcgaaagaacaaggaccctaaatttgcagagatggaggaacgcttctatcgctatgggataaaacccgagtggatgatgatccaccgaatcctcaaccacagtgtggacaagaagggccacgtccactacttgatcaagtggcgggacttaccttacgatcaggcttcttgggagagtgaggatgtggagatccaggattacgacctgttcaagcagagctattggaatcacagggagttaatgaggggtgaggaaggccgaccaggcaagaagctcaagaaggtgaagcttcggaagttggagaggcctccagaaacgccaacagttgatccaacagtgaagtatgagcgacagccagagtacctggatgctacaggtggaaccctgcacccctatcaaatggagggcctgaattggttgcgcttctcctgggctcagggcactgacaccatcttggctgatgagatgggccttgggaaaactgtacagacagcagtcttcctgtattccctttacaaggagggtcattccaaaggccccttcctagtgagcgcccctctttctaccatcatcaactgggagcgggagtttgaaatgtgggctccagacatgtatgtcgtaacctatgtgggtgacaaggacagccgtgccatcatccgagagaatgagttctcctttgaagacaatgccattcgtggtggcaagaaggcctcccgcatgaagaaagaggcatctgtgaaattccatgtgctgctgacatcctatgaattgatcaccattgacatggctattttgggctctattgattgggcctgcctcatcgtggatgaagcccatcggctgaagaacaatcagtctaagttcttccgggtattgaatggttactcactccagcacaagctgttgctgactgggacaccattacaaaacaatctggaagagttgtttcatctgctcaactttctcacccccgagaggttccacaatttggaaggttttttggaggagtttgctgacattgccaaggaggaccagataaaaaaactgcatgacatgctggggccgcacatgttgcggcggctcaaagccgatgtgttcaagaacatgccctccaagacagaactaattgtgcgtgtggagctgagccctatgcagaagaaatactacaagtacatcctcactcgaaattttgaagcactcaatgcccgaggtggtggcaaccaggtgtctctgctgaatgtggtgatggatcttaagaagtgctgcaaccatccatacctcttccctgtggctgcaatggaagctcctaagatgcctaatggcatgtatgatggcagtgccctaatcagagcatctgggaaattattgctgctgcagaaaatgctcaagaaccttaaggagggtgggcatcgtgtactcatcttttcccagatgaccaagatgctagacctgctagaggatttcttggaacatgaaggttataaatacgaacgcatcgatggtggaatcactgggaacatgcggcaagaggccattgaccgcttcaatgcaccgggtgctcagcagttctgcttcttgctttccactcgagctgggggccttggaatcaatctggccactgctgacacagttattatctatgactctgactggaacccccataatgacattcaggcctttagcagagctcaccggattgggcaaaataaaaaggtaatgatctaccggtttgtgacccgtgcgtcagtggaggagcgcatcacgcaggtggcaaagaagaaaatgatgctgacgcatctagtggtgcggcctgggctgggctccaagactggatctatgtccaaacaggagcttgatgatatcctcaaatttggcactgaggaactattcaaggatgaagccactgatggaggaggagacaacaaagagggagaagatagcagtgttatccactacgatgataaggccattgaacggctgctagaccgtaaccaggatgagactgaagacacagaattgcagggcatgaatgaatatttgagctcattcaaagtggcccagtatgtggtacgggaagaagaaatgggggaggaagaggaggtagaacgggaaatcattaaacaggaagaaagtgtggatcctgactactgggagaaattgctgcggcaccattatgagcagcagcaagaagatctagcccgaaatctgggcaaaggaaaaagaatccgtaaacaggtcaactacaatgatggctcccaggaggaccgagattggcaggacgaccagtccgacaaccagtccgattactcagtggcttcagaggaaggtgatgaagactttgatgaacgttcagaagctccccgtaggcccagtcgtaagggcctgcggaatgataaagataagccattgcctcctctgttggcccgtgttggtgggaatattgaagtacttggttttaatgctcgtcagcgaaaagcctttcttaatgcaattatgcgatatggtatgccacctcaggatgcttttactacccagtggcttgtaagagacctgcgaggcaaatcagagaaagagttcaaggcatatgtctctcttttcatgcggcatttatgtgagccgggggcagatggggctgagacctttgctgatggtgtcccccgagaaggcctgtctcgccagcatgtccttactagaattggtgttatgtctttgattcgcaagaaggttcaggagtttgaacatgttaatgggcgctggagcatgcctgaactggctgaggtggaggaaaacaagaagatgtcccagccagggtcaccctccccaaaaactcctacaccctccactccaggggacacgcagcccaacactcctgcacctgtcccacctgctgaagatgggataaaaatagaggaaaatagcctcaaagaagaagagagcatagaaggagaaaaggaggttaaatctacagcccctgagactgccattgagtgtacacaggcccctgcccctgcctcagaggatgaaaaggtcgttgttgaaccccctgagggagaggagaaagtggaaaaggcagaggtgaaggagagaacagaggaacctatggagacagagcccaaaggtgctgctgatgtagagaaggtggaggaaaagtcagcaatagatctgacccctattgtggtagaagacaaagaagagaagaaagaagaagaagagaaaaaagaggtgatgcttcagaatggagagacccccaaggacctgaatgatgagaaacagaagaaaaatattaaacaacgtttcatgtttaacattgcagatggtggttttactgagttgcactccctttggcagaatgaagagcgggcagccacagttaccaagaagacttatgagatctggcatcgacggcatgactactggctgctagccggcattataaaccatggctatgcccggtggcaagacatccagaatgacccacgctatgccatcctcaatgagcctttcaagggtgaaatgaaccgtggcaatttcttagagatcaagaataaatttctagctcgaaggtttaagctcttagaacaagctctggtgattgaggaacagctgcgccgggctgcttacttgaacatgtcagaagacccttctcacccttccatggccctcaacacccgctttgctgaggtggagtgtttggcggaaagtcatcagcacctgtccaaggagtcaatggcaggaaacaagccagccaatgcagtcctgcacaaagttctgaaacagctggaagaactgctgagtgacatgaaagctgatgtgactcgactcccagctaccattgcccgaattcccccagttgctgtgaggttacagatgtcagagcgtaacattctcagccgcctggcaaaccgggcacccgaacctaccccacagcaggtagcccagcagcagtgaagatgcagactgataccacctccaccgctgagcagtgaccttcctcactttctcttgtcccagcttctcccctgggggcctgagagaccctcaccttccttctgcccatcttccatgttgtaaaggaacagccccagtgcactgggggaggggagggagtgaggggcagtggtgcccttcctgcagaagagacatgcagcagtagcgctggcgccatctgcaggagctggcgggctggccttctggaccctggcttctccccactgtaacgcctgttacacacaaactgttgtgggttcctgccaggcttgaagaaaatgatctgaattttttcctccttttggttttattttgttggtttattttgtgttttcttttctcctttttggggggtattcagagtgggctgggcccctgggcgagacacagctacctctgttggcatctttttaataccaggaacccagcggctctagccactgagcggctaaatgaaataaagtggaaaaaaaaaaaaaggaaaaaaccaaaagcataaaaaaccacagcaaatttcttgatgaaaattgaaaataaaagtttccttgtatttt

SEQ ID NO: 1060 - DNA, 6514 bp, Homo sapiens
gtttcaggccctttaagaggcgacgctggagccggagccattttccccccttcggccgcggcgaggaggagccggagcgggagtgacaccgagccggacccagcgcgacctgcggcggctccgggtgactcgggccagtgtagaggtcctcaggccgccggcaggagcagctgggccaattccctggccgggagcggaaggggatggcgtcgggcctgggctccccgtccccctgctcggcgggcagtgaggaggaggatatggatgcacttttgaacaacagcctgcccccaccccacccagaaaatgaagaggacccagaagaggatttgtcagaaacagagactccaaagctcaagaagaagaaaaagcctaagaaacctcgggaccctaaaatccctaagagcaagcgccaaaaaaaggagctgggggacagctctggggaggggccagagtttgtggaggaggaggaagaggtggctctgcgctcagacagtgagggcagcgactatactcctggcaagaagaagaagaagaagcttggacctaagaaagagaagaagagcaaatccaagcggaaggaggaggaggaggaggaggatgatgatgatgattcaaaggagcctaaatcatctgctcagctcctggaagactggggcatggaagacattgaccacgtgttctcagaggaggattatcgaaccctcaccaactacaaggccttcagccagtttgtcagacccctcattgctgccaaaaatcccaagattgctgtctccaagatgatgatggttttgggtgcaaaatggcgggagttcagtaccaataaccccttcaaaggcagttctggggcatcagtggcagctgcggcagcagcagcggtagctgtggtggagagcatggtgacagccactgaggttgcaccaccacctccccctgtggaggtgcctatccgcaaggccaagaccaaggagggcaaaggtcccaatgctcggaggaagcccaagggcagccctcgtgtacctgatgccaagaagcctaaacccaagaaagtagctcccctgaaaatcaagctgggaggttttggttccaagcgtaagagatcctcgagtgaggatgatgacttagatgtggaatctgacttcgatgatgccagtatcaatagctattctgtttctgatggttccaccagccgtagtagccgcagccgcaagaaactccgaaccactaaaaagaaaaagaaaggcgaggaggaggtgactgctgtggatggttatgagacagaccaccaggactattgcgaggtgtgccagcaaggcggtgagatcatcctgtgtgatacctgtccccgtgcttaccacatggtctgcctggatcccgacatggagaaggctcccgagggcaagtggagctgcccacactgcgagaaggaaggcatccagtgggaagctaaagaggacaattcggagggtgaggagatcctggaagaggttgggggagacctcgaagaggaggatgaccaccatatggaattctgtcgggtctgcaaggatggtggggaactgctctgctgtgatacctgtccttcttcctaccacatccactgcctgaatcccccacttccagagatccccaacggtgaatggctctgtccccgttgtacgtgtccagctctgaagggcaaagtgcagaagatcctaatctggaagtggggtcagccaccatctcccacaccagtgcctcggcctccagatgctgatcccaacacgccctccccaaagcccttggaggggcggccagagcggcagttctttgtgaaatggcaaggcatgtcttactggcactgctcctgggtttctgaactgcagctggagctgcactgtcaggtgatgttccgaaactatcagcggaagaatgatatggatgagccaccttctggggactttggtggtgatgaagagaaaagccgaaagcgaaagaacaaggaccctaaatttgcagagatggaggaacgcttctatcgctatgggataaaacccgagtggatgatgatccaccgaatcctcaaccacagtgtggacaagaagggccacgtccactacttgatcaagtggcgggacttaccttacgatcaggcttcttgggagagtgaggatgtggagatccaggattacgacctgttcaagcagagctattggaatcacagggagttaatgaggggtgaggaaggccgaccaggcaagaagctcaagaaggtgaagcttcggaagttggagaggcctccagaaacgccaacagttgatccaacagtgaagtatgagcgacagccagagtacctggatgctacaggtggaaccctgcacccctatcaaatggagggcctgaattggttgcgcttctcctgggctcagggcactgacaccatcttggctgatgagatgggccttgggaaaactgtacagacagcagtcttcctgtattccctttacaaggagggtcattccaaaggccccttcctagtgagcgcccctctttctaccatcatcaactgggagcgggagtttgaaatgtgggctccagacatgtatgtcgtaacctatgtgggtgacaaggacagccgtgccatcatccgagagaatgagttctcctttgaagacaatgccattcgtggtggcaagaaggcctcccgcatgaagaaagaggcatctgtgaaattccatgtgctgctgacatcctatgaattgatcaccattgacatggctattttgggctctattgattgggcctgcctcatcgtggatgaagcccatcggctgaagaacaatcagtctaagttcttccgggtattgaatggttactcactccagcacaagctgttgctgactgggacaccattacaaaacaatctggaagagttgtttcatctgctcaactttctcacccccgagaggttccacaatttggaaggttttttggaggagtttgctgacattgccaaggaggaccagataaaaaaactgcatgacatgctggggccgcacatgttgcggcggctcaaagccgatgtgttcaagaacatgccctccaagacagaactaattgtgcgtgtggagctgagccctatgcagaagaaatactacaagtacatcctcactcgaaattttgaagcactcaatgcccgaggtggtggcaaccaggtgtctctgctgaatgtggtgatggatcttaagaagtgctgcaaccatccatacctcttccctgtggctgcaatggaagctcctaagatgcctaatggcatgtatgatggcagtgccctaatcagagcatctgggaaattattgctgctgcagaaaatgctcaagaaccttaaggagggtgggcatcgtgtactcatcttttcccagatgaccaagatgctagacctgctagaggatttcttggaacatgaaggttataaatacgaacgcatcgatggtggaatcactgggaacatgcggcaagaggccattgaccgcttcaatgcaccgggtgctcagcagttctgcttcttgctttccactcgagctgggggccttggaatcaatctggccactgctgacacagttattatctatgactctgactggaacccccataatgacattcaggcctttagcagagctcaccggattgggcaaaataaaaaggtaatgatctaccggtttgtgacccgtgcgtcagtggaggagcgcatcacgcaggtggcaaagaagaaaatgatgctgacgcatctagtggtgcggcctgggctgggctccaagactggatctatgtccaaacaggagcttgatgatatcctcaaatttggcactgaggaactattcaaggatgaagccactgatggaggaggagacaacaaagagggagaagatagcagtgttatccactacgatgataaggccattgaacggctgctagaccgtaaccaggatgagactgaagacacagaattgcagggcatgaatgaatatttgagctcattcaaagtggcccagtatgtggtacgggaagaagaaatgggggaggaagaggaggtagaacgggaaatcattaaacaggaagaaagtgtggatcctgactactgggagaaattgctgcggcaccattatgagcagcagcaagaagatctagcccgaaatctgggcaaaggaaaaagaatccgtaaacaggtcaactacaatgatggctcccaggaggaccgagattggcaggacgaccagtccgacaaccagtccgattactcagtggcttcagaggaaggtgatgaagactttgatgaacgttcagaagctccccgtaggcccagtcgtaagggcctgcggaatgataaagataagccattgcctcctctgttggcccgtgttggtgggaatattgaagtacttggttttaatgctcgtcagcgaaaagcctttcttaatgcaattatgcgatatggtatgccacctcaggatgcttttactacccagtggcttgtaagagacctgcgaggcaaatcagagaaagagttcaaggcatatgtctctcttttcatgcggcatttatgtgagccgggggcagatggggctgagacctttgctgatggtgtcccccgagaaggcctgtctcgccagcatgtccttactagaattggtgttatgtctttgattcgcaagaaggttcaggagtttgaacatgttaatgggcgctggagcatgcctgaactggctgaggtggaggaaaacaagaagatgtcccagccagggtcaccctccccaaaaactcctacaccctccactccaggggacacgcagcccaacactcctgcacctgtcccacctgctgaagatgggataaaaatagaggaaaatagcctcaaagaagaagagagcatagaaggagaaaaggaggttaaatctacagcccctgagactgccattgagtgtacacaggcccctgcccctgcctcagaggatgaaaaggtcgttgttgaaccccctgagggagaggagaaagtggaaaaggcagaggtgaaggagagaacagaggaacctatggagacagagcccaaaggtgctgctgatgtagagaaggtggaggaaaagtcagcaatagatctgacccctattgtggtagaagacaaagaagagaagaaagaagaagaagagaaaaaagaggtgatgcttcagaatggagagacccccaaggacctgaatgatgagaaacagaagaaaaatattaaacaacgtttcatgtttaacattgcagatggtggttttactgagttgcactccctttggcagaatgaagagcgggcagccacagttaccaagaagacttatgagatctggcatcgacggcatgactactggctgctagccggcattataaaccatggctatgcccggtggcaagacatccagaatgacccacgctatgccatcctcaatgagcctttcaagggtgaaatgaaccgtggcaatttcttagagatcaagaataaatttctagctcgaaggtttaagctcttagaacaagctctggtgattgaggaacagctgcgccgggctgcttacttgaacatgtcagaagacccttctcacccttccatggccctcaacacccgctttgctgaggtggagtgtttggcggaaagtcatcagcacctgtccaaggagtcaatggcaggaaacaagccagccaatgcagtcctgcacaaagttctgaaacagctggaagaactgctgagtgacatgaaagctgatgtgactcgactcccagctaccattgcccgaattcccccagttgctgtgaggttacagatgtcagagcgtaacattctcagccgcctggcaaaccgggcacccgaacctaccccacagcaggtagcccagcagcagtgaagatgcagactgataccacctccaccgctgagcagtgaccttcctcactttctcttgtcccagcttctcccctgggggcctgagagaccctcaccttccttctgcccatcttccatgttgtaaaggaacagccccagtgcactgggggaggggagggagtgaggggcagtggtgcccttcctgcagaagagacatgcagcagtagcgctggcgccatctgcaggagctggcgggctggccttctggaccctggcttctccccactgtaacgcctgttacacacaaactgttgtgggttcctgccaggcttgaagaaaatgatctgaattttttcctccttttggttttattttgttggtttattttgtgttttcttttctcctttttggggggtattcagagtgggctgggcccctgggcgagacacagctacctctgttggcatctttttaataccaggaacccagcggctctagccactgagcggctaaatgaaataaagtggaaaaaaaaaaaaaggaaaaaaccaaaagcataaaaaaccacagcaaatttcttgatgaaaattgaaaataaaagtttccttgtatttt

SEQ ID NO: 1061 - DNA, 6554 bp, Homo sapiens
cgcggcgaggaggagccggagcgggagtgacaccgagccggacccagcgcgacctgcggcggctccgggtgactcgggccagtgtagaggtcctcaggccgccggcaggagcagctgggccaattccctggccgggagcggaaggggatggcgtcgggcctgggctccccgtccccctgctcggcgggcagtgaggaggaggatatggatgcacttttgaacaacagcctgcccccaccccacccagaggacccagaagaggatttgtcagaaacagagactccaaagctcaagaagaagaaaaagcctaagaaacctcgggaccctaaaatccctaagagcaagcgccaaaaaaaggagcgtatgctcttatgccggcagctgggggacagctctggggaggggccagagtttgtggaggaggaggaagaggtggctctgcgctcagacagtgagggcagcgactatactcctggcaagaagaagaagaagaagcttggacctaagaaagagaagaagagcaaatccaagcggaaggaggaggaggaggaggaggatgatgatgatgattcaaaggagcctaaatcatctgctcagctcctggaagactggggcatggaagacattgaccacgtgttctcagaggaggattatcgaaccctcaccaactacaaggccttcagccagtttgtcagacccctcattgctgccaaaaatcccaagattgctgtctccaagatgatgatggttttgggtgcaaaatggcgggagttcagtaccaataaccccttcaaaggcagttctggggcatcagtggcagctgcggcagcagcagcggtagctgtggtggagagcatggtgacagccactgaggttgcaccaccacctccccctgtggaggtgcctatccgcaaggccaagaccaaggagggcaaaggtcccaatgctcggaggaagcccaagggcagccctcgtgtacctgatgccaagaagcctaaacccaagaaagtagctcccctgaaaatcaagctgggaggttttggttccaagcgtaagagatcctcgagtgaggatgatgacttagatgtggaatctgacttcgatgatgccagtatcaatagctattctgtttctgatggttccaccagccgtagtagccgcagccgcaagaaactccgaaccactaaaaagaaaaagaaaggcgaggaggaggtgactgctgtggatggttatgagacagaccaccaggactattgcgaggtgtgccagcaaggcggtgagatcatcctgtgtgatacctgtccccgtgcttaccacatggtctgcctggatcccgacatggagaaggctcccgagggcaagtggagctgcccacactgcgagaaggaaggcatccagtgggaagctaaagaggacaattcggagggtgaggagatcctggaagaggttgggggagacctcgaagaggaggatgaccaccatatggaattctgtcgggtctgcaaggatggtggggaactgctctgctgtgatacctgtccttcttcctaccacatccactgcctgaatcccccacttccagagatccccaacggtgaatggctctgtccccgttgtacgtgtccagctctgaagggcaaagtgcagaagatcctaatctggaagtggggtcagccaccatctcccacaccagtgcctcggcctccagatgctgatcccaacacgccctccccaaagcccttggaggggcggccagagcggcagttctttgtgaaatggcaaggcatgtcttactggcactgctcctgggtttctgaactgcagctggagctgcactgtcaggtgatgttccgaaactatcagcggaagaatgatatggatgagccaccttctggggactttggtggtgatgaagagaaaagccgaaagcgaaagaacaaggaccctaaatttgcagagatggaggaacgcttctatcgctatgggataaaacccgagtggatgatgatccaccgaatcctcaaccacagtgtggacaagaagggccacgtccactacttgatcaagtggcgggacttaccttacgatcaggcttcttgggagagtgaggatgtggagatccaggattacgacctgttcaagcagagctattggaatcacagggagttaatgaggggtgaggaaggccgaccaggcaagaagctcaagaaggtgaagcttcggaagttggagaggcctccagaaacgccaacagttgatccaacagtgaagtatgagcgacagccagagtacctggatgctacaggtggaaccctgcacccctatcaaatggagggcctgaattggttgcgcttctcctgggctcagggcactgacaccatcttggctgatgagatgggccttgggaaaactgtacagacagcagtcttcctgtattccctttacaaggagggtcattccaaaggccccttcctagtgagcgcccctctttctaccatcatcaactgggagcgggagtttgaaatgtgggctccagacatgtatgtcgtaacctatgtgggtgacaaggacagccgtgccatcatccgagagaatgagttctcctttgaagacaatgccattcgtggtggcaagaaggcctcccgcatgaagaaagaggcatctgtgaaattccatgtgctgctgacatcctatgaattgatcaccattgacatggctattttgggctctattgattgggcctgcctcatcgtggatgaagcccatcggctgaagaacaatcagtctaagttcttccgggtattgaatggttactcactccagcacaagctgttgctgactgggacaccattacaaaacaatctggaagagttgtttcatctgctcaactttctcacccccgagaggttccacaatttggaaggttttttggaggagtttgctgacattgccaaggaggaccagataaaaaaactgcatgacatgctggggccgcacatgttgcggcggctcaaagccgatgtgttcaagaacatgccctccaagacagaactaattgtgcgtgtggagctgagccctatgcagaagaaatactacaagtacatcctcactcgaaattttgaagcactcaatgcccgaggtggtggcaaccaggtgtctctgctgaatgtggtgatggatcttaagaagtgctgcaaccatccatacctcttccctgtggctgcaatggaagctcctaagatgcctaatggcatgtatgatggcagtgccctaatcagagcatctgggaaattattgctgctgcagaaaatgctcaagaaccttaaggagggtgggcatcgtgtactcatcttttcccagatgaccaagatgctagacctgctagaggatttcttggaacatgaaggttataaatacgaacgcatcgatggtggaatcactgggaacatgcggcaagaggccattgaccgcttcaatgcaccgggtgctcagcagttctgcttcttgctttccactcgagctgggggccttggaatcaatctggccactgctgacacagttattatctatgactctgactggaacccccataatgacattcaggcctttagcagagctcaccggattgggcaaaataaaaaggtaatgatctaccggtttgtgacccgtgcgtcagtggaggagcgcatcacgcaggtggcaaagaagaaaatgatgctgacgcatctagtggtgcggcctgggctgggctccaagactggatctatgtccaaacaggagcttgatgatatcctcaaatttggcactgaggaactattcaaggatgaagccactgatggaggaggagacaacaaagagggagaagatagcagtgttatccactacgatgataaggccattgaacggctgctagaccgtaaccaggatgagactgaagacacagaattgcagggcatgaatgaatatttgagctcattcaaagtggcccagtatgtggtacgggaagaagaaatgggggaggaagaggaggtagaacgggaaatcattaaacaggaagaaagtgtggatcctgactactgggagaaattgctgcggcaccattatgagcagcagcaagaagatctagcccgaaatctgggcaaaggaaaaagaatccgtaaacaggtcaactacaatgatggctcccaggaggaccgaggtgtgtgtggccggccccgccccccacccatgggccgttccactagagcagtgggccccgctcatctgccctctctccctccagattggcaggacgaccagtccgacaaccagtccgattactcagtggcttcagaggaaggtgatgaagactttgatgaacgttcagaagctccccgtaggcccagtcgtaagggcctgcggaatgataaagataagccattgcctcctctgttggcccgtgttggtgggaatattgaagtacttggttttaatgctcgtcagcgaaaagcctttcttaatgcaattatgcgatatggtatgccacctcaggatgcttttactacccagtggcttgtaagagacctgcgaggcaaatcagagaaagagttcaaggcatatgtctctcttttcatgcggcatttatgtgagccgggggcagatggggctgagacctttgctgatggtgtcccccgagaaggcctgtctcgccagcatgtccttactagaattggtgttatgtctttgattcgcaagaaggttcaggagtttgaacatgttaatgggcgctggagcatgcctgaactggctgaggtggaggaaaacaagaagatgtcccagccagggtcaccctccccaaaaactcctacaccctccactccaggggacacgcagcccaacactcctgcacctgtcccacctgctgaagatgggataaaaatagaggaaaatagcctcaaagaagaagagagcatagaaggagaaaaggaggttaaatctacagcccctgagactgccattgagtgtacacaggcccctgcccctgcctcagaggatgaaaaggtcgttgttgaaccccctgagggagaggagaaagtggaaaaggcagaggtgaaggagagaacagaggaacctatggagacagagcccaaaggtgctgctgatgtagagaaggtggaggaaaagtcagcaatagatctgacccctattgtggtagaagacaaagaagagaagaaagaagaagaagagaaaaaagaggtgatgcttcagaatggagagacccccaaggacctgaatgatgagaaacagaagaaaaatattaaacaacgtttcatgtttaacattgcagatggtggttttactgagttgcactccctttggcagaatgaagagcgggcagccacagttaccaagaagacttatgagatctggcatcgacggcatgactactggctgctagccggcattataaaccatggctatgcccggtggcaagacatccagaatgacccacgctatgccatcctcaatgagcctttcaagggtgaaatgaaccgtggcaatttcttagagatcaagaataaatttctagctcgaaggtttaagctcttagaacaagctctggtgattgaggaacagctgcgccgggctgcttacttgaacatgtcagaagacccttctcacccttccatggccctcaacacccgctttgctgaggtggagtgtttggcggaaagtcatcagcacctgtccaaggagtcaatggcaggaaacaagccagccaatgcagtcctgcacaaagttctgaaacagctggaagaactgctgagtgacatgaaagctgatgtgactcgactcccagctaccattgcccgaattcccccagttgctgtgaggttacagatgtcagagcgtaacattctcagccgcctggcaaaccgggcacccgaacctaccccacagcaggtagcccagcagcagtgaagatgcagactgataccacctccaccgctgagcagtgaccttcctcactttctcttgtcccagcttctcccctgggggcctgagagaccctcaccttccttctgcccatcttccatgttgtaaaggaacagccccagtgcactgggggaggggagggagtgaggggcagtggtgcccttcctgcagaagagacatgcagcagtagcgctggcgccatctgcaggagctggcgggctggccttctggaccctggcttctccccactgtaacgcctgttacacacaaactgttgtgggttcctgccaggcttgaagaaaatgatctgaattttttcctccttttggttttattttgttggtttattttgtgttttcttttctcctttttggggggtattcagagtgggctgggcccctgggcgagacacagctacctctgttggcatctttttaataccaggaacccagcggctctagccactgagcggctaaatgaaataaagtggaaaaaaaaaaaaaggaaaaaaccaaaagcataaaaaaccacagcaaatttcttgatgaaaattgaaaataaaagtttccttgtatttt

SEQ ID NO: 1062 - DNA, 1317 bp, Homo sapiens
atgggctgtccgtgggggggcggggcctgtgcggtgggatttcccggccggtgtttcaggccctttaagaggcgacgctggagccggagccattttccccccttcggccgcggcgaggaggagccggagcgggagtgacaccgagccggacccagcgcgacctgcggcggctccgggtgactcgggccagtgtagaggtcctcaggccgccggcaggagcagctgggccaattccctggccgggagcggaaggggatggcgtcgggcctgggctccccgtccccctgctcggcgggcagtgaggaggaggatatggatgcacttttgaacaacagcctgcccccaccccacccagaaaatgaagaggacccagaagaggatttgtcagaaacagagactccaaagctcaagaagaagaaaaagcctaagaaacctcgggaccctaaaatccctaagagcaagcgccaaaaaaaggagcgtatgctcttatgccggcagctgggggacagctctggggaggggccagagtttgtggaggaggaggaagaggtggctctgcgctcagacagtgagggcagcgactatactcctggcaagaagaagaagaagaagcttggacctaagaaagagaagaagagcaaatccaagcggaaggaggaggaggaggaggaggatgatgatgatgattcaaaggagcctaaatcatctgctcagctcctggaagactggggcatggaagacattgaccacgtgttctcagaggaggattatcgaaccctcaccaactacaaggccttcagccagtttgtcagacccctcattgctgccaaaaatcccaagattgctgtctccaagatgatgatggttttgggtgcaaaatggcgggagttcagtaccaataaccccttcaaaggcagttctggggcatcagtggcagctgcggcagcagcagcggtagctgtggtggagagcatggtgacagccactgaggttgcaccaccacctccccctgtggaggtgcctatccgcaaggccaagaccaaggagggcaaaggtcccaatgctcggaggaagcccaagggcagccctcgtgtacctgatgccaagaagcctaaacccaagaaagtagctcccctgaaaatcaagctgggaggttttggttccaagcgtaagagatcctcgagtgaggatgatgacttagatgtggaatctgacttcgatgatgccagtatcaatagctattctgtttctgatggttccaccagccgtagtagccgcagccgcaagaaactccgaaccactaaaaagaaaaagaaa

SEQ ID NO: 1063 - DNA, 1317 bp, Homo sapiens; identical to SEQ ID NO: 1062

SEQ ID NO: 1064 - DNA, 4355 bp, Homo sapiens
ggctttggccctggaaagcctcgcggacgtgttctgacccaaggttttagcagtggatgtggcgttttcttccattccttctttcagtttttctgtactcgttgcttgcaattaagtgtaaatacttttgctagtggataatgggggaggcaaggactgagacctgcggtatgacgatagctctggctcttaatagtttgaggtaaagcgagatactctgagcttttgtctcccgtaaaaagggtggtgaatatgaataagggctttcttagcgttataagaattaaagggcatagttctgtggtgtgaaatctttaaaagatgttcagtaaataaaaatgattttcctccttcccctctcagacctctttttcttctttctttctttttttttgacaagttctcactcctctcacccaggctggagtctttctgaaagagttcttccgcttgttgttggctttcaactgttggatttgaggcgcttagcgccttcttcgtccgggtgcagcacattcttgattggtctcatgcctttgtggttgtaaatgtgcctggaatcctagcctttcatggtttgttctgagtaatgaataccctattactatgatactagtatcttccttaattatcctactcattgtctcaacattctgacagttggattgagcatattcaaattttgaaaattattgtagaaatgtttttacctcatatgaaccacctgacattggaacagactttcttttcacaagtgttaccaaagactgtgaaattattcgatgacatgatgtatgaattaaccagtcaagccagaggactgtcaagccaaaatttggaaatccagaccactctaaggaatattttacaaacaatggtgcagctcttaggagctctcacaggatgtgttcagcatatctgtgccacacaggaatccatcattttggaaaatattcagagtctcccctcctcagtccttcatataattaaaagcacatttgtgcattgtaagaatagtgaatctgtgtattctgggtgtttacacctagtttcagaccttctccaggctcttttcaaggaggcctattctcttcaaaagcagttaatggaactgctggacatggtttgcatggaccctttagtagatgacaatgatgatattttgaatatggtaatagttattcattctttattggatatctgctctgttatttccagtatggaccatgcatttcatgccaatacttggaagtttataattaagcagagccttaagcaccagtccataataaaaagccagttgaaacacaaagatataattactagcttgtgtgaagacattcttttctccttccattcttgtttacagttagctgagcagatgacacagtcagatgcacaggataatgctgactacagattatttcagaaaacactcaaattgtgtcgtttttttgccaactcccttttgcactacgctaaggaatttcttcctttcctctctgattcttgctgtactttgcaccaactgtatcttcagatacacagcaagtttcctccaagcctttatgctaccaggatttctaaagcacaccaagaggaaatagcaggtgctttcctagtgacactggatccacttatcagtcagctgctcacatttcagcctttcatgcaggtggttttggacagtaaattagacctgccatgtgaactgcagtttccacaatgtcttcttctggttgttgtcatggataagctgccatctcagcctaaggaagtgcaaaccctgtggtgcacagacagccaggtctcagaaacgacaaccaggatatctctactcaaagccgttttctacagttttgagcagtgttctggtgaactctctctacctgttcatttacagggattaaagagtaaggggaaagctgaggtggctgtcaccttgtatcagcatgtttgtgttcatctgtgtacatttattacttcctttcatccctcactgtttgctgaactggatgctgctctgctgaatgctgtacttagtgctaatatgatcacctctttgttagctatggatgcatggtgcttccttgctcgatatgggactgctgaactgtgtgcacaccatgtcaccatagtggctcatctgataaagtcatgccctggagaatgttatcaactcatcaacctatcaatactgttgaagcgtctctttttcttcatggcaccaccccatcagctggagtttatccagaaattttccccaaaagaagcagaaaatctgcctctgtggcaacatatttccttccaggcgttacctcctgagcttagggaacaaactgtccatgaggtcaccacagtaggcactgcagaatgcaggaaatggctgagcaggagtcgtactttgggagaactagaatctctgaacacagtactgtctgctttgcttgcagtatgtaattctgctggtgaagctttggatacaggaaaacaaactgcaattatcgaagttgtgagtcagctttgggcttttttaaacattaaacaggtagcagatcaaccttatgttcaacagacattcagccttttacttccactgttgggatttttcattcaaactctagatcctaaactgatacttcaggcagtaactttgcagacctcgctacttaaattagagcttcctgactatgttcgtttggcaatgttggattttgtatcttctttaggaaaactttttatacctgaagctatccaggacagaattctgcccaacctgtcctgtatgtttgccttactgctagctgacaggagttggctgctagaacaacataccttggaggcgtttactcagttcgctgagggaacaaatcatgaagagatagttccacagtgtctcagttctgaagaaactaagaacaaagttgtatcctttctggagaagactgggtttgtagatgaaactgaagctgccaaagtggaacgtgtgaaacaggaaaaaggtattttctgggaaccctttgctaatgtgactgtagaagaagcaaagaggtcatctttacagccttatgcaaaaagagctcgtcaggagttcccctgggaagaagagtacaggtcagcgctgcatacaatagcaggggctttggaagcaactgagtcactactccaaaagggtcctgctccagcctggctttcaatggaaatggaggcgctccaagaaaggatggataagctaaaacgttacatacatactctagggtgaaacttatcactaggcagaactgggtttgatgctttgtcaactgaaaatacttatgtctgtacattttctaacagatataaaacaaattttgtaaagttgaatctagtgaaaataatctttatttgacatttagagaacaggattgtggggaatattcttattaagaactttggtacaatgtactacatgtggaacagtcaggaactgcctaggtccacaaagaaccatttactcagatagtctaactgtaaacaaataaataagctgcctaaggaaacctcagcaatttaaaatcatttatataatttatagctaaaattttttaaagttgtatttcataatagagcttactcttatgttaaagaatggcacaaaattaagctaaccagcttgaattacattttctttacttccagaattgtcctggaaaaagcagtaaattcgacctctcctcagctacttgctcttcatagaaactggcctcagtcaaatgcacaaaggctcttcctcctggaaaccagtactgtgagcctcaccacccagggcttttagccagcactcacagtcagtctcctacttcagttggcacagactggataatgagctcctgggatgggaaaagcaggccactttggggttttcttgtcccaaagcctgcttttgaggtattgattttttttaaaaaaagggaatcctttttcctaaagtttaactcacatctattgtcaccagttattatcttcccagttcagctccccttcttcttcccagccttcagcctctccctgcaacaaaataaagcacaccaagaacccactgaaacaaatcatatgcaaaaatcatacgcaaatttgaaaaagcaggaatttaaaatttatcttttgatgccagaaacactacctcgtactaagtaaaataacttagagctctaacagaaagttgaaaagtaggattacaaaaccatggcactggaaaatagcttttcaaaaaccataaaatccagtaaaaatcagtgtggatgacaccaaatccttattttaatcccttttttttctttttcaaataaaaaggttacaatagctcattaaacaaa

SEQ ID NO: 1065 - DNA, 4002 bp, Homo sapiens
ttccggtctgggctttggcgggtctggtttgaagctctcctgtttgacgaaagtatgtctcaggaaggctggagtctttctgaaagagttcttccgcttgttgttggctttcaactgttggatttgaggcgcttagcgccttcttcgtccgggtgcagcacattcttgattggtctcatgcctttgtggttgtaaatgtgcctggaatcctagcctttcatggtttgttctgagtaatgaataccctattactatgatactagtatcttccttaattatcctactcattgtctcaacattctgacagttggattgagcatattcaaattttgaaaattattgtagaaatgtttttacctcatatgaaccacctgacattggaacagactttcttttcacaagtgttaccaaagactgtgaaattattcgatgacatgatgtatgaattaaccagtcaagccagaggactgtcaagccaaaatttggaaatccagaccactctaaggaatattttacaaacaatggtgcagctcttaggagctctcacaggatgtgttcagcatatctgtgccacacaggaatccatcattttggaaaatattcagagtctcccctcctcagtccttcatataattaaaagcacatttgtgcattgtaagaatagtgaatctgtgtattctgggtgtttacacctagtttcagaccttctccaggctcttttcaaggaggcctattctcttcaaaagcagttaatggaactgctggacatggtttgcatggaccctttagtagatgacaatgatgatattttgaatatggtaatagttattcattctttattggatatctgctctgttatttccagtatggaccatgcatttcatgccaatacttggaagtttataattaagcagagccttaagcaccagtccataataaaaagccagttgaaacacaaagatataattactagcttgtgtgaagacattcttttctccttccattcttgtttacagttagctgagcagatgacacagtcagatgcacaggataatgctgactacagattatttcagaaaacactcaaattgtgtcgtttttttgccaactcccttttgcactacgctaaggaatttcttcctttcctctctgattcttgctgtactttgcaccaactgtatcttcagatacacagcaagtttcctccaagcctttatgctaccaggatttctaaagcacaccaagaggaaatagcaggtgctttcctagtgacactggatccacttatcagtcagctgctcacatttcagcctttcatgcaggtggttttggacagtaaattagacctgccatgtgaactgcagtttccacaatgtcttcttctggttgttgtcatggataagctgccatctcagcctaaggaagtgcaaaccctgtggtgcacagacagccaggtctcagaaacgacaaccaggatatctctactcaaagccgttttctacagttttgagcagtgttctggtgaactctctctacctgttcatttacagggattaaagagtaaggggaaagctgaggtggctgtcaccttgtatcagcatgtttgtgttcatctgtgtacatttattacttcctttcatccctcactgtttgctgaactggatgctgctctgctgaatgctgtacttagtgctaatatgatcacctctttgttagctatggatgcatggtgcttccttgctcgatatgggactgctgaactgtgtgcacaccatgtcaccatagtggctcatctgataaagtcatgccctggagaatgttatcaactcatcaacctatcaatactgttgaagcgtctctttttcttcatggcaccaccccatcagctggagtttatccagaaattttccccaaaagaagcagaaaatctgcctctgtggcaacatatttccttccaggcgttacctcctgagcttagggaacaaactgtccatgaggtcaccacagtaggcactgcagaatgcaggaaatggctgagcaggagtcgtactttgggagaactagaatctctgaacacagtactgtctgctttgcttgcagtatgtaattctgctggtgaagctttggatacaggaaaacaaactgcaattatcgaagttgtgagtcagctttgggcttttttaaacattaaacaggtagcagatcaaccttatgttcaacagacattcagccttttacttccactgttgggatttttcattcaaactctagatcctaaactgatacttcaggcagtaactttgcagacctcgctacttaaattagagcttcctgactatgttcgtttggcaatgttggattttgtatcttctttaggaaaactttttatacctgaagctatccaggacagaattctgcccaacctgtcctgtatgtttgccttactgctagctgacaggagttggctgctagaacaacataccttggaggcgtttactcagttcgctgagggaacaaatcatgaagagatagttccacagtgtctcagttctgaagaaactaagaacaaagttgtatcctttctggagaagactgggtttgtagatgaaactgaagctgccaaagtggaacgtgtgaaacaggaaaaaggtattttctgggaaccctttgctaatgtgactgtagaagaagcaaagaggtcatctttacagccttatgcaaaaagagctcgtcaggagttcccctgggaagaagagtacaggtcagcgctgcatacaatagcaggggctttggaagcaactgagtcactactccaaaagggtcctgctccagcctggctttcaatggaaatggaggcgctccaagaaaggatggataagctaaaacgttacatacatactctagggtgaaacttatcactaggcagaactgggtttgatgctttgtcaactgaaaatacttatgtctgtacattttctaacagatataaaacaaattttgtaaagttgaatctagtgaaaataatctttatttgacatttagagaacaggattgtggggaatattcttattaagaactttggtacaatgtactacatgtggaacagtcaggaactgcctaggtccacaaagaaccatttactcagatagtctaactgtaaacaaataaataagctgcctaaggaaacctcagcaatttaaaatcatttatataatttatagctaaaattttttaaagttgtatttcataatagagcttactcttatgttaaagaatggcacaaaattaagctaaccagcttgaattacattttctttacttccagaattgtcctggaaaaagcagtaaattcgacctctcctcagctacttgctcttcatagaaactggcctcagtcaaatgcacaaaggctcttcctcctggaaaccagtactgtgagcctcaccacccagggcttttagccagcactcacagtcagtctcctacttcagttggcacagactggataatgagctcctgggatgggaaaagcaggccactttggggttttcttgtcccaaagcctgcttttgaggtattgattttttttaaaaaaagggaatcctttttcctaaagtttaactcacatctattgtcaccagttattatcttcccagttcagctccccttcttcttcccagccttcagcctctccctgcaacaaaataaagcacaccaagaacccactgaaacaaatcatatgcaaaaatcatacgcaaatttgaaaaagcaggaatttaaaatttatcttttgatgccagaaacactacctcgtactaagtaaaataacttagagctctaacagaaagttgaaaagtaggattacaaaaccatggcactggaaaatagcttttcaaaaaccataaaatccagtaaaaatcagtgtggatgacaccaaatccttattttaatcccttttttttctttttcaaataaaaaggttacaatagctcattaaacaaa

SEQ ID NO: 1066 - DNA, 1697 bp, Homo sapiens
actgcgagtttccggtctgggctttggcgggtctggtttgaagctctcctgtttgacgaaagtatgtctcaggaaggtgcggtcccagctagcgcggttcccctggaagaattaagtagctggccagaggagctatgccgccgggaactgccgtccgtcctgccccgactcctctcattgtctcaacattctgacagttggattgagcatattcactgtgaaattattcgatgacatgatgtatgaattaaccagtcaagccagaggactgtcaagccaaaatttggaaatccagaccactctaaggaatattttacaaacaatggtgcagctcttaggagctctcacaggatgtgttcagcatatctgtgccacacaggaatccatcattttggaaaatattcagagtctcccctcctcagtccttcatataattaaaagcacatttgtgcattgtaagaatagtgaatctgtgtattctgggtgtttacacctagtttcagaccttctccaggctcttttcaaggaggcctattctcttcaaaagcagttaatggaactgctggacatggtttgcatggaccctttagtagatgacaatgatgatattttgaatatggtaatagttattcattctttattggatatctgctctgttatttccagtatggaccatgcatttcatgccaatacttggaagtttataattaagcagagccttaagcaccagtccataataaaaagccagttgaaacacaaagatataattactagcttgtgtgaagacattcttttctccttccattcttgtttacagttagctgagcagatgacacagtcagatgcacaggataatgctgactacagattatttcagaaaacactcaaattgtgtcgtttttttgccaactcccttttgcactacgctaaggaatttcttcctttcctctctgattcttgctgtactttgcaccaactgtatcttcagatacacagcaagtttcctccaagcctttatgctaccaggatttctaaagcacaccaagaggaaatagcaggtgctttcctagtgacactggatccacttatcagtcagctgctcacatttcagcctttcatgcaggtggttttggacagtaaattaggatatctctactcaaagccgttttctacagttttgagcagtgttctggtgaactctctctacctgttcatttacagggattaaagagtaaggggaaagctgaggtggctgtcaccttgtatcagcatgtttgtgttcatctgtgtacatttattacttcctttcatccctcactgtttgctgaactggtaagcatattacttactgtgctaagctaaggttacacttttgctttctcttcattgaaattgtgattcatatacagaagaaaatgtgggaatacttagtatattccttttgagtgaaacttagttgtgtcctagaaaatggtaatcccagattcctgtattatttagatctaatatttggctaaaatatttgagaaaacattttgggtggggaggtatgcaaagacaatgtgagaagaggaaaaatatgtagtacttaagtaagtttcaaaagaaaagtaaatagcttgtagtatcaggtctcttatagatctcagacataatatagattttaaaaaggatagaatttgatttgaaaagaggtt

SEQ ID NO: 1067 - DNA, 1071 bp, Homo sapiens
gaagctctcctgtttgacgaaagtatgtctcaggaaggtgcggtcccagctagcgcggttcccctggaagaattaagtagctggccagaggagctatgccgccgggaactgccgtccgtcctgccccgactcctctcattgtctcaacattctgacagttggattgagcatattcaaattttgaaaattattgtagaaatgtttttacctcatatgaaccacctgacattggaacagactttcttttcacaagtgttaccaaagactgtgaaattattcgatgacatgatgtatgaattaaccagtcaagccagaggactgtcaagccaaaatttggaaatccagaccactctaaggaatattttacaaacaatggtgcagctcttaggagctctcacaggatgtgttcagcatatctgtgccacacaggaatccatcattttggaaaatattcagagtctcccctcctcagtccttcatataattaaaagcacatttgtgcattgtaagaatagtgaatctgtgtattctgggtgtttacacctagtttcagaccttctccaggctcttttcaaggaggcctattctcttcaaaagcagttaatggaactgctggacatggtttgcatggaccctttagtagatgacaatgatgatattttgaatatggtaatagttattcattctttattggatatctgctctgttatttccagtatggaccatgcatttcatgccaatacttggaagtttataattaagcagagccttaagcaccagtccataataaaaagccagttgaaacacaaagatataattactagcttgtgtgaagacattcttttctccttccattcttgtttacagttagctgagcagatgacacagtcagatgcacaggataatgctgactacagattatttcagaaaacactcaaattgtgtcgtttttttgccaactcccttttgcactacgctaaggaatttcttcctttcctctctgattcttgctgtactttgcaccaactgtatcttcagatacacagatggagtttcgctcttgctgtctag

SEQ ID NO: 1068 - DNA, 3076 bp, Homo sapiens
attctgagcctagccacagaggtaaactccggacatttttttctttcatgtcgccaaatacatccttgtcattaaaagacctttgaaactgagtaaaatggctttgaaacctcagtagaatatgctcaaactgtctggagaaggattacgggacagctaccacagtagaagagatcaaattgcccttaaaaatctccagtctgatgtcacagaggcaaaatctgacttcaccaaggagaccctggcatcacaaaacacaaaaatgatttcatccatagtcatctcccagatgattgatgagaataagtcaagagaaaacagggcctccttgcccctaccgtgtgccattgctcagtctcgtgcacatcacgccaagcaatctctggctaaccgcagcggagtcaacattcacagagcatttgcgttacttccgggcagattaggaatcccggcaccgtcagatgagcgaggacctgaggcagagctgccgcccaaagaggagagaccctgtgggggcccccgcagagggtttgcatccatcaccatcacggccagacgcgtgggccccccagcccgcgccctggtgtgggggactgctggggactctctgtgccccaagtgcagggctgaggacacactgttccaggcgcccccggctctggccaatggcgcccatccaggtcggcatcagagatcttttgcctgcacagagttctccagaaacagctccgtggtgcggctgaaggttcccgaggcccacactgggttgtgtgagagacgcaagtactgggtcacccatgcagacgacaaagagaccagtttttctccagacaccccactgtcaggaaagagcccgctggtgttcagttcctgtgtccacctcagggtgtctcagcagtgtccagattcaatctattacgtagacaagtctctctccgtccccattgagccacctcaaattgccagccccaaaatgcacagatccgtcctgtcgctcaacctcaattgtagttcccacagattaacagcagatggagtagatggcctagtgaacagagagccaataagcgaagccctgaagcaggagctcctggagggagaccaggacctcgtaggccagcgctggaacccaggtttacaagaaagtcacttgaaggaaaccccatcgttgaggcgggtgcatttggggaccggcgcttgtccttggagtggttcttttccattggaaaacacagaattggcaaatgtgggagctaaccaagtcactgtaagaaaaggggaaaaggaccatacaactcattgtcacgccagcgatcatgccaaccaactgtccattcacattcctggctggagttacagggcagtacacacaaaagtattttctggaagcagcaagaggcaacaaggagaagtatgtatgactgtgtctgctcctccagtggaacagaagcccactagacatttccttcccattggggatagctctccaagcgatgactgtctgtctagagacctttctgagcccacagagagacgacatcaaagcttcctgaaacccagaatcctttttcctgggtttctttgccccttacaagatgtatgtgcatctctgcaggaagacaatggtgttcagatagaaagcaagttccccaaaggagattacacatgctgtgacttggttgtaaaaataaaggaatgtaagaagagtgaggaccccaccacacctgagccctccccagcagcaccctcgccagcaccccgcgatggagcagggagccctggcctgtccgaagactgttctgagtctcagcaaacgcctgcaagatctttgaccttgcaagaagcactggaagttcgtaagcctcagttcatttctcgctcacaagaacggctgaagaagcttgaacacatggtccagcagaggaaagcccagcggaaggaggacctgaggcagaagcagagcctccttcccatccgcaccagcaagaagcagttcacgattccccatcctctgagtgataacttgttcaaacccaaagaacggtgcatttcagagaaggagatgcatatgcgatctaagagaatctatgataacttgccggaagttaaaaagaaaaaagaagaacaaaggaaaagggtgatcttacaaagtaacagactccgtgccgaagtcttcaaaaagcaattactggaccagctccttcaaaggaatgcggtctaaccacaggctgccctgctgaccacactacctggacctgggaggacttcgaatgctggataagccattaaacttagcattatcttcatcatgggaaaacacttattttactttcgattttttttttccataaaggaaaacatcacttcctgaattactgacccaagccaaacagaaacaataaccctcgagaaaataggtcaacaatctgttgtggggaaaccacctccatgtaacccactggatacagtccccttaatgtttttgcttctaaattgtaccttttgcttctgatttcttctcccctgctgtttcctgcccatcagagaggcctgatacaagcaagtttgtttacatccctggggaatcttttacatcaaacttttgggatccaaatccatctccttttaaatttcaatctcagcacctgccagttatgcaaatgccaaaatgtgggtcatcatatagtatatttgaaacctttctgaacatgtacaccacccaatgctagaggctgacttggaaaccggtgggtgcaatgcccgaggctgtggaacaatcagcccatctctttgtgacctggagcagtcagagggccctcagtcaccccgccccattcctcaccagagaaaagaatccatttctatggaagctctgacgtaacttcagtgttttctacaatactcctcctgccccgccccattaaaacagttcttttgttaagaaatagcctaatggtccaactttgctgtctgttcttccaaatgtttataatacacattatttataaatatgtctgtttgggaagctaagaacaagctagtttttacaacacaaatggaaataaatgcaattatt

SEQ ID NO: 1069 - DNA, 3678 bp, Homo sapiens
gggaagatggccatgtgcaggtggaggcagagattagagaggggctgtcccaagccgagggacacagaggatgccagacaccacgggacactgagaagggcaaggaagggtcctcccctagggccttcagagggagcacggtcctgacacctggatttctggcctccagaactgggaaggagtaaatccctgttgtatccagctgctccctttgtagtcacttttcacagcagcgctgggaacgaacgcaggcaccaatccagcttgggggccatgtggggtagcagcggatcgggacttccttctaagagaagcgatcttgagccgtgtcacgggtgaggagttaggagttagctcagtggggaaaaggtgaaggcagcactcacggtcatcaagccagcccctgtgggaagcaggctgggtttaaggatttctaacctgggctccttgaactcccagggtccccctacatgtgtgcttcaattttgcaccttttcttggggagaaacgaatcccttgcatttgagttttggaggaccatgtggccttcacggtcacaaactggcaatgtcaagaaggtttggcaggaccggctgggagatgaggctggtggggtcaccagcttgattgtgaccttgctgacaccagcagggcagggaggtgaactgacgcaatggagcagagcctttgtctcaggagcaaaccagccttggctttcagttggatgttggaggattacgggacagctaccacagtagaagagatcaaattgcccttaaaaatctccagtctgatgtcacagaggcaaaatctgacttcaccaaggagaccctggcatcacaaaacacaaaaatgatttcatccatagtcatctcccagatgattgatgagaataagtcaagagaaaacagggcctccttgcccctaccgtgtgccattgctcagtctcgtgcacatcacgccaagcaatctctggctaaccgcagcggagtcaacattcacagagcatttgcgttacttccgggcagattaggaatcccggcaccgtcagatgagcgaggacctgaggcagagctgccgcccaaagaggagagaccctgtgggggcccccgcagagggtttgcatccatcaccatcacggccagacgcgtgggccccccagcccgcgccctggtgtgggggactgctggggactctctgtgccccaagtgcagggctgaggacacactgttccaggcgcccccggctctggccaatggcgcccatccaggtcggcatcagagatcttttgcctgcacagagttctccagaaacagctccgtggtgcggctgaaggttcccgaggcccacactgggttgtgtgagagacgcaagtactgggtcacccatgcagacgacaaagagaccagtttttctccagacaccccactgtcaggaaagagcccgctggtgttcagttcctgtgtccacctcagggtgtctcagcagtgtccagattcaatctattacgtagacaagtctctctccgtccccattgagccacctcaaattgccagccccaaaatgcacagatccgtcctgtcgctcaacctcaattgtagttcccacagattaacagcagatggagtagatggcctagtgaacagagagccaataagcgaagccctgaagcaggagctcctggagggagaccaggacctcgtaggccagcgctggaacccaggtttacaagaaagtcacttgaaggaaaccccatcgttgaggcgggtgcatttggggaccggcgcttgtccttggagtggttcttttccattggaaaacacagaattggcaaatgtgggagctaaccaagtcactgtaagaaaaggggaaaaggaccatacaactcattgtcacgccagcgatcatgccaaccaactgtccattcacattcctggctggagttacagggcagtacacacaaaagtattttctggaagcagcaagaggcaacaaggagaagtatgtatgactgtgtctgctcctccagtggaacagaagcccactagacatttccttcccattggggatagctctccaagcgatgactgtctgtctagagacctttctgagcccacagagagacgacatcaaagcttcctgaaacccagaatcctttttcctgggtttctttgccccttacaagatgtatgtgcatctctgcaggaagacaatggtgttcagatagaaagcaagttccccaaaggagattacacatgctgtgacttggttgtaaaaataaaggaatgtaagaagagtgaggaccccaccacacctgagccctccccagcagcaccctcgccagcaccccgcgatggagcagggagccctggcctgtccgaagactgttctgagtctcagcaaacgcctgcaagatctttgaccttgcaagaagcactggaagttcgtaagcctcagttcatttctcgctcacaagaacggctgaagaagcttgaacacatggtccagcagaggaaagcccagcggaaggaggacctgaggcagaagcagagcctccttcccatccgcaccagcaagaagcagttcacgattccccatcctctgagtgataacttgttcaaacccaaagaacggtgcatttcagagaaggagatgcatatgcgatctaagagaatctatgataacttgccggaagttaaaaagaaaaaagaagaacaaaggaaaagggtgatcttacaaagtaacagactccgtgccgaagtcttcaaaaagcaattactggaccagctccttcaaaggaatgcggtctaaccacaggctgccctgctgaccacactacctggacctgggaggacttcgaatgctggataagccattaaacttagcattatcttcatcatgggaaaacacttattttactttcgattttttttttccataaaggaaaacatcacttcctgaattactgacccaagccaaacagaaacaataaccctcgagaaaataggtcaacaatctgttgtggggaaaccacctccatgtaacccactggatacagtccccttaatgtttttgcttctaaattgtaccttttgcttctgatttcttctcccctgctgtttcctgcccatcagagaggcctgatacaagcaagtttgtttacatccctggggaatcttttacatcaaacttttgggatccaaatccatctccttttaaatttcaatctcagcacctgccagttatgcaaatgccaaaatgtgggtcatcatatagtatatttgaaacctttctgaacatgtacaccacccaatgctagaggctgacttggaaaccggtgggtgcaatgcccgaggctgtggaacaatcagcccatctctttgtgacctggagcagtcagagggccctcagtcaccccgccccattcctcaccagagaaaagaatccatttctatggaagctctgacgtaacttcagtgttttctacaatactcctcctgccccgccccattaaaacagttcttttgttaagaaatagcctaatggtccaactttgctgtctgttcttccaaatgtttataatacacattatttataaatatgtctgtttgggaagctaagaacaagctagtttttacaacacaaatggaaataaatgcaattattataaaaattcaa

SEQ ID NO: 1070 - DNA, 2035 bp, Homo sapiens
ctctcacacatgccctccctcgatggcccccagctcttgtaggacaagccctcatggcagagctagatggcaccctaggggccatacaggtgcgtgcactccttgcctcgcggatgaggaagatgagcccagaggaggagctgacatggctgagtggccaggtgggatctggagcctagtgtccttgccgtctggacccctcccagcatatcatgctgtgtcctactaaggctcccaaaatggggacaaacttttcatctttcagcttctcccagtgcaccttcttgctgcctaagccctgactctctgcttaggtttcaaaaaatgagacaactcatgagagaaaagaaaatggtcagatccgcaatgcatggaaaaatatctctttatgtgtgtcatctcctcaagactcccaacaaagcctatgccagcctctctcttacagaggaacaaacagaggccaggaggttacgtggctcgtccaaggctagacagcattaaaatgtggtggcaccaagagtcaacctggaccaggcgtcaaaactcaagctgttctacttttaccttctcctaatcatgtacagtgattattcatattgcaaactcgcagctttagtcttactggaggggtgacacctggattacgggacagctaccacagtagaagagatcaaattgcccttaaaaatctccagtctgatgtcacagaggcaaaatctgacttcaccaaggagaccctggcatcacaaaacacaaaaatgatttcatccatagtcatctcccagatgattgatgagaataagtcaagagaaaacagggcctccttgcccctaccgtgtgccattgctcagtctcgtgcacatcacgccaagcaatctctggctaaccgcagcggagtcaacattcacagagcatttgcgttacttccgggcagattaggaatcccggcaccgtcagatgagcgaggacctgaggcagagctgccgcccaaagaggagagaccctgtgggggcccccgcagagggtttgcatccatcaccatcacggccagacgcgtgggccccccagcccgcgccctggtgtgggggactgctggggactctctgtgccccaagtgcagggctgaggacacactgttccaggcgcccccggctctggccaatggcgcccatccaggtcggcatcagagatcttttgcctgcacagagttctccagaaacagctccgtggtgcggctgaaggttcccgaggcccacactgggttgtgtgagagacgcaagtactgggtcacccatgcagacgacaaagagaccagtttttctccagacaccccactgtcaggaaagagcccgctggtgttcagttcctgtgtccacctcagggtgtctcagcagtgtccagattcaatctattacgtagacaagtctctctccgtccccattgagccacctcaaattgccagccccaaaatgcacagatccgtcctgtcgctcaacctcaattgtagttcccacagattaacagcagatggagtagatggcctagtgaacagagagccaataagcgaagccctgaagcaggagctcctggagggagaccaggacctcgtaggccagcgctggaacccaggtttacaagaaagtcacttgaaggaaaccccatcgttgaggcgggtgcatttggggaccggcgcttgtccttggagtggttcttttccattggaaaacacagaattggcaaatgtgggagctaaccaagtcactgtaagaaaaggggaaaaggaccatacaactcattgtcacgccagcgatcatgccaaccaactgtccattcacattcctggctggagttacagggcagacttattacaagaaggacaacataagcagctatcaatgttccaaagataaatcccactttagtggttaaagagattgctcaagctaagcacttcgtcttccttattgatgatgattccagaaatacaccactgcattgttgtatgttaccccagttaaagcacatcctcattttt

SEQ ID NO: 1071 - DNA, 1414 bp, Homo sapiens
attctgagcctagccacagaggtaaactccggacatttttttctttcatgtcgccaaatacatccttgtcattaaaagacctttgaaactgagtaaaatggctttgaaacctcagtagaatatgctcaaactgtctggagaaggattacgggacagctaccacagtagaagagatcaaattgcccttaaaaatctccagtctgatgtcacagaggcaaaatctgacttcaccaaggagaccctggcatcacaaaacacaaaaatgatttcatccatagtcatctcccagatgattgatgagaataagtcaagagaaaacagggcctccttgcccctaccgtgtgccattgctcagtctcgtgcacatcacgccaagcaatctctggctaaccgcagcggagtcaacattcacagagcatttgcgttacttccgggcagattaggaatcccggcaccgtcagatgagcgaggacctgaggcagagctgccgcccaaagaggagagaccctgtgggggcccccgcagagggtttgcatccatcaccatcacggccagacgcgtgggccccccagcccgcgccctggtgtgggggactgctggggactctctgtgccccaagtgcagggctgaggacacactgttccaggcgcccccggctctggccaatggcgcccatccaggtcggcatcagagatcttttgcctgcacagagttctccagaaacagctccgtggtgcggctgaaggttcccgaggcccacactgggttgtgtgagagacgcaagtactgggtcacccatgcagacgacaaagagaccagtttttctccagacaccccactgtcaggaaagagcccgctggtgttcagttcctgtgtccacctcagggtgtctcagcagtgtccagattcaatctattacgtagacaagtctctctccgtccccattgagccacctcaaattgccagccccaaaatgcacagatccgtcctgtcgctcaacctcaattgtagttcccacagattaacagcagatggagtagatggcctagtgaacagagagccaataagcgaagccctgaagcaggagctcctggagggagaccaggacctcgtaggccagcgctggaacccaggtttacaagaaagtcacttgaaggaaaccccatcgttgaggcgggtgcatttggggaccggcgcttgtccttggagtggttcttttccattggaaaacacagaattggcaaatgtgggagctaaccaagtcactgtaagaaaaggggaaaaggaccatacaactcattgtcacgccagcgatcatgccaaccaactgtccattcacattcctggctggagttacagggcagacttattacaagaaggacaacataagcagctatcaatgttccaaagataa

SEQ ID NO: 1072 - DNA, 1595 bp, Homo sapiens
cttggagtggttcttttccattggaaaacacagaattggcaaatgtgggagctaaccaagtcactgtaagaaaaggggaaaaggaccatacaactcattgtcacgccagcgatcatgccaaccaactgtccattcacattcctggctggagttacagggcaggagattacacatgctgtgacttggttgtaaaaataaaggaatgtaagaagagtgaggaccccaccacacctgagccctccccagcagcaccctcgccagcaccccgcgatggagcagggagccctggcctgtccgaagactgttctgagtctcagcaaacgcctgcaagatctttgaccttgcaagaagcactggaagttcgtaagcctcagttcatttctcgctcacaagaacggctgaagaagcttgaacacatggtccagcagaggaaagcccagcggaaggaggacctgaggcagaagcagagcctccttcccatccgcaccagcaagaagcagttcacgattccccatcctctgagtgataacttgttcaaacccaaagaacggtgcatttcagagaaggagatgcatatgcgatctaagagaatctatgataacttgccggaagttaaaaagaaaaaagaagaacaaaggaaaagggtgatcttacaaagtaacagactccgtgccgaagtcttcaaaaagcaattactggaccagctccttcaaaggaatgcggtctaaccacaggctgccctgctgaccacactacctggacctgggaggacttcgaatgctggataagccattaaacttagcattatcttcatcatgggaaaacacttattttactttcgattttttttttccataaaggaaaacatcacttcctgaattactgacccaagccaaacagaaacaataaccctcgagaaaataggtcaacaatctgttgtggggaaaccacctccatgtaacccactggatacagtccccttaatgtttttgcttctaaattgtaccttttgcttctgatttcttctcccctgctgtttcctgcccatcagagaggcctgatacaagcaagtttgtttacatccctggggaatcttttacatcaaacttttgggatccaaatccatctccttttaaatttcaatctcagcacctgccagttatgcaaatgccaaaatgtgggtcatcatatagtatatttgaaacctttctgaacatgtacaccacccaatgctagaggctgacttggaaaccggtgggtgcaatgcccgaggctgtggaacaatcagcccatctctttgtgacctggagcagtcagagggccctcagtcaccccgccccattcctcaccagagaaaagaatccatttctatggaagctctgacgtaacttcagtgttttctacaatactcctcctgccccgccccattaaaacagttcttttgttaagaaatagcctaatggtccaactttgctgtctgttcttccaaatgtttataatacacattatttataaatatgtctgtttgggaagctaagaacaagctagtttttacaacacaaatggaaataaatgcaattattataaaaattcaa

SEQ ID NO: 1073 - DNA, 2107 bp, Homo sapiens
attctgagcctagccacagaggtaaactccggacatttttttctttcatgtcgccaaatacatccttgtcattaaaagacctttgaaactgagtaaaatggctttgaaacctcagtagaatatgctcaaactgtctggagaaggattacgggacagctaccacagtagaagagatcaaattgcccttaaaaatctccagtctgatgtcacagaggcaaaatctgacttcaccaaggagaccctggcatcacaaaacacaaaaatgatttcatccatagtcatctcccagatgattgatgagaataagtcaagagaaaacagggcctccttgcccctaccgtgtgccattgctcagtctcgtgcacatcacgccaagcaatctctggctaaccgcagcggagtcaacattcacagagcatttgcgttacttccgggcagattaggaatcccggcaccgtcagatgagcgaggacctgaggcagagctgccgcccaaagaggagagaccctgtgggggcccccgcagagggtttgcatccatcaccatcacggccagacgcgtgggccccccagcccgcgccctggtgtgggggactgctggggactctctgtgccccaagtgcagggctgaggacacactgttccaggcgcccccggctctggccaatggcgcccatccaggtcggcatcagagatcttttgcctgcacagagttctccagaaacagctccgtggtgcggctgaaggttcccgaggcccacactgggttgtgtgagagacgcaagtactgggtcacccatgcagacgacaaagagaccagtttttctccagacaccccactgtcaggaaagagcccgctggtgttcagttcctgtgtccacctcagggtgtctcagcagtgtccagattcaatctattacgtagacaagtctctctccgtccccattgagccacctcaaattgccagccccaaaatgcacagatccgtcctgtcgctcaacctcaattgtagttcccacagattaacagcagatggagtagatggcctagtgaacagagagccaataagcgaagccctgaagcaggagctcctggagggagaccaggacctcgtaggccagcgctggaacccaggtttacaagaaagtcacttgaaggaaaccccatcgttgaggcgggtgcatttggggaccggcgcttgtccttggagtggttcttttccattggaaaacacagaattggcaaatgtgggagctaaccaagtcactgtaagaaaaggggaaaaggaccatacaactcattgtcacgccagcgatcatgccaaccaactgtccattcacattcctggctggagttacagggcagtacacacaaaagtattttctggaagcagcaagaggcaacaaggagaagtatgtatgactgtgtctgctcctccagtggaacagaagcccactagacatttccttcccattggggatagctctccaagcgatgactgtctgtctagagacctttctgagcccacagagagacgacatcaaagcttcctgaaacccagaatcctttttcctgggtttctttgccccttacaagatgtatgtgcatctctgcaggaagacaatggtgttcagatagaaagcaagttccccaaaggagattacacatgctgtgacttggttgtaaaaataaaggaatgtaagaagagtgaggaccccaccacacctgagccctccccagcagcaccctcgccagcaccccgcgatggagcagggagccctggcctgtccgaagactgttctgagtctcagcaaacgcctgcaagatctttgaccttgcaagaagcactggaagttcgtaagcctcagttcatttctcgctcacaagaacggctgaagaagcttgaacacatggtccagcagaggaaagcccagcggaaggaggacctgaggcagaagcagagcctccttcccatccgcaccagcaagaagcagttcacgattccccatcctctgagtgataacttgttcaaacccaaagaacggtgcatttcagagaaggagatgcatatgcgatctaagagaatctatgataacttgccggaagtt

SEQ ID NO: 1074 - DNA, 2785 bp, Homo sapiens
attctgagcctagccacagaggtaaactccggacatttttttctttcatgtcgccaaatacatccttgtcattaaaagacctttgaaactgagtaaaatggctttgaaacctcagtagaatatgctcaaactgtctggagaaggattacgggacagctaccacagtagaagagatcaaattgcccttaaaaatctccagtctgatgtcacagaggcaaaatctgacttcaccaaggagaccctggcatcacaaaacacaaaaatgatttcatccatagtcatctcccagatgattgatgagaataagtcaagagaaaacagggcctccttgcccctaccgtgtgccattgctcagtctcgtgcacatcacgccaagcaatctctggctaaccgcagcggagtcaacattcacagagcatttgcgttacttccgggcagattaggaatcccggcaccgtcagatgagcgaggacctgaggcagagctgccgcccaaagaggagagaccctgtgggggcccccgcagagggtttgcatccatcaccatcacggccagacgcgtgggccccccagcccgcgccctggtgtgggggactgctggggactctctgtgccccaagtgcagggctgaggacacactgttccaggcgcccccggctctggccaatggcgcccatccaggtcggcatcagagatcttttgcctgcacagagttctccagaaacagctccgtggtgcggctgaaggttcccgaggcccacactgggttgtgtgagagacgcaagtactgggtcacccatgcagacgacaaagagaccagtttttctccagacaccccactgtcaggaaagagcccgctggtgttcagttcctgtgtccacctcagggtgtctcagcagtgtccagattcaatctattacgtagacaagtctctctccgtccccattgagccacctcaaattgccagccccaaaatgcacagatccgtcctgtcgctcaacctcaattgtagttcccacagattaacagcagatggagtagatggcctagtgaacagagagccaataagcgaagccctgaagcaggagctcctggagggagaccaggacctcgtaggccagcgctggaacccaggtttacaagaaagtcacttgaaggaaaccccatcgttgaggcgggtgcatttggggaccggcgcttgtccttggagtggttcttttccattggaaaacacagaattggcaaatgtgggagctaaccaagtcactgtaagaaaaggggaaaaggaccatacaactcattgtcacgccagcgatcatgccaaccaactgtccattcacattcctggctggagttacagggcaggagattacacatgctgtgacttggttgtaaaaataaaggaatgtaagaagagtgaggaccccaccacacctgagccctccccagcagcaccctcgccagcaccccgcgatggagcagggagccctggcctgtccgaagactgttctgagtctcagcaaacgcctgcaagatctttgaccttgcaagaagcactggaagttcgtaagcctcagttcatttctcgctcacaagaacggctgaagaagcttgaacacatggtccagcagaggaaagcccagcggaaggaggacctgaggcagaagcagagcctccttcccatccgcaccagcaagaagcagttcacgattccccatcctctgagtgataacttgttcaaacccaaagaacggtgcatttcagagaaggagatgcatatgcgatctaagagaatctatgataacttgccggaagttaaaaagaaaaaagaagaacaaaggaaaagggtgatcttacaaagtaacagactccgtgccgaagtcttcaaaaagcaattactggaccagctccttcaaaggaatgcggtctaaccacaggctgccctgctgaccacactacctggacctgggaggacttcgaatgctggataagccattaaacttagcattatcttcatcatgggaaaacacttattttactttcgattttttttttccataaaggaaaacatcacttcctgaattactgacccaagccaaacagaaacaataaccctcgagaaaataggtcaacaatctgttgtggggaaaccacctccatgtaacccactggatacagtccccttaatgtttttgcttctaaattgtaccttttgcttctgatttcttctcccctgctgtttcctgcccatcagagaggcctgatacaagcaagtttgtttacatccctggggaatcttttacatcaaacttttgggatccaaatccatctccttttaaatttcaatctcagcacctgccagttatgcaaatgccaaaatgtgggtcatcatatagtatatttgaaacctttctgaacatgtacaccacccaatgctagaggctgacttggaaaccggtgggtgcaatgcccgaggctgtggaacaatcagcccatctctttgtgacctggagcagtcagagggccctcagtcaccccgccccattcctcaccagagaaaagaatccatttctatggaagctctgacgtaacttcagtgttttctacaatactcctcctgccccgccccattaaaacagttcttttgttaagaaatagcctaatggtccaactttgctgtctgttcttccaaatgtttataatacacattatttataaatatgtctgtttgggaagctaagaacaagctagtttttacaacacaaatggaaataaatgcaattatt

SEQ ID NO: 1075 - DNA, 2720 bp, Homo sapiens
actagctaaagtcacaagatactgagtctcatgcagcactctggaattcctacaaaaactcatccgcaggggtatgctgcccgctacacagaaacggccgtgcatcggactttccagataaaaacatttagtacagagttgaaaaaccatgtgatggtcatggattttgtgaagagtaactggtttccctcccagagaagagccaaagtttgtatcatccatatgtgtcaaggcttgaagacggctgagcagacagccagcagatatgagatccacagtcgactcttctcatcccccaaagatcattctgcctgggaaagaaatgaaagtctttccaatgcaggattacgggacagctaccacagtagaagagatcaaattgcccttaaaaatctccagtctgatgtcacagaggcaaaatctgacttcaccaaggagaccctggcatcacaaaacacaaaaatgatttcatccatagtcatctcccagatgattgatgagaataagtcaagagaaaacagggcctccttgcccctaccgtgtgccattgctcagtctcgtgcacatcacgccaagcaatctctggctaaccgcagcggagtcaacattcacagagcatttgcgttacttccgggcagattaggaatcccggcaccgtcagatgagcgaggacctgaggcagagctgccgcccaaagaggagagaccctgtgggggcccccgcagagggtttgcatccatcaccatcacggccagacgcgtgggccccccagcccgcgccctggtgtgggggactgctggggactctctgtgccccaagtgcagggctgaggacacactgttccaggcgcccccggctctggccaatggcgcccatccaggtcggcatcagagatcttttgcctgcacagagttctccagaaacagctccgtggtgcggctgaaggttcccgaggcccacactgggttgtgtgagagacgcaagtactgggtcacccatgcagacgacaaagagaccagtttttctccagacaccccactgtcaggaaagagcccgctggtgttcagttcctgtgtccacctcagggtgtctcagcagtgtccagattcaatctattacgtagacaagtctctctccgtccccattgagccacctcaaattgccagccccaaaatgcacagatccgtcctgtcgctcaacctcaattgtagttcccacagattaacagcagatggagtagatggcctagtgaacagagagccaataagcgaagccctgaagcaggagctcctggagggagaccaggacctcgtaggccagcgctggaacccaggtttacaagaaagtcacttgaaggaaaccccatcgttgaggcgggtgcatttggggaccggcgcttgtccttggagtggttcttttccattggaaaacacagaattggcaaatgtgggagctaaccaagtcactgtaagaaaaggggaaaaggaccatacaactcattgtcacgccagcgatcatgccaaccaactgtccattcacattcctggctggagttacagggcagtacacacaaaagtattttctggaagcagcaagaggcaacaaggagaagtatgtatgactgtgtctgctcctccagtggaacagaagcccactagacatttccttcccattggggatagctctccaagcgatgactgtctgtctagagacctttctgagcccacagagagacgacatcaaagcttcctgaaacccagaatcctttttcctgggtttctttgccccttacaagatgtatgtgcatctctgcaggaagacaatggtgttcagatagaaagcaagttccccaaaggagattacacatgctgtgacttggttgtaaaaataaaggaatgtaagaagagtgaggaccccaccacacctgagccctccccagcagcaccctcgccagcaccccgcgatggagcagggagccctggcctgtccgaagactgttctgagtctcagcaaacgcctgcaagatctttgaccttgcaagaagcactggaagttcgtaagcctcagttcatttctcgctcacaagaacggctgaagaagcttgaacacatggtccagcagaggaaagcccagcggaaggaggacctgaggcagaagcagagcctccttcccatccgcaccagcaagaagcagttcacgattccccatcctctgagtgataacttgttcaaacccaaagaacggtgcatttcagagaaggagatgcatatgcgatctaagagaatctatgataacttgccggaagttaaaaagaaaaaagaagaacaaaggaaaagggtgatcttacaaagtaacagactccgtgccgaagtcttcaaaaagcaattactggaccagctccttcaaaggaatgcggtctaaccacaggctgccctgctgaccacactacctggacctgggaggacttcgaatgctggataagccattaaacttagcattatcttcatcatgggaaaacacttattttactttcgattttttttttccataaaggaaaacatcacttcctgaattactgacccaagccaaacagaaacaataaccctcgagaaaataggtcaacaatctgttgtggggaaaccacctccatgtaacccactggatacagtccccttaatgtttttgcttctaaattgtaccttttgcttctgatttcttct

SEQ ID NO: 1076 - DNA, 3520 bp, Homo sapiens
gagcagacaagtgcctcttgggcccgcttctctaacaaatgtaaaaataatgcccttgaaccaggagcgaaactgagctatctaaggaaaacactgtgagcaaatactgagagcctagggaaaccatctgattagaagagctcccctcaggagcgcgttagcttcacaccttcggcagcaggagggcggcagcttctcgcaggcggcagggcgggcggccaggatcatgtccaccaccacatgccaagtggtggcgttcctcctgtccatcctggggctggccggctgcatcgcggccaccgggatggacatgtggagcacccaggacctgtacgacaaccccgtcacctccgtgttccagtacgaagggctctggaggagctgcgtgaggcagagttcaggcttcaccgaatgcaggccctatttcaccatcctgggacttccagccatgctgcaggcagtgcgagccctgatgatcgtaggcatcgtcctgggtgccattggcctcctggtatccatctttgccctgaaatgcatccgcattggcagcatggaggactctgccaaagccaacatgacactgacctccgggatcatgttcattgtctcaggtctttgtgcaattgctggagtgtctgtgtttgccaacatgctggtgactaacttctggatgtccacagctaacatgtacaccggcatgggtgggatggtgcagactgttcagaccaggtacacatttggtgcggctctgttcgtgggctgggtcgctggaggcctcacactaattgggggtgtgatgatgtgcatcgcctgccggggcctggcaccagaagaaaccaactacaaagccgtttcttatcatgcctcaggccacagtgttgcctacaagcctggaggcttcaaggccagcactggctttgggtccaacaccaaaaacaagaagatatacgatggaggtgcccgcacagaggacgaggtacaatcttatccttccaagcacgactatgtgtaatgctctaagacctctcagcacgggcggaagaaactcccggagagctcacccaaaaaacaaggagatcccatctagatttcttcttgcttttgactcacagctggaagttagaaaagcctcgatttcatctttggagaggccaaatggtcttagcctcagtctctgtctctaaatattccaccataaaacagctgagttatttatgaattagaggctatagctcacattttcaatcctctatttctttttttaaatataactttctactctgatgagagaatgtggttttaatctctctctcacattttgatgatttagacagactccccctcttcctcctagtcaataaacccattgatgatctatttcccagcttatccccaagaaaacttttgaaaggaaagagtagacccaaagatgttattttctgctgtttgaattttgtctccccacccccaacttggctagtaataaacacttactgaagaagaagcaataagagaaagatatttgtaatctctccagcccatgatctcggttttcttacactgtgatcttaaaagttaccaaaccaaagtcattttcagtttgaggcaaccaaacctttctactgctgttgacatcttcttattacagcaacaccattctaggagtttcctgagctctccactggagtcctctttctgtcgcgggtcagaaattgtccctagatgaatgagaaaattattttttttaatttaagtcctaaatatagttaaaataaataatgttttagtaaaatgatacactatctctgtgaaatagcctcacccctacatgtggatagaaggaaatgaaaaaataattgctttgacattgtctatatggtactttgtaaagtcatgcttaagtacaaattccatgaaaagctcactgatcctaattctttccctttgaggtctctatggctctgattgtacatgatagtaagtgtaagccatgtaaaaagtaaataatgtctgggcacagtggctcacgcctgtaatcctagcactttgggaggctgaggaggaaggatcacttgagcccagaagttcgagactagcctgggcaacatggagaagccctgtctctacaaaatacagagagaaaaaatcagccagtcatggtggcctacacctgtagtcccagcattccgggaggctgaggtgggaggatcacttgagcccagggaggttggggctgcagtgagccatgatcacaccactgcactccagccaggtgacatagcgagatcctgtctaaaaaaataaaaaataaataatggaacacagcaagtcctaggaagtaggttaaaactaattctttaaaaaaaaaaaaaagttgagcctgaattaaatgtaatgtttccaagtgacaggtatccacatttgcatggttacaagccactgccagttagcagtagcactttcctggcactgtggtcggttttgttttgttttgctttgtttagagacggggtctcactttccaggctggcctcaaactcctgcactcaagcaattcttctaccctggcctcccaagtagctggaattacaggtgtgcgccatcacaactagctggtggtcagttttgttactctgagagctgttcacttctctgaattcacctagagtggttggaccatcagatgtttgggcaaaactgaaagctctttgcaaccacacaccttccctgagcttacatcactgcccttttgagcagaaagtctaaattccttccaagacagtagaattccatcccagtaccaaagccagataggccccctaggaaactgaggtaagagcagtctctaaaaactacccacagcagcattggtgcaggggaacttggccattaggttattatttgagaggaaagtcctcacatcaatagtacatatgaaagtgacctccaaggggattggtgaatactcataaggatcttcaggctgaacagactatgtctggggaaagaacggattatgccccattaaataacaagttgtgttcaagagtcagagcagtgagctcagaggcccttctcactgagacagcaacatttaaaccaaaccagaggaagtatttgtggaactcactgcctcagtttgggtaaaggatgagcagacaagtcaactaaagaaaaaagaaaagcaaggaggagggttgagcaatctagagcatggagtttgttaagtgctctctggatttgagttgaagagcatccatttgagttgaaggccacagggcacaatgagctctcccttctaccaccagaaagtccctggtcaggtctcaggtagtgcggtgtggctcagctgggtttttaattagcgcattctctatccaacatttaattgtttgaaagcctccatatagttagattgtgctttgtaattttgttgttgttgctctatcttattgtatatgcattgagtattaacctgaatgttttgttacttaaatattaaaaacactgttatcctaca

SEQ ID NO: 1077 - DNA, 3431 bp, Homo sapiens
aaccgcctccattacatggtccgttcctgacgtgtacaccagcctctcagagaaaactccatccctacactcggtagtctcagaattgcgctgtccacttgtcgtgtggctctgtgtcgacactgtgcgccaccatggccgtgactgcctgtcagggcttggggttcgtggtttcactgattgggattgcgggcatcattgctgccacctgcatggaccagtggagcacccaagacttgtacaacaaccccgtaacagctgttttcaactaccaggggctgtggcgctcctgtgtccgagagagctctggcttcaccgagtgccggggctacttcaccctgctggggctgccagccatgctgcaggcagtgcgagccctgatgatcgtaggcatcgtcctgggtgccattggcctcctggtatccatctttgccctgaaatgcatccgcattggcagcatggaggactctgccaaagccaacatgacactgacctccgggatcatgttcattgtctcaggtctttgtgcaattgctggagtgtctgtgtttgccaacatgctggtgactaacttctggatgtccacagctaacatgtacaccggcatgggtgggatggtgcagactgttcagaccaggtacacatttggtgcggctctgttcgtgggctgggtcgctggaggcctcacactaattgggggtgtgatgatgtgcatcgcctgccggggcctggcaccagaagaaaccaactacaaagccgtttcttatcatgcctcaggccacagtgttgcctacaagcctggaggcttcaaggccagcactggctttgggtccaacaccaaaaacaagaagatatacgatggaggtgcccgcacagaggacgaggtacaatcttatccttccaagcacgactatgtgtaatgctctaagacctctcagcacgggcggaagaaactcccggagagctcacccaaaaaacaaggagatcccatctagatttcttcttgcttttgactcacagctggaagttagaaaagcctcgatttcatctttggagaggccaaatggtcttagcctcagtctctgtctctaaatattccaccataaaacagctgagttatttatgaattagaggctatagctcacattttcaatcctctatttctttttttaaatataactttctactctgatgagagaatgtggttttaatctctctctcacattttgatgatttagacagactccccctcttcctcctagtcaataaacccattgatgatctatttcccagcttatccccaagaaaacttttgaaaggaaagagtagacccaaagatgttattttctgctgtttgaattttgtctccccacccccaacttggctagtaataaacacttactgaagaagaagcaataagagaaagatatttgtaatctctccagcccatgatctcggttttcttacactgtgatcttaaaagttaccaaaccaaagtcattttcagtttgaggcaaccaaacctttctactgctgttgacatcttcttattacagcaacaccattctaggagtttcctgagctctccactggagtcctctttctgtcgcgggtcagaaattgtccctagatgaatgagaaaattattttttttaatttaagtcctaaatatagttaaaataaataatgttttagtaaaatgatacactatctctgtgaaatagcctcacccctacatgtggatagaaggaaatgaaaaaataattgctttgacattgtctatatggtactttgtaaagtcatgcttaagtacaaattccatgaaaagctcactgatcctaattctttccctttgaggtctctatggctctgattgtacatgatagtaagtgtaagccatgtaaaaagtaaataatgtctgggcacagtggctcacgcctgtaatcctagcactttgggaggctgaggaggaaggatcacttgagcccagaagttcgagactagcctgggcaacatggagaagccctgtctctacaaaatacagagagaaaaaatcagccagtcatggtggcctacacctgtagtcccagcattccgggaggctgaggtgggaggatcacttgagcccagggaggttggggctgcagtgagccatgatcacaccactgcactccagccaggtgacatagcgagatcctgtctaaaaaaataaaaaataaataatggaacacagcaagtcctaggaagtaggttaaaactaattctttaaaaaaaaaaaaaagttgagcctgaattaaatgtaatgtttccaagtgacaggtatccacatttgcatggttacaagccactgccagttagcagtagcactttcctggcactgtggtcggttttgttttgttttgctttgtttagagacggggtctcactttccaggctggcctcaaactcctgcactcaagcaattcttctaccctggcctcccaagtagctggaattacaggtgtgcgccatcacaactagctggtggtcagttttgttactctgagagctgttcacttctctgaattcacctagagtggttggaccatcagatgtttgggcaaaactgaaagctctttgcaaccacacaccttccctgagcttacatcactgcccttttgagcagaaagtctaaattccttccaagacagtagaattccatcccagtaccaaagccagataggccccctaggaaactgaggtaagagcagtctctaaaaactacccacagcagcattggtgcaggggaacttggccattaggttattatttgagaggaaagtcctcacatcaatagtacatatgaaagtgacctccaaggggattggtgaatactcataaggatcttcaggctgaacagactatgtctggggaaagaacggattatgccccattaaataacaagttgtgttcaagagtcagagcagtgagctcagaggcccttctcactgagacagcaacatttaaaccaaaccagaggaagtatttgtggaactcactgcctcagtttgggtaaaggatgagcagacaagtcaactaaagaaaaaagaaaagcaaggaggagggttgagcaatctagagcatggagtttgttaagtgctctctggatttgagttgaagagcatccatttgagttgaaggccacagggcacaatgagctctcccttctaccaccagaaagtccctggtcaggtctcaggtagtgcggtgtggctcagctgggtttttaattagcgcattctctatccaacatttaattgtttgaaagcctccatatagttagattgtgctttgtaattttgttgttgttgctctatcttattgtatatgcattgagtattaacctgaatgttttgttacttaaatattaaaaacactgttatcctacagtt

SEQ ID NO: 1078 - DNA, 985 bp, Homo sapiens
gagagcctagggaaaccatctgattagaagagctcccctcaggagcgcgttagcttcacaccttcggcagcaggagggcggcagcttctcgcaggcggcagggcgggcggccaggatcatgtccaccaccacatgccaagtggtggcgttcctcctgtccatcctggggctggccggctgcatcgcggccaccgggatggacatgtggagcacccaggacctgtacgacaaccccgtcacctccgtgttccagtacgaagggctctggaggagctgcgtgaggcagagttcaggcttcaccgaatgcaggccctatttcaccatcctgggacttccagccatgctgcaggcagtgcgagccctgatgatcgtagccatctttgccctgaaatgcatccgcattggcagcatggaggactctgccaaagccaacatgacactgacctccgggatcatgttcattgtctcaggtctttgtgcaattgctggagtgtctgtgtttgccaacatgctggtgactaacttctggatgtccacagctaacatgtacaccggcatgggtgggatggtgcagactgttcagaccaggtacacatttggtgcggctctgttcgtgggctgggtcgctggaggcctcacactaattgggggtgtgatgatgtgcatcgcctgccggggcctggcaccagaagaaaccaactacaaagccgtttcttatcatgcctcaggccacagtgttgcctacaagcctggaggcttcaaggccagcactggctttgggtccaacaccaaaaacaagaagatatacgatggaggtgcccgcacagaggacgaggtacaatcttatccttccaagcacgactatgtgtaatgctctaagacctctcagcacgggcggaagaaactcccggagagctcacccaaaaaacaaggagatcccatctagatttcttcttgcttttgactcacagctggaagttagaaa

SEQ ID NO: 1079 - DNA, 3954 bp, Homo sapiens
aacctgctgggcccgccgggactcgcccccctgcccgctcctctcctccagccccggccggcctcggctcggcccccggcccgccccttccagccctcggcacctcccgccggccgcttggctccgccactcggcactcactgcccgggccgcccggacagggagcttcgctggcgcgcttggccggcgacaggacaggttcgggacgtccatctgtccatccgtccggagagaaattacagatccgcagccccgggatggggccggccccgctgccgctgctgctgggcctcttcctccccgcgctctggcgtagagctatcactgaggcaagggaagaagccaagccttacccgctattcccgggaccttttccagggagcctgcaaactgaccacacaccgctgttatcccttcctcacgccagtgggtaccagcctgccttgatgttttcaccaacccagcctggaagaccacatacaggaaacgtagccattccccaggtgacctctgtcgaatcaaagcccctaccgcctcttgccttcaaacacacagttggacacataatactttctgaacataaaggtgtcaaatttaattgctcaatcagtgtacctaatatataccaggacaccacaatttcttggtggaaagatgggaaggaattgcttggggcacatcatgcaattacacagttttatccagatgatgaagttacagcaataatcgcttccttcagcataaccagtgtgcagcgttcagacaatgggtcgtatatctgtaagatgaaaataaacaatgaagagatcgtgtctgatcccatctacatcgaagtacaaggacttcctcactttactaagcagcctgagagcatgaatgtcaccagaaacacagccttcaacctcacctgtcaggctgtgggcccgcctgagcccgtcaacattttctgggttcaaaacagtagccgtgttaacgaacagcctgaaaaatccccctccgtgctaactgttccaggcctgacggagatggcggtcttcagttgtgaggcccacaatgacaaagggctgaccgtgtccaagggagtgcagatcaacatcaaagcaattccctccccaccaactgaagtcagcatccgtaacagcactgcacacagcattctgatctcctgggttcctggttttgatggatactccccgttcaggaattgcagcattcaggtcaaggaagctgatccgctgagtaatggctcagtcatgatttttaacacctctgccttaccacatctgtaccaaatcaagcagctgcaagccctggctaattacagcattggtgtttcctgcatgaatgaaataggctggtctgcagtgagcccttggattctagccagcacgactgaaggagccccatcagtagcacctttaaatgtcactgtgtttctgaatgaatctagtgataatgtggacatcagatggatgaagcctccgactaagcagcaggatggagaactggtgggctaccggatatcccacgtgtggcagagtgcagggatttccaaagagctcttggaggaagttggccagaatggcagccgagctcggatctctgttcaagtccacaatgctacgtgcacagtgaggattgcagccgtcaccagagggggagttgggcccttcagtgatccagtgaaaatatttatccctgcacacggttgggtagattatgccccctcttcaactccggcgcctggcaacgcagatcctgtgctcatcatctttggctgcttttgtggatttattttgattgggttgattttatacatctccttggccatcagaaaaagagtccaggagacaaagtttgggaatgcattcacagaggaggattctgaattagtggtgaattatatagcaaagaaatccttctgtcggcgagccattgaacttaccttacatagcttgggagtcagtgaggaactacaaaataaactagaagatgttgtgattgacaggaatcttctaattcttggaaaaattctgggtgaaggagagtttgggtctgtaatggaaggaaatcttaagcaggaagatgggacctctctgaaagtggcagtgaagaccatgaagttggacaactcttcacagcgggagatcgaggagtttctcagtgaggcagcgtgcatgaaagacttcagccacccaaatgtcattcgacttctaggtgtgtgtatagaaatgagctctcaaggcatcccaaagcccatggtaattttacccttcatgaaatacggggacctgcatacttacttactttattcccgattggagacaggaccaaagcatattcctctgcagacactattgaagttcatggtggatattgccctgggaatggagtatctgagcaacaggaattttcttcatcgagatttagctgctcgaaactgcatgttgcgagatgacatgactgtctgtgttgcggacttcggcctctctaagaagatttacagtggcgattattaccgccaaggccgcattgctaagatgcctgttaaatggatcgccatagaaagtcttgcagaccgagtctacacaagtaaaagtgatgtgtgggcatttggcgtgaccatgtgggaaatagctacgcggggaatgactccctatcctggggtccagaaccatgagatgtatgactatcttctccatggccacaggttgaagcagcccgaagactgcctggatgaactgtatgaaataatgtactcttgctggagaaccgatcccttagaccgccccaccttttcagtattgaggctgcagctagaaaaactcttagaaagtttgcctgacgttcggaaccaagcagacgttatttacgtcaatacacagttgctggagagctctgagggcctggcccagggctccacccttgctccactggacttgaacatcgaccctgactctataattgcctcctgcactccccgcgctgccatcagtgtggtcacagcagaagttcatgacagcaaacctcatgaaggacggtacatcctgaatgggggcagtgaggaatgggaagatctgacttctgccccctctgctgcagtcacagctgaaaagaacagtgttttaccgggggagagacttgttaggaatggggtctcctggtcccattcgagcatgctgcccttgggaagctcattgcccgatgaacttttgtttgctgacgactcctcagaaggctcagaagtcctgatgtgaggagaggtgcggggagacattccaaaaatcaagccaattcttctgctgtaggagaatccaattgtacctgatgtttttggtatttgtcttccttaccaagtgaactccatggccccaaagcaccagatgaatgttgttaagtaagctgtcattaaaaatacataatatatatttatttaaagagaaaaaatatgtgtatatcatggaaaaagacaaggatattttaataaaacattacttatttcatttcacttatcttgcatatcttaaaattaagcttcagctgctccttgatattaacatttgtacagagttgaagttgttttttcaagttcttttctttttcatgactattaaatgtaaaaatatttgtaaaatgaaatgccatatttgacttggcttctggtcttgatgtatttgataagaatgattcattcaatgtttaaagttgtataactgattaattttctgatatggcttcctaataaaatatgaataaggaaggatatgttgaacttacttgagacttgaaagacagtggtcggcagcggccttgtggcctttgcaaaggaattcccttaatgcctggtccttggggcaattgctctgaccattcttggcattgctttatagagatatggaaaaaccacaccagggtctgtagataaggaataaagaatattgaaggattgaaaaa

SEQ ID NO: 1080 - DNA, 3810 bp, Homo sapiens
actcactgcccgggccgcccggacagggagcttcgctggcgcgcttggccggcgacaggacaggttcgggacgtccatctgtccatccgtccggagagaaattacagatccgcagccccgggatggggccggccccgctgccgctgctgctgggcctcttcctccccgcgctctggcgtagagctatcactgaggcaagggaagaagccaagccttacccgctattcccgggaccttttccagggagcctgcaaactgaccacacaccgctgttatcccttcctcacgccagtgggtaccagcctgccttgatgttttcaccaacccagcctggaagaccacatacaggaaacgtagccattccccaggtgacctctgtcgaatcaaagcccctaccgcctcttgccttcaaacacacagttggacacataatactttctgaacataaaggtgtcaaatttaattgctcaatcagtgtacctaatatataccaggacaccacaatttcttggtggaaagatgggaaggaattgcttggggcacatcatgcaattacacagttttatccagatgatgaagttacagcaataatcgcttccttcagcataaccagtgtgcagcgttcagacaatgggtcgtatatctgtaagatgaaaataaacaatgaagagatcgtgtctgatcccatctacatcgaagtacaaggacttcctcactttactaagcagcctgagagcatgaatgtcaccagaaacacagccttcaacctcacctgtcaggctgtgggcccgcctgagcccgtcaacattttctgggttcaaaacagtagccgtgttaacgaacagcctgaaaaatccccctccgtgctaactgttccaggcctgacggagatggcggtcttcagttgtgaggcccacaatgacaaagggctgaccgtgtccaagggagtgcagatcaacatcaaagcaattccctccccaccaactgaagtcagcatccgtaacagcactgcacacagcattctgatctcctgggttcctggttttgatggatactccccgttcaggaattgcagcattcaggtcaaggaagctgatccgctgagtaatggctcagtcatgatttttaacacctctgccttaccacatctgtaccaaatcaagcagctgcaagccctggctaattacagcattggtgtttcctgcatgaatgaaataggctggtctgcagtgagcccttggattctagccagcacgactgaaggagccccatcagtagcacctttaaatgtcactgtgtttctgaatgaatctagtgataatgtggacatcagatggatgaagcctccgactaagcagcaggatggagaactggtgggctaccggatatcccacgtgtggcagagtgcagggatttccaaagagctcttggaggaagttggccagaatggcagccgagctcggatctctgttcaagtccacaatgctacgtgcacagtgaggattgcagccgtcaccagagggggagttgggcccttcagtgatccagtgaaaatatttatccctgcacacggtgagagctatacccatgcacagattgccagaaacttacacaaagtgagacctgcctatatttctttgactatttgttcttccctgttacaagccagtgtttctcatatatttcaaaccatgactggtctattggtatctaccaggttgggtagattatgccccctcttcaactccggcgcctggcaacgcagatcctgtgctcatcatctttggctgcttttgtggattttgattgggttgattttatacatctccttggccatcagaaaaagagtccaggagacaaagtttgggaatgcattcacagaggaggattctgaattagtggtgaattatatagcaaagaaatccttctgtcggcgagccattgaacttaccttacatagcttgggagtcagtgaggaactacaaaataaactagaagatgttgtgattgacaggaatcttctaattcttggaaaaattctgggtgaaggagagtttgggtctgtaatggaaggaaatcttaagcaggaagatgggacctctctgaaagtggcagtgaagaccatgaagttggacaactcttcacagcgggagatcgaggagtttctcagtgaggcagcgtgcatgaaagacttcagccacccaaatgtcattcgacttctaggtacttccgagaaatgcaggtgggtggccaagagggctctgctgatctgctctgtgccaaaggaaaaaatctctggtgtagataaaaactgcttgcaaatacatattcctctgcagacactattgaagttcatggtggatattgccctgggaatggagtatctgagcaacaggaattttcttcatcgagatttagctgctcgaaactgcatgttgcgagatgacatgactgtctgtgttgcggacttcggcctctctaagaagatttacagtggcgattattaccgccaaggccgcattgctaagatgcctgttaaatggatcgccatagaaagtcttgcagaccgagtctacacaagtaaaagtgatgtgtgggcatttggcgtgaccatgtgggaaatagctacgcggggaatgactccctatcctggggtccagaaccatgagatgtatgactatcttctccatggccacaggttgaagcagcccactgcctggatgaactgtgaccaggtgggcatgtgcagaggggtggaacccacagacaccccagcccaggagccattcctgatgtgggagatagtgtatgaatgtactcttgctggagaaccgatccctgaccgccccaccttttcagtattgaggctgcagctagaaaaactcttagaaagtttgcctgacgttcggaaccaagcagacgttatttacgtcaatacacagttgctggagagctctgagggcctggccctccacccttgctccactggacttgaacatcgaccctgactctataattgcctcctgcactccccgcgctgccatcagtgtggtcacagcagaagttcatgacagcaaacctcatgaaggacggtacatcctgaatgggggcagtgaggaatgggaagatctgacttctgccccctctgctgcagtcacagctgaaaagaacagtgttttaccgggggagagacttgttaggaatggggtctcctggtcccattcgagcatgctgcccttgggaagctcattgcccgatgaacttttgtttgctgacgactcctcagaaggctcagaagtcctgatgtgaggagaggtgcggggagacattccaaaaatcaagccaattcttctgctgtaggagaatccaattgtacctgatgtttttggtatttgtcttccttaccaagtgaactccatggccccaaagcaccagatgaatgttgttaagtaagctgtcattaaaaatacataatatatatttatttaaagagaaaaaatatgtgtatatcatggaaaaagacaaggatattttaataaaacattacttatttcatttcacttatcttgcatatcttaaaattaagcttcagctgctccttgatattaacatttgtacagagttgaagttgttttttcaagttcttttctttttcatgactattaaatgtaaaaatatttgtaaaatgaaatgccatatttgacttggcttctggtcttgatgtatttgataagaatgattcattcaatgtttaaagttgtataactgattaattttctgatatggcttcctaataaaatatgaataagg

SEQ ID NO: 1081 - DNA, 3189 bp, Homo sapiens
cgcccggacagggagcttcgctggcgcgcttggccggcgacaggacaggttcgggacgtccatctgtccatccgtccggagagaaattacagatccgcagccccgggatggggccggccccgctgccgctgctgctgggcctcttcctccccgcgctctggcgtagagcataaccagtgtgcagcgttcagacaatgggtcgtatatctgtaagatgaaaataaacaatgaagagatcgtgtctgatcccatctacatcgaagtacaaggacttcctcactttactaagcagcctgagagcatgaatgtcaccagaaacacagccttcaacctcacctgtcaggctgtgggcccgcctgagcccgtcaacattttctgggttcaaaacagtagccgtgttaacgaacagcctgaaaaatccccctccgtgctaactgttccaggcctgacggagatggcggtcttcagttgtgaggcccacaatgacaaagggctgaccgtgtccaagggagtgcagatcaacatcaaagcaattccctccccaccaactgaagtcagcatccgtaacagcactgcacacagcattctgatctcctgggttcctggttttgatggatactccccgttcaggaattgcagcattcaggtcaaggaagctgatccgctgagtaatggctcagtcatgatttttaacacctctgccttaccacatctgtaccaaatcaagcagctgcaagccctggctaattacagcattggtgtttcctgcatgaatgaaataggctggtctgcagtgagcccttggattctagccagcacgactgaaggagccccatcagtagcacctttaaatgtcactgtgtttctgaatgaatctagtgataatgtggacatcagatggatgaagcctccgactaagcagcaggatggagaactggtgggctaccggatatcccacgtgtggcagagtgcagggatttccaaagagctcttggaggaagttggccagaatggcagccgagctcggatctctgttcaagtccacaatgctacgtgcacagtgaggattgcagccgtcaccagagggggagttgggcccttcagtgatccagtgaaaatatttatccctgcacacggttgggtagattatgccccctcttcaactccggcgcctggcaacgcagatcctgtgctcatcatctttggctgcttttgtggatttattttgattgggttgattttatacatctccttggccatcagaaaaagagtccaggagacaaagtttgggaatgcattcacagaggaggattctgaattagtggtgaattatatagcaaagaaatccttctgtcggcgagccattgaacttaccttacatagcttgggagtcagtgaggaactacaaaataaactagaagatgttgtgattgacaggaatcttctaattcttggaaaaattctgggtgaaggagagtttgggtctgtaatggaaggaaatcttaagcaggaagatgggacctctctgaaagtggcagtgaagaccatgaagttggacaactcttcacagcgggagatcgaggagtttctcagtgaggcagcgtgcatgaaagacttcagccacccaaatgtcattcgacttctaggtgtgtgtatagaaatgagctctcaaggcatcccaaagcccatggtaattttacccttcatgaaatacggggacctgcatacttacttactttattcccgattggagacaggaccaaagcatattcctctgcagacactattgaagttcatggtggatattgccctgggaatggagtatctgagcaacaggaattttcttcatcgagatttagctgctcgaaactgcatgttgcgagatgacatgactgtctgtgttgcggacttcggcctctctaagaagatttacagtggcgattattaccgccaaggccgcattgctaagatgcctgttaaatggatcgccatagaaagtcttgcagaccgagtctacacaagtaaaagtgatgtgtgggcatttggcgtgaccatgtgggaaatagctacgcggggaatgactccctatcctggggtccagaaccatgagatgtatgactatcttctccatggccacaggttgaagcagcccgaagactgcctggatgaactgtatgaaataatgtactcttgctggagaaccgatcccttagaccgccccaccttttcagtattgaggctgcagctagaaaaactcttagaaagtttgcctgacgttcggaaccaagcagacgttatttacgtcaatacacagttgctggagagctctgagggcctggcccagggctccacccttgctccactggacttgaacatcgaccctgactctataattgcctcctgcactccccgcgctgccatcagtgtggtcacagcagaagttcatgacagcaaacctcatgaaggacggtacatcctgaatgggggcagtgaggaatgggaagatctgacttctgccccctctgctgcagtcacagctgaaaagaacagtgttttaccgggggagagacttgttaggaatggggtctcctggtcccattcgagcatgctgcccttgggaagctcattgcccgatgaacttttgtttgctgacgactcctcagaaggctcagaagtcctgatgtgaggagaggtgcggggagacattccaaaaatcaagccaattcttctgctgtaggagaatccaattgtacctgatgtttttggtatttgtcttccttaccaagtgaactccatggccccaaagcaccagatgaatgttgttaagtaagctgtcattaaaaatacataatatatatttatttaaagagaaaaaatatgtgtatatcatggaaaaagacaaggatattttaataaaacattacttatttcatttcacttatcttgcatatcttaaaattaagcttcagctgctccttgatattaacatttgtacagagttgaagttgttttttcaagttcttttctttttcatgactattaaatgtaaaaatatttgtaaaatgaaatgccatatttgacttggcttctggtcttgatgtatttgataagaatgattcattcaatgtttaaagttgtataactgattaattttctgatatggcttcctaataaaatatgaataaggaa

SEQ ID NO: 1082 - DNA, 3600 bp, Homo sapiens
ctcggcactcactgcccgggccgcccggacagggagcttcgctggcgcgcttggccggcgacaggacaggttcgggacgtccatctgtccatccgtccggagagaaattacagatccgcagccccgggatggggccggccccgctgccgctgctgctgggcctcttcctccccgcgctctggcgtagagctatcactgaggcaagggaagaagccaagccttacccgctattcccgggaccttttccagggagcctgcaaactgaccacacaccgctgttatcccttcctcacgccagtgggtaccagcctgccttgatgttttcaccaacccagcctggaagaccacatacaggaaacgtagccattccccaggtgacctctgtcgaatcaaagcccctaccgcctcttgccttcaaacacacagttggacacataatactttctgaacataaaggtgtcaaatttaattgctcaatcagtgtacctaatatataccaggacaccacaatttcttggtggaaagatgggaaggaattgcttggggcacatcatgcaattacacagttttatccagatgatgaagttacagcaataatcgcttccttcagcataaccagtgtgcagcgttcagacaatgggtcgtatatctgtaagatgaaaataaacaatgaagagatcgtgtctgatcccatctacatcgaagtacaaggacttcctcactttactaagcagcctgagagcatgaatgtcaccagaaacacagccttcaacctcacctgtcaggctgtgggcccgcctgagcccgtcaacattttctgggttcaaaacagtagccgtgttaacgaacagcctgaaaaatccccctccgtgctaactgttccaggcctgacggagatggcggtcttcagttgtgaggcccacaatgacaaagggctgaccgtgtccaagggagtgcagatcaacatcaaagcaattccctccccaccaactgaagtcagcatccgtaacagcactgcacacagcattctgatctcctgggttcctggttttgatggatactccccgttcaggaattgcagcattcaggtcaaggaagctgatccgctgagtaatggctcagtcatgatttttaacacctctgccttaccacatctgtaccaaatcaagcagctgcaagccctggctaattacagcattggtgtttcctgcatgaatgaaataggctggtctgcagtgagcccttggattctagccagcacgactgaaggagccccatcagtagcacctttaaatgtcactgtgtttctgaatgaatctagtgataatgtggacatcagatggatgaagcctccgactaagcagcaggatggagaactggtgggctaccggatatcccacgtgtggcagagtgcagggatttccaaagagctcttggaggaagttggccagaatggcagccgagctcggatctctgttcaagtccacaatgctacgtgcacagtgaggattgcagccgtcaccagagggggagttgggcccttcagtgatccagtgaaaatatttatccctgcacacggttgggtagattatgccccctcttcaactccggcgcctggcaacgcagatcctgtgctcatcatctttggctgcttttgtggatttattttgattgggttgattttatacatctccttggccatcagaaaaagagtccaggagacaaagtttgggaatgcattcacagaggaggattctgaattagtggtgaattatatagcaaagaaatccttctgtcggcgagccattgaacttaccttacatagcttgggagtcagtgaggaactacaaaataaactagaagatgttgtgattgacaggaatcttctaattcttggaaaaattctgggtgaaggagagtttgggtctgtaatggaaggaaatcttaagcaggaagatgggacctctctgaaagtggcagtgaagaccatgaagttggacaactcttcacagcgggagatcgaggagtttctcagtgaggcagcgtgcatgaaagacttcagccacccaaatgtcattcgacttctaggtgtgtgtatagaaatgagctctcaaggcatcccaaagcccatggtaattttacccttcatgaaatacggggacctgcatacttacttactttattcccgattggagacaggaccaaagcatattcctctgcagacactattgaagttcatggtggatattgccctgggaatggagtatctgagcaacaggaattttcttcatcgagatttagctgctcgaaactgcatgttgcgagatgacatgactgtctgtgttgcggacttcggcctctctaagaagatttacagtggcgattattaccgccaaggccgcattgctaagatgcctgttaaatggatcgccatagaaagtcttgcagaccgagtctacacaagtaaaagtgatgtgtgggcatttggcgtgaccatgtgggaaatagctacgcggggaatgactccctatcctggggtccagaaccatgagatgtatgactatcttctccatggccacaggttgaagcagcccgaagactgcctggatgaactgtatgaaataatgtactcttgctggagaaccgatcccttagaccgccccaccttttcagtattgaggctgcagctagaaaaactcttagaaagtttgcctgacgttcggaaccaagcagacgttatttacgtcaatacacagttgctggagagctctgagggcctggcccagggctccacccttgctccactggacttgaacatcgaccctgactctataattgcctcctgcactccccgcgctgccatcagtgtggtcacagcagaagttcatgacagcaaacctcatgaaggacggtacatcctgaatgggggcagtgaggaatgggaagatctgacttctgccccctctgctgcagtcacagctgaaaagaacagtgttttaccgggggagagacttgttaggaatggggtctcctggtcccattcgagcatgctgcccttgggaagctcattgcccgatgaacttttgtttgctgacgactcctcagaaggctcagaagtcctgatgtgaggagaggtgcggggagacattccaaaaatcaagccaattcttctgctgtaggagaatccaattgtacctgatgtttttggtatttgtcttccttaccaagtgaactccatggccccaaagcaccagatgaatgttgttaagtaagctgtcattaaaaatacataatatatatttatttaaagagaaaaaatatgtgtatatcatggaaaaagacaaggatattttaataaaacattacttatttcatttcacttatcttgcatatcttaaaattaagcttcagctgctccttgatattaacatttgtacagagttgaagttgttttttcaagttcttttctttttcatgactattaaatgtaaaaatatttgtaaaatgaaatgccatatttgacttggcttctggtcttgatgtatttgataagaatgattaattttctgatatggcttcctaataaaatatgaataagga

SEQ ID NO: 1083 - DNA, 1234 bp, Homo sapiens
ggccggcgggaagactccgttacccagcgagcgaggcggcggcgcagggccagcggactccatttcccgtcggctcgcggtgggagcgccggaagcccgccccacccctcattgtgcggctcctactaaacggaaggggccgggagaggccgcgttcagtcgggtcccggcagcggctgcagcgctctcgtcttctgcggctctcggtgccctctccttttcgtttccggaaacatggcctccggtgtggctgtctctgatggtgtcatcaaggtgttcaacgacatgaaggtgcgtaagtcttcaacgccagaggaggtgaagaagcgcaagaaggcggtgctcttctgcctgagtgaggacaagaagaacatcatcctggaggagggcaaggagatcctggtgggcgatgtgggccagactgtcgacgacccctacgccacctttgtcaagatgctgccagataaggactgccgctatgccctctatgatgcaacctatgagaccaaggagagcaagaaggaggatctggtgtttatcttctgggcccccgagtctgcgccccttaagagcaaaatgatttatgccagctccaaggacgccatcaagaagaagctgacagggatcaagcatgaattgcaagcaaactgctacgaggaggtcaaggaccgctgcaccctggcagagaagctggggggcagtgccgtcatctccctggagggcaagcctttgtgagccccttctggccccctgcctggagcatctggcagccccacacctgcccttgggggttgcaggctgcccccttcctgccagaccggaggggctggggggatcccagcagggggagggcaatcccttcaccccagttgccaaacagaccccccaccccctggattttccttctccctccatcccttgacggttctggccttcccaaactgcttttgatcttttgattcctcttgggctgaagcagaccaagttccccccaggcaccccagttgtgggggagcctgtattttttttaacaacatccccattccccacctggtcctcccccttcccatgctgccaacttctaaccgcaatagtgactctgtgcttgtctgtttagttctgtgtataaatggaatgttgtggagatgacccctccctgtgccggctggttcctctcccttttcccctggtcacggctactcatggaagcaggaccagtaagggaccttcgatt

SEQ ID NO: 1084 - DNA, 1752 bp, Homo sapiens
aactgcgaagcccccctctctctccccgttgctcttggaaactctaaggctcagaaaagggggcgctagcctcatattcatgtagggtcgctcgcgggaggcggggtcaagctgctgtctccacctggagcgccgggagtccgggcgggggcggtgctgtggaatgtccccgactacaacccccggtcgggattccaggctaatcaatagttgcttcgattcagaaatgcaaaaccctaacctcactcaaaaatttcaggccaagggatccagataataccagatgggtcttaagaaagccgttttgctgtgggataaagagccgcttagtcggggatcgttttcgggtcattttactgagcgccgcctcgccgggctcagagcggttcctgggaaattggaccaatgggctcgcgctgcgcgctgcggtgccgcccaggacctgggcctacatttccctacatgcactgcagctcggagccggccggcgggaagactccgttacccagcgagcgaggcggcggcgcagggccagcggactccatttcccgtcggctcgcggtgggagcgccggaagcccgccccacccctcattgtgcggctcctactaaacggaaggggccgggagaggccgcgttcagtcgggtcccggcagcggctgcagcgctctcgtcttctgcggctctcggtgccctctccttttcgtttccggaaacatggcctccggtgtggctgtctctgatggtgtcatcaaggtgttcaacgacatgaaggtgcgtaagtcttcaacgccagaggaggtgaagaagcgcaagaaggcggtgctcttctgcctgagtgaggacaagaagaacatcatcctggaggagggcaaggagatcctggtgggcgatgtgggccagactgtcgacgacccctacgccacctttgtcaagatgctgccagataaggactgccgctatgccctctatgatgcaacctatgagaccaaggagagcaagaaggaggatctggtgtttatcttctgggcccccgagtctgcgccccttaagagcaaaatgatttatgccagctccaaggacgccatcaagaagaagctgacagggatcaagcatgaattgcaagcaaactgctacgaggaggtcaaggaccgctgcaccctggcagagaagctggggggcagtgccgtcatctccctggagggcaagcctttgtgagccccttctggccccctgcctggagcatctggcagccccacacctgcccttgggggttgcaggctgcccccttcctgccagaccggaggggctggggggatcccagcagggggagggcaatcccttcaccccagttgccaaacagaccccccaccccctggattttccttctccctccatcccttgacggttctggccttcccaaactgcttttgatcttttgattcctcttgggctgaagcagaccaagttccccccaggcaccccagttgtgggggagcctgtattttttttaacaacatccccattccccacctggtcctcccccttcccatgctgccaacttctaaccgcaatagtgactctgtgcttgtctgtttagttctgtgtataaatggaatgttgtggagatgacccctccctgtgccggctggttcctctcccttttcccctggtcacggctactcatggaagcaggaccagtaagggaccttcgattaaaaaaaaaaaagacaataataaaaaggctcattaa

SEQ ID NO: 1085 - DNA, 567 bp, Homo sapiens
cgggagtccgggcgggggcggtgctgtggaatgtccccgactacaacccccgctcggagccggccggcgggaagactccgttacccagcgagcgaggcggcggcgcagggccagcggactccatttcccgtcggctcgcggtgggagcgccggaagcccgccccacccctcattgtgcggctcctactaaacggaaggggccgggagaggccgcgttcagtcgggtcccggcagcggctgcagcgctctcgtcttctgcggctctcggtgccctctccttttcgtttccggaaacatggcctccggtgtggctgtctctgatggtgtcatcaaggtgttcaacgacatgaaggtgcgtaagtcttcaacgccagaggaggtgaagaagcgcaagaaggcggtgctcttctgcctgagtgaggacaagaagaacatcatcctggaggagggcaaggagatcctggtgggcgatgtgggccagactgtcgacgacccctacgccacctttgtcaagatgctgccagataaggactgccgctatgccctctatgatgcaacctatgagac

SEQ ID NO: 1086 - DNA, 5411 bp, Homo sapiens
gtgtcccatagtgtttccaaacttggaaagggcgggggagggcgggaggatgcggagggcggaggtatgcagacaacgagtcagagtttccccttgaaagcctcaaaagtgtccacgtcctcaaaaagaatggaaccaatttaagaagccagccccgtggccacgtcccttcccccattcgctccctcctctgcgcccccgcaggctcctcccagctgtggctgcccgggcccccagccccagccctcccattggtggaggcccttttggaggcaccctagggccagggaaacttttgccgtataaatagggcagatccgggctttattattttagcaccacggcagcaggaggtttcggctaagttggaggtactggccacgactgcatgcccgcgcccgccaggtgatacctccgccggtgacccaggggctctgcgacacaaggagtctgcatgtctaagtgctagacatgctcagctttgtggatacgcggactttgttgctgcttgcagtaaccttatgcctagcaacatgccaatctttacaagaggaaactgtaagaaagggcccagccggagatagaggaccacgtggagaaaggggtccaccaggccccccaggcagagatggtgaagatggtcccacaggccctcctggtccacctggtcctcctggcccccctggtctcggtgggaactttgctgctcagtatgatggaaaaggagttggacttggccctggaccaatgggcttaatgggacctagaggcccacctggtgcagctggagccccaggccctcaaggtttccaaggacctgctggtgagcctggtgaacctggtcaaactggtcctgcaggtgctcgtggtccagctggccctcctggcaaggctggtgaagatggtcaccctggaaaacccggacgacctggtgagagaggagttgttggaccacagggtgctcgtggtttccctggaactcctggacttcctggcttcaaaggcattaggggacacaatggtctggatggattgaagggacagcccggtgctcctggtgtgaagggtgaacctggtgcccctggtgaaaatggaactccaggtcaaacaggagcccgtgggcttcctggtgagagaggacgtgttggtgcccctggcccagctggtgcccgtggcagtgatggaagtgtgggtcccgtgggtcctgctggtcccattgggtctgctggccctccaggcttcccaggtgcccctggccccaagggtgaaattggagctgttggtaacgctggtcctgctggtcccgccggtccccgtggtgaagtgggtcttccaggcctctccggccccgttggacctcctggtaatcctggagcaaacggccttactggtgccaagggtgctgctggccttcccggcgttgctggggctcccggcctccctggaccccgcggtattcctggccctgttggtgctgccggtgctactggtgccagaggacttgttggtgagcctggtccagctggctccaaaggagagagcggtaacaagggtgagcccggctctgctgggccccaaggtcctcctggtcccagtggtgaagaaggaaagagaggccctaatggggaagctggatctgccggccctccaggacctcctgggctgagaggtagtcctggttctcgtggtcttcctggagctgatggcagagctggcgtcatgggccctcctggtagtcgtggtgcaagtggccctgctggagtccgaggacctaatggagatgctggtcgccctggggagcctggtctcatgggacccagaggtcttcctggttcccctggaaatatcggccccgctggaaaagaaggtcctgtcggcctccctggcatcgacggcaggcctggcccaattggcccagctggagcaagaggagagcctggcaacattggattccctggacccaaaggccccactggtgatcctggcaaaaacggtgataaaggtcatgctggtcttgctggtgctcggggtgctccaggtcctgatggaaacaatggtgctcagggacctcctggaccacagggtgttcaaggtggaaaaggtgaacagggtccccctggtcctccaggcttccagggtctgcctggcccctcaggtcccgctggtgaagttggcaaaccaggagaaaggggtctccatggtgagtttggtctccctggtcctgctggtccaagaggggaacgcggtcccccaggtgagagtggtgctgccggtcctactggtcctattggaagccgaggtccttctggacccccagggcctgatggaaacaagggtgaacctggtgtggttggtgctgtgggcactgctggtccatctggtcctagtggactcccaggagagaggggtgctgctggcatacctggaggcaagggagaaaagggtgaacctggtctcagaggtgaaattggtaaccctggcagagatggtgctcgtggtgctcctggtgctgtaggtgcccctggtcctgctggagccacaggtgaccggggcgaagctggggctgctggtcctgctggtcctgctggtcctcggggaagccctggtgaacgtggtgaggtcggtcctgctggccccaatggatttgctggtcctgctggtgctgctggtcaacctggtgctaaaggagaaagaggagccaaagggcctaagggtgaaaacggtgttgttggtcccacaggccccgttggagctgctggcccagctggtccaaatggtccccccggtcctgctggaagtcgtggtgatggaggcccccctggtatgactggtttccctggtgctgctggacggactggtcccccaggaccctctggtatttctggccctcctggtccccctggtcctgctgggaaagaagggcttcgtggtcctcgtggtgaccaaggtccagttggccgaactggagaagtaggtgcagttggtccccctggcttcgctggtgagaagggtccctctggagaggctggtactgctggacctcctggcactccaggtcctcagggtcttcttggtgctcctggtattctgggtctccctggctcgagaggtgaacgtggtctaccaggtgttgctggtgctgtgggtgaacctggtcctcttggcattgccggccctcctggggcccgtggtcctcctggtgctgtgggtagtcctggagtcaacggtgctcctggtgaagctggtcgtgatggcaaccctgggaacgatggtcccccaggtcgcgatggtcaacccggacacaagggagagcgcggttaccctggcaatattggtcccgttggtgctgcaggtgcacctggtcctcatggccccgtgggtcctgctggcaaacatggaaaccgtggtgaaactggtccttctggtcctgttggtcctgctggtgctgttggcccaagaggtcctagtggcccacaaggcattcgtggcgataagggagagcccggtgaaaaggggcccagaggtcttcctggcttaaagggacacaatggattgcaaggtctgcctggtatcgctggtcaccatggtgatcaaggtgctcctggctccgtgggtcctgctggtcctaggggccctgctggtccttctggccctgctggaaaagatggtcgcactggacatcctggtacagttggacctgctggcattcgaggccctcagggtcaccaaggccctgctggcccccctggtccccctggccctcctggacctccaggtgtaagcggtggtggttatgactttggttacgatggagacttctacagggctgaccagcctcgctcagcaccttctctcagacccaaggactatgaagttgatgctactctgaagtctctcaacaaccagattgagacccttcttactcctgaaggctctagaaagaacccagctcgcacatgccgtgacttgagactcagccacccagagtggagcagtggttactactggattgaccctaaccaaggatgcactatggatgctatcaaagtatactgtgatttctctactggcgaaacctgtatccgggcccaacctgaaaacatcccagccaagaactggtataggagctccaaggacaagaaacacgtctggctaggagaaactatcaatgctggcagccagtttgaatataatgtagaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacatttgcaccacttgtggcttttgaatatcttccacagagggaagtttaaaacccaaacttccaaaggtttaaactacctcaaaacactttcccatgagtgtgatccacattgttaggtgctgacctagacagagatgaactgaggtccttgttttgttttgttcataatacaaaggtgctaattaatagtatttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaatcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggttttccaaaagaacatat

SEQ ID NO: 1087 - DNA, 5414 bp, Homo sapiens
gtgtcccatagtgtttccaaacttggaaagggcgggggagggcgggaggatgcggagggcggaggtatgcagacaacgagtcagagtttccccttgaaagcctcaaaagtgtccacgtcctcaaaaagaatggaaccaatttaagaagccagccccgtggccacgtcccttcccccattcgctccctcctctgcgcccccgcaggctcctcccagctgtggctgcccgggcccccagccccagccctcccattggtggaggcccttttggaggcaccctagggccagggaaacttttgccgtataaatagggcagatccgggctttattattttagcaccacggcagcaggaggtttcggctaagttggaggtactggccacgactgcatgcccgcgcccgccaggtgatacctccgccggtgacccaggggctctgcgacacaaggagtctgcatgtctaagtgctagacatgctcagctttgtggatacgcggactttgttgctgcttgcagtaaccttatgcctagcaacatgccaatgtacacttggagggcagactctcagtaaatttccaccctacttgcacatagaaaggtctgaacaaggtccaccaggccccccaggcagagatggtgaagatggtcccacaggccctcctggtccacctggtcctcctggcccccctggtctcggtgggaactttgctgctcagtatgatggaaaaggagttggacttggccctggaccaatgggcttaatgggacctagaggcccacctggtgcagctggagccccaggccctcaaggtttccaaggacctgctggtgagcctggtgaacctggtcaaactggtcctgcaggtgctcgtggtccagctggccctcctggcaaggctggtgaagatggtcaccctggaaaacccggacgacctggtgagagaggagttgttggaccacagggtgctcgtggtttccctggaactcctggacttcctggcttcaaaggcattaggggacacaatggtctggatggattgaagggacagcccggtgctcctggtgtgaagggtgaacctggtgcccctggtgaaaatggaactccaggtcaaacaggagcccgtgggcttcctggtgagagaggacgtgttggtgcccctggcccagctggtgcccgtggcagtgatggaagtgtgggtcccgtgggtcctgctggtcccattgggtctgctggccctccaggcttcccaggtgcccctggccccaagggtgaaattggagctgttggtaacgctggtcctgctggtcccgccggtccccgtggtgaagtgggtcttccaggcctctccggccccgttggacctcctggtaatcctggagcaaacggccttactggtgccaagggtgctgctggccttcccggcgttgctggggctcccggcctccctggaccccgcggtattcctggccctgttggtgctgccggtgctactggtgccagaggacttgttggtgagcctggtccagctggctccaaaggagagagcggtaacaagggtgagcccggctctgctgggccccaaggtcctcctggtcccagtggtgaagaaggaaagagaggccctaatggggaagctggatctgccggccctccaggacctcctgggctgagaggtagtcctggttctcgtggtcttcctggagctgatggcagagctggcgtcatgggccctcctggtagtcgtggtgcaagtggccctgctggagtccgaggacctaatggagatgctggtcgccctggggagcctggtctcatgggacccagaggtcttcctggttcccctggaaatatcggccccgctggaaaagaaggtcctgtcggcctccctggcatcgacggcaggcctggcccaattggcccagctggagcaagaggagagcctggcaacattggattccctggacccaaaggccccactggtgatcctggcaaaaacggtgataaaggtcatgctggtcttgctggtgctcggggtgctccaggtcctgatggaaacaatggtgctcagggacctcctggaccacagggtgttcaaggtggaaaaggtgaacagggtccccctggtcctccaggcttccagggtctgcctggcccctcaggtcccgctggtgaagttggcaaaccaggagaaaggggtctccatggtgagtttggtctccctggtcctgctggtccaagaggggaacgcggtcccccaggtgagagtggtgctgccggtcctactggtcctattggaagccgaggtccttctggacccccagggcctgatggaaacaagggtgaacctggtgtggttggtgctgtgggcactgctggtccatctggtcctagtggactcccaggagagaggggtgctgctggcatacctggaggcaagggagaaaagggtgaacctggtctcagaggtgaaattggtaaccctggcagagatggtgctcgtggtgctcctggtgctgtaggtgcccctggtcctgctggagccacaggtgaccggggcgaagctggggctgctggtcctgctggtcctgctggtcctcggggaagccctggtgaacgtggtgaggtcggtcctgctggccccaatggatttgctggtcctgctggtgctgctggtcaacctggtgctaaaggagaaagaggagccaaagggcctaagggtgaaaacggtgttgttggtcccacaggccccgttggagctgctggcccagctggtccaaatggtccccccggtcctgctggaagtcgtggtgatggaggcccccctggtatgactggtttccctggtgctgctggacggactggtcccccaggaccctctggtatttctggccctcctggtccccctggtcctgctgggaaagaagggcttcgtggtcctcgtggtgaccaaggtccagttggccgaactggagaagtaggtgcagttggtccccctggcttcgctggtgagaagggtccctctggagaggctggtactgctggacctcctggcactccaggtcctcagggtcttcttggtgctcctggtattctgggtctccctggctcgagaggtgaacgtggtctaccaggtgttgctggtgctgtgggtgaacctggtcctcttggcattgccggccctcctggggcccgtggtcctcctggtgctgtgggtagtcctggagtcaacggtgctcctggtgaagctggtcgtgatggcaaccctgggaacgatggtcccccaggtcgcgatggtcaacccggacacaagggagagcgcggttaccctggcaatattggtcccgttggtgctgcaggtgcacctggtcctcatggccccgtgggtcctgctggcaaacatggaaaccgtggtgaaactggtccttctggtcctgttggtcctgctggtgctgttggcccaagaggtcctagtggcccacaaggcattcgtggcgataagggagagcccggtgaaaaggggcccagaggtcttcctggcttaaagggacacaatggattgcaaggtctgcctggtatcgctggtcaccatggtgatcaaggtgctcctggctccgtgggtcctgctggtcctaggggccctgctggtccttctggccctgctggaaaagatggtcgcactggacatcctggtacagttggacctgctggcattcgaggccctcagggtcaccaaggccctgctggcccccctggtccccctggccctcctggacctccaggtgtaagcggtggtggttatgactttggttacgatggagacttctacagggctgaccagcctcgctcagcaccttctctcagacccaaggactatgaagttgatgctactctgaagtctctcaacaaccagattgagacccttcttactcctgaaggctctagaaagaacccagctcgcacatgccgtgacttgagactcagccacccagagtggagcagtggttactactggattgaccctaaccaaggatgcactatggatgctatcaaagtatactgtgatttctctactggcgaaacctgtatccgggcccaacctgaaaacatcccagccaagaactggtataggagctccaaggacaagaaacacgtctggctaggagaaactatcaatgctggcagccagtttgaatataatgtagaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacatttgcaccacttgtggcttttgaatatcttccacagagggaagtttaaaacccaaacttccaaaggtttaaactacctcaaaacactttcccatgagtgtgatccacattgttaggtgctgacctagacagagatgaactgaggtccttgttttgttttgttcataatacaaaggtgctaattaatagtatttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaatcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggttttccaaaagaacatat

SEQ ID NO: 1088 - DNA, 5543 bp, Homo sapiens
gtgagggaagccaaactttttcctatttaaggccaaagcaaaggaatctcagtggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcagggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcatctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcatgccacaggggattctcctccttcatcctgtaaaggtcaacaataaaaaccaaattatggggctgcttttgtcacactagcatagagaatgtgttgaaatttaactttgtaagcttgtatgtggttgttgatcttttttttccttacagacacccataataaaatatcatattaaaattc

SEQ ID NO: 1089 - DNA, 4581 bp, Homo sapiens
ggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcagggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggactctttggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcatctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcatgccacaggggattctcctccttcatcctgtaaaggtcaacaataaaaaccaaattatggggctgcttttgtcacactagcatagagaatgtgttgaaatttaactttgtaagcttgtatgtggttgttgatcttttttttccttacagacacccataataaaatatcatattaaaattc

SEQ ID NO: 1090 - DNA, 6264 bp, Homo sapiens
gagtgtggctgcagtgcgccgggacaccagggctccgcgctccgcactcaagaggctcccgcgtcccaacccctcgcgcccgcgcgttcgcggatccaggccgaggaccgaaaggggccgcccgagcccccggggccggcgcccagagagcccagcaaggccggccgccctgccggtgtgccgccggcgggtgcttctggaagggccaatgcgttcgggcagcagcccctgaagccgagcccgaggctaagtgggactgaccggggcccagagtggacgaaccgccagcatggggagagaccagcgcgcggtggccggccctgccctacggcggtggctgctgctggggacagtgaccgtggggttcctcgcccagagcgtcttggcgggtgtgaagaagtttgatgtgccgtgtggaggaagagattgcagtgggggctgccagtgctaccctgagaaaggtggacgtggtcagcctgggccagtgggcccccaggggtacaatgggccaccaggattacaaggattcccgggactgcagggacgtaaaggagacaagggtgaaaggggagcccccggagtaacgggacccaagggcgacgtgggagcaagaggcgtttctggattccctggtgccgatggaattcctggacacccggggcaaggtgggcccaggggaaggccgggctacgatggctgcaacggaacccagggagactcaggtccacaggggccccccggctctgaggggttcaccgggcctcccgggccccaaggaccaaaagggcagaaaggtgagccttatgcactgcctaaagaggagcgcgacagatatcggggtgaacctggagagcctggattggtcggtttccagggacctcccggccgccctgggcatgtgggacagatgggtccagttggagctccagggagaccaggaccatcgtccgatgagagctttaagaacaagttgaagaataagggcttaaattattatactgtaaatagtatgcagggtgacgtagggcagccgggacccaacgggattccatcagacaccctccaccccatcatcgcgcccacaggagtcaccttccacccagatcagtacaagggccctgttggctggaggggccgcccctgggttgctggcatttccttgaagggagaagaaggaatcatgggctttcctggactgaggggttaccctggcttgagtggtgaaaaaggatcaccaggacagaagggaagccgaggcctggatggctatcaagggcctgatggaccccggggacccaagggagaagccggagacccagggccccctggactacctgcctactcccctcacccttccctagcaaaaggtgccagaggtgacccgggattcccaggggcccaaggggagccaggaagccagggtgagccaggagacccgggcctcccaggtccccctggcctctccatcggagatggagatcagaggagaggcctgccgggtgagatgggacccaagggcttcatcggagaccccggcatccctgcgctctacgggggcccacctggacctgatggaaagcgagggcctccaggaccccccgggctccctggaccacctggacctgatggcttcctgtttgggctgaaaggagcaaaaggaagagcaggcttccctgggcttcccggctcccctggagcccgcggaccaaaggggtggaaaggtgacgctggggaatgcagatgtacagaaggcgacgaagctatcaaaggtcttccgggactgccaggacccaagggcttcgcaggcatcaacggggagccggggaggaaaggggacagaggagaccccggccaacacggcctccctgggttcccagggctcaagggagtgcctggcaacattggtgctcccggacccaaaggagcaaaaggagattccagaacaatcacaaccaaaggtgagcggggacagcccggcgtcccaggtgtgcccgggatgaaaggtgacgatggcagcccaggccgcgatgggctcgatggattccccggcctcccaggccctcccggtgatggcatcaagggccctccaggggacccaggctatccaggaatacctggaacgaagggtactccaggagaaatgggccccccaggactgggccttcccggcctcaaaggccaacgtggtttccctggagacgccggcttacctggaccaccaggcttcctgggccctcctggccccgcagggaccccaggacaaatagattgtgacacagatgtgaaaagggccgttggaggtgacagacaggaggccatccagccaggttgcataggagggcccaagggattgccaggcctgccaggacccccaggccccacaggtgccaaaggcctccgaggaatcccaggcttcgcaggagctgatggaggaccagggcccaggggcttgccaggagacgcaggtcgtgaagggttcccaggacccccagggttcataggaccccgaggatccaaaggtgcagtgggcctccctggcccagatggatccccaggtcccatcggcctgccagggccagatgggccccctggggaaaggggcctccctggagaagtcctgggagctcagcccgggccacggggagatgctggtgtgcctggacagcctgggcttaaaggccttcccggagacagaggcccccctggattcagaggaagccaagggatgcctgggatgccagggctgaagggccagccaggcctcccaggaccttccggccagccaggcctgtatgggcctccaggactgcatggattcccaggagctcctggccaagaggggcccttggggctgccaggaatcccaggccgtgaaggtctgcctggtgatagaggggaccctggggacacaggcgctcctggccctgtgggcatgaaaggtctctctggtgacagaggagatgctggcttcacaggggagcaaggccatccaggaagccctggatttaaaggaattgatggaatgcctgggacccccgggctaaaaggagatagaggctcacctgggatggatggtttccaaggcatgcctggactcaaagggagacccgggtttccagggagcaaaggcgaggctggatttttcggaatacccggtctgaagggtctggctggtgagccaggttttaaaggcagccgaggggaccctgggcccccaggaccacctcctgtcatcctgccaggaatgaaagacattaaaggagagaaaggagatgaagggcctatggggctgaaaggatacctgggcgcaaaaggtatccaaggaatgccaggcatcccagggctgtcaggaatccctgggctgcctgggaggcccggccacatcaaaggagtcaagggagacatcggagtccccggcatccccggtttgccaggattccctggggtggctggcccccctggaattacgggattcccaggattcataggaagccggggtgacaaaggtgccccagggagagcaggcctgtatggcgagattggcgcgactggtgatttcggtgacatcggggacactataaatttaccaggaagaccaggcctgaagggggagcggggcaccactggaataccaggtctgaagggattctttggagagaagggaacagaaggtgacatcggcttccctgggataacaggcgtgactggagtccaaggccctcctggacttaaaggacaaacaggctttccagggctgactgggcctccagggtcgcagggagagctggggcggattggactgcctggtggcaaaggagatgatggctggccgggagctccgggcttaccaggttttccgggactccgtgggatccgcggcttacacggcttgccaggcaccaagggctttccaggatccccaggttctgacatccacggagacccaggcttcccaggccctcctggggaaagaggtgacccaggagaggccaacacccttccaggccctgtgggagtcccaggacagaaaggagaccaaggagctccaggggaacgaggcccacctgggagcccaggacttcaggggttccctggtatcacacccccttccaacatctctggggcacctggtgacaaaggggcgccagggatatttggcctgaaaggttatcggggcccaccagggccaccaggttctgctgctcttcctggaagcaaaggtgacacagggaacccaggagctccaggaaccccagggaccaaaggatgggccggggactccgggccccagggcaggcctggtgtgtttggtctcccaggagaaaaagggcccaggggtgaacaaggcttcatggggaacactggacccactggggcggtgggcgacagaggccccaagggacccaagggagacccaggattccctggtgcccccgggactgtgggagcccccgggattgcaggaatcccccagaagattgccgtccaaccagggacagtgggtccccaggggaggcgaggcccccctggggcaccgggggagatggggccccagggcccccccggagaaccaggtttccgtggggctccagggaaagctgggccccaaggaagaggtggtgtgtctgctgttcccggcttccggggagatgaaggacccataggccaccaggggccgattggccaagaaggtgcaccaggccgtccagggagcccgggcctgccgggtatgccaggccgcagcgtcagcatcggctacctcctggtgaagcacagccagacggaccaggagcccatgtgcccagtgggcatgaacaaactctggagtggatacagcctgctgtacttcgagggccaggagaaggcgcacaaccaggacctggggctggcgggctcctgcctggcgcggttcagcaccatgcccttcctgtactgcaaccctggtgatgtctgctactatgccagccggaacgacaagtcctactggctctctaccactgcgccgctgcccatgatgcccgtggccgaggacgagatcaagccctacatcagccgctgttctgtgtgtgaggccccggccatcgccatcgcggtccacagtcaggatgtctccatcccacactgcccagctgggtggcggagtttgtggatcggatattccttcctcatgcacacggcggcgggagacgaaggcggtggccaatcactggtgtcaccgggcagctgtctagaggacttccgcgccacaccattcatcgaatgcaatggaggccgcggcacctgccactactacgccaacaagtacagcttctggctgaccaccattcccgagcagagcttccagggctcgccctccgccgacacgctcaaggccggcctcatccgcacacacatcagccgctgccaggtgtgcatgaagaacctgtgagccggcgcgtgccaggaagggccattttggtgcttattcttaacttattacctcaggtgccaacccaaaaattggttttatttttttcttaaaaaaaaaaaagtctaccaaaggaatttgcatccagcagcagcacttagacctgccagccactgtcaccgagcgggtgcaagcactcggggtccctggagggcaagccctgcccacagaaagccaggagcagccctggcccccatcagccctgctagacgcaccgcctgaaggcacagctaaccacttcgcacacacccatgtaaccactgcactttccaatgccacagacaactcacattgttcaactcccttctcggggtgggacagacgagacaacagcacacaggcagccagccgtggccagaggctcgaggggctcagggcctcaggcacccgtccccacacgagggccccgtgggtgggcctggccctgctttctacgccaatgttatgccagctccatgttctcccaaataccgttgatgtgaattattttaaaggcaaaaccgtgctctttattttaaaaaacactgataatcacactgcggtaggtcattcttttgccacatccctatagaccactgggtttggcaaaactcaggcagaagtggagacctttctagacatcattgtcagccttgctacttgaaggtacaccccatagggtcggaggtgctgtccccactgccccacgttgtccctgagatttaacccctccactgctgggggtgagctgtactcttctgactgccccctcctgtgtaacgactacaaaataaaacttggttctgaatatttttaaa

SEQ ID NO: 1091 - DNA, 6281 bp, Homo sapiens
gggagcgcgcggcccgggagtgtggctgcagtgcgccgggacaccagggctccgcgctccgcactcaagaggctcccgcgtcccaacccctcgcgcccgcgcgttcgcggatccaggccgaggaccgaaaggggccgcccgagcccccggggccggcgcccagagagcccagcaaggccggccgccctgccggtgtgccgccggcgggtgcttctggaagggccaatgcgttcgggcagcagcccctgaagccgagcccgaggctaagtgggactgaccggggcccagagtggacgaaccgccagcatggggagagaccagcgcgcggtggccggccctgccctacggcggtggctgctgctggggacagtgaccgtggggttcctcgcccagagcgtcttggcgggtgtgaagaagtttgatgtgccgtgtggaggaagagattgcagtgggggctgccagtgctaccctgagaaaggtggacgtggtcagcctgggccagtgggcccccaggggtacaatgggccaccaggattacaaggattcccgggactgcagggacgtaaaggagacaagggtgaaaggggagcccccggagtaacgggacccaagggcgacgtgggagcaagaggcgtttctggattccctggtgccgatggaattcctggacacccggggcaaggtgggcccaggggaaggccgggctacgatggctgcaacggaacccagggagactcaggtccacaggggccccccggctctgaggggttcaccgggcctcccgggccccaaggaccaaaagggcagaaaggtgagccttatgcactgcctaaagaggagcgcgacagatatcggggtgaacctggagagcctggattggtcggtttccagggacctcccggccgccctgggcatgtgggacagatgggtccagttggagctccagggagaccaggaccacctggaccccctggaccaaaaggacagcaaggcaacagaggacttggtttctacggagttaagggtgaaaagggtgacgtagggcagccgggacccaacgggattccatcagacaccctccaccccatcatcgcgcccacaggagtcaccttccacccagatcagtacaagggtgaaaaaggcagtgagggggaaccaggaataagaggcatttccttgaagggagaagaaggaatcatgggctttcctggactgaggggttaccctggcttgagtggtgaaaaaggatcaccaggacagaagggaagccgaggcctggatggctatcaagggcctgatggaccccggggacccaagggagaagccggagacccagggccccctggactacctgcctactcccctcacccttccctagcaaaaggtgccagaggtgacccgggattcccaggggcccaaggggagccaggaagccagggtgagccaggagacccgggcctcccaggtccccctggcctctccatcggagatggagatcagaggagaggcctgccgggtgagatgggacccaagggcttcatcggagaccccggcatccctgcgctctacgggggcccacctggacctgatggaaagcgagggcctccaggaccccccgggctccctggaccacctggacctgatggcttcctgtttgggctgaaaggagcaaaaggaagagcaggcttccctgggcttcccggctcccctggagcccgcggaccaaaggggtggaaaggtgacgctggggaatgcagatgtacagaaggcgacgaagctatcaaaggtcttccgggactgccaggacccaagggcttcgcaggcatcaacggggagccggggaggaaaggggacagaggagaccccggccaacacggcctccctgggttcccagggctcaagggagtgcctggcaacattggtgctcccggacccaaaggagcaaaaggagattccagaacaatcacaaccaaaggtgagcggggacagcccggcgtcccaggtgtgcccgggatgaaaggtgacgatggcagcccaggccgcgatgggctcgatggattccccggcctcccaggccctcccggtgatggcatcaagggccctccaggggacccaggctatccaggaatacctggaacgaagggtactccaggagaaatgggccccccaggactgggccttcccggcctcaaaggccaacgtggtttccctggagacgccggcttacctggaccaccaggcttcctgggccctcctggccccgcagggaccccaggacaaatagattgtgacacagatgtgaaaagggccgttggaggtgacagacaggaggccatccagccaggttgcataggagggcccaagggattgccaggcctgccaggacccccaggccccacaggtgccaaaggcctccgaggaatcccaggcttcgcaggagctgatggaggaccagggcccaggggcttgccaggagacgcaggtcgtgaagggttcccaggacccccagggttcataggaccccgaggatccaaaggtgcagtgggcctccctggcccagatggatccccaggtcccatcggcctgccagggccagatgggccccctggggaaaggggcctccctggagaagtcctgggagctcagcccgggccacggggagatgctggtgtgcctggacagcctgggcttaaaggccttcccggagacagaggcccccctggattcagaggaagccaagggatgcctgggatgccagggctgaagggccagccaggcctcccaggaccttccggccagccaggcctgtatgggcctccaggactgcatggattcccaggagctcctggccaagaggggcccttggggctgccaggaatcccaggccgtgaaggtctgcctggtgatagaggggaccctggggacacaggcgctcctggccctgtgggcatgaaaggtctctctggtgacagaggagatgctggcttcacaggggagcaaggccatccaggaagccctggatttaaaggaattgatggaatgcctgggacccccgggctaaaaggagatagaggctcacctgggatggatggtttccaaggcatgcctggactcaaagggagacccgggtttccagggagcaaaggcgaggctggatttttcggaatacccggtctgaagggtctggctggtgagccaggttttaaaggcagccgaggggaccctgggcccccaggaccacctcctgtcatcctgccaggaatgaaagacattaaaggagagaaaggagatgaagggcctatggggctgaaaggatacctgggcgcaaaaggtatccaaggaatgccaggcatcccagggctgtcaggaatccctgggctgcctgggaggcccggccacatcaaaggagtcaagggagacatcggagtccccggcatccccggtttgccaggattccctggggtggctggcccccctggaattacgggattcccaggattcataggaagccggggtgacaaaggtgccccagggagagcaggcctgtatggcgagattggcgcgactggtgatttcggtgacatcggggacactataaatttaccaggaagaccaggcctgaagggggagcggggcaccactggaataccaggtctgaagggattctttggagagaagggaacagaaggtgacatcggcttccctgggataacaggcgtgactggagtccaaggccctcctggacttaaaggacaaacaggctttccagggctgactgggcctccagggtcgcagggagagctggggcggattggactgcctggtggcaaaggagatgatggctggccgggagctccgggcttaccaggttttccgggactccgtgggatccgcggcttacacggcttgccaggcaccaagggctttccaggatccccaggttctgacatccacggagacccaggcttcccaggccctcctggggaaagaggtgacccaggagaggccaacacccttccaggccctgtgggagtcccaggacagaaaggagaccaaggagctccaggggaacgaggcccacctgggagcccaggacttcaggggttccctggtatcacacccccttccaacatctctggggcacctggtgacaaaggggcgccagggatatttggcctgaaaggttatcggggcccaccagggccaccaggttctgctgctcttcctggaagcaaaggtgacacagggaacccaggagctccaggaaccccagggaccaaaggatgggccggggactccgggccccagggcaggcctggtgtgtttggtctcccaggagaaaaagggcccaggggtgaacaaggcttcatggggaacactggacccactggggcggtgggcgacagaggccccaagggacccaagggagacccaggattccctggtgcccccgggactgtgggagcccccgggattgcaggaatcccccagaagattgccgtccaaccagggacagtgggtccccaggggaggcgaggcccccctggggcaccgggggagatggggccccagggcccccccggagaaccaggtttccgtggggctccagggaaagctgggccccaaggaagaggtggtgtgtctgctgttcccggcttccggggagatgaaggacccataggccaccaggggccgattggccaagaaggtgcaccaggccgtccagggagcccgggcctgccgggtatgccaggccgcagcgtcagcatcggctacctcctggtgaagcacagccagacggaccaggagcccatgtgcccagtgggcatgaacaaactctggagtggatacagcctgctgtacttcgagggccaggagaaggcgcacaaccaggacctggggctggcgggctcctgcctggcgcggttcagcaccatgcccttcctgtactgcaaccctggtgatgtctgctactatgccagccggaacgacaagtcctactggctctctaccactgcgccgctgcccatgatgcccgtggccgaggacgagatcaagccctacatcagccgctgttctgtgtgtgaggccccggccatcgccatcgcggtccacagtcaggatgtctccatcccacactgcccagctgggtggcggagtttgtggatcggatattccttcctcatgcacacggcggcgggagacgaaggcggtggccaatcactggtgtcaccgggcagctgtctagaggacttccgcgccacaccattcatcgaatgcaatggaggccgcggcacctgccactactacgccaacaagtacagcttctggctgaccaccattcccgagcagagcttccagggctcgccctccgccgacacgctcaaggccggcctcatccgcacacacatcagccgctgccaggtgtgcatgaagaacctgtgagccggcgcgtgccaggaagggccattttggtgcttattcttaacttattacctcaggtgccaacccaaaaattggttttatttttttcttaaaaaaaaaaaagtctaccaaaggaatttgcatccagcagcagcacttagacctgccagccactgtcaccgagcgggtgcaagcactcggggtccctggagggcaagccctgcccacagaaagccaggagcagccctggcccccatcagccctgctagacgcaccgcctgaaggcacagctaaccacttcgcacacacccatgtaaccactgcactttccaatgccacagacaactcacattgttcaactcccttctcggggtgggacagacgagacaacagcacacaggcagccagccgtggccagaggctcgaggggctcagggcctcaggcacccgtccccacacgagggccccgtgggtgggcctggccctgctttctacgccaatgttatgccagctccatgttctcccaaataccgttgatgtgaattattttaaaggcaaaaccgtgctctttattttaaaaaacactgataatcacactgcggtaggtcattcttttgccacatccctatagaccactgggtttggcaaaactcaggcagaagtggagacctttctagacatcattgtcagccttgctacttgaaggtacaccccatagggtcggaggtgctgtccccactgccccacgttgtccctgagatttaacccctccactgctgggggtgagctgtactcttctgactgccccctcctgtgtaacgactacaaaataaaacttggttctgaatatttttaaa

SEQ ID NO: 1092 - DNA, 491 bp, Homo sapiens
agttaacaatttctatacagttaagtggatttagtgagtatcattcttccaggagagaagtaaaatttttttttaaagaggaaaacaaagaacaagattaagaacagtaaaagaataagtatggaaaatctggctaagtgggactgaccggggcccagagtggacgaaccgccagcatggggagagaccagcgcgcggtggccggccctgccctacggcggtggctgctgctggggacagtgaccgtggggttcctcgcccagagcgtcttggcgggtgtgaagaagtttgatgtgccgtgtggaggaagagattgcagtgggggctgccagtgctaccctgagaaaggtggacgtggtcagcctgggccagtgggcccccaggggtacaatgggccaccaggattacaaggattcccgggactgcagggacgtaaaggagacaagggtgaaaggggagcccccggagtaacgggacccaagggcgacgtg

SEQ ID NO: 1093 - DNA, 7918 bp, Homo sapiens
gggagggacgaaccgcgcgaccgagccctacaaaacccgccccggccgagtggcgaggcgagctttccagccgggctcccagagccgcgctgcgcaggagacgcggtggcctgagagcctgagggtccccggactcgcccaggctctgagcgcgcgcccaccatgagcgcccggaccgcccccaggccgcaggtgctcctgctgccgctcctgctggtgctcctggcggcggcgcccgcagccagcaagggttgtgtctgtaaagacaaaggccagtgcttctgtgacggggccaaaggggagaagggggagaagggctttcctggaccccccggttctcctggccagaaaggattcacaggtcctgaaggcttgcctggaccgcagggacccaagtcgtttcgagctattcccagttatagtggaggaaaaagtcttcagggaataagtggattgccaggattttctggttctcctggacttccaggcaccccaggcaataccgggccttacggacttgtcggtgtaccaggatgcagtggttctaagggtgagcaggggtttccaggactcccagggacactgggctacccagggatcccgggaatacataacttgaaaattttcaagggtgctcctgctaaagaagaagatatagaacttgatgcaaaaggcgaccccgggttgccaggggctccaggaccccagggtttgccaggccctccaggttttcctgggcctgttggcccacctggtcctccgggattctttggctttccaggagccatgggacctagaggacctaagtcatttgttctatcttcccgtataagcactaaaggggaaaagggtgtgaaagggttaacaggacccccgggaccaccaggaacagttattgtgaccctaactggcccagataacagaacggacctcaagggggaaaagggagacaagggagcaatgggcgagcctggacctcctggaccctcaggactgcctggagaatcatatggatctgaaaagggtgctcctggagaccctggcctgcagggaaaacccggaaaagatggtgttcctggcttccctggaagtgagggagtcaagggcaacaggggtttccctgggttaatgggtgaagatggcattaaggaagaaaagagagatgtggcaattgtttctttctcctctaagacagaatattatgacacataccaggaaaagggagatgaaggcactccaggcccaccagggcccagaggagctcgtggcccacaaggtaagaataaatttcgttgtataccaggaagccaaggatcatcaaggcctggcctcagaggagcccctggatggccaggcctgaaaggaagtaaaggggaacgaggccgcccaggaaaggatgccatggggactcctgggtccccaggttgtgctggttcaccaggtcttccaggatcaccgggacctccaggaccgccaggtgacatcgtttttcgcaagggtccacctggagatcacggactgccaggctatctagggtctccaggaatcccaggagttgatgggcccaaaggagaaccaggcctcctgtgtacacagtgcccttatatcccagggcctcccggtctcccaggattgccagggttacatggtgtaaaaggaatcccaggaagacaaggcgcagctggcttgaaaggaagcccagggtccccaggaaatacaggtcttccaggatttccaggtttcccaggtgcccagggtgacccaggacttaaaggagaaaaaggtgaaacacttcagcctgaggggcaagtgggtgtcccaggtgacccggggctcagaggccaacctgggagaaagggcttggatggaattcctggaactccgggagtgaaaggattaccaggacctaaaggcgaactggctctgagtggtgagaaaggggaccaaggtcctccaggggatcctggctcccctgggtccccaggacctgcaggaccagctggaccacctggctacggaccccaaggagaacctggtctccagggcacgcaaggagttcctggagcccccggaccacccggagaagccggccctaggggagagctcagtgtttcaacaccagttccaggcccaccaggacctccagggccccctggccatcctggcccccaaggtccacctggtatccctggatccctggggaaatgtggagatcctggtcttccagggcctgatggtgaaccaggaattccaggaattggatttcctgggcctcctggacctaagggagaccaaggttttccaggtacaaaaggatcactgggttgtcctggaaaaatgggagagcctgggttacctggaaagccaggcctcccaggagccaagggagaaccagcagtagccatgcctggaggaccaggaacaccaggttttccaggagaaagaggcaattctggggaacatggagaaattggactccctggacttccaggtctccctggaactccaggaaatgaagggcttgatggaccacgaggagatccagggcagcctggaccacctggagaacaaggacccccaggaaggtgcatagagggtcccaggggagcccaaggacttccaggcttaaatggattgaaagggcaacaaggcagaagaggtaaaacggggccaaagggagacccaggaattccaggcttggatagatcaggatttcctggagaaactggatcaccaggaattccaggtcatcaaggtgaaatgggaccactgggtcaaagaggatatccaggaaatccgggaattttagggccaccaggtgaagatggagtgattgggatgatgggctttcctggagccattggccctccagggccccctgggaacccaggcacaccagggcagagggggagccctggaattccaggagtaaagggccagagaggaaccccaggagccaagggggaacaaggagataaaggaaatcccgggccttcagagatatcccacgtaataggggacaaaggagaaccaggtctcaaaggattcgcaggaaatccaggtgagaaaggaaacagaggcgttccagggatgccaggtttaaagggcctcaaaggactacccggaccagcaggaccaccaggccccagaggagatttgggcagcactgggaatcctggagaaccaggactgcgtggtataccaggaagcatggggaacatgggcatgccaggttctaaaggaaaaaggggaactttgggattcccaggtcgagcaggaagaccaggcctcccaggtattcatggtctccagggagataagggagagccaggttattcagaaggtacaaggccaggaccaccgggaccaacgggggatccaggactgccgggtgatatgggaaagaaaggagaaatggggcaacctggcccacctggacatttggggcctgctggacctgagggagcccctggaagtcctggaagtcctggcctcccaggaaagccaggtcctcatggtgatttgggttttaaaggaatcaaaggcctcctgggccctccaggaatcagaggccctccaggtcttccaggatttccaggatctcctggaccaatgggtataagaggtgaccaaggacgtgatggaattcctggtccagccggagaaaagggagaaacgggtttattgagggcccctccaggcccaagagggaaccctggtgctcaaggagccaaaggagacaggggagccccaggttttcctggcctcccgggcagaaaaggggccatgggagatgctggacctcgaggacccacaggcatagaaggattcccagggccaccaggtctgcccggtgcaattatccctggccagacaggaaatcgtggtccaccaggctcaagaggaagcccaggtgcgcctggtccccctggacctccagggagtcatgtaataggcataaaaggagacaaagggtctatgggccaccctggcccaaaaggtccacctggaactgcaggagacatgggaccaccaggtcgtctgggagcaccaggtactccaggtcttccaggacccagaggtgatcctggattccaggggtttccaggcgtgaaaggagaaaagggtaatcctggatttctaggatccattggacctccaggaccaattgggccaaaaggaccacctggtgtacgtggagaccctggcacacttaagattatctcccttccaggaagcccagggccacctggcacacctggagaaccagggatgcagggagaacctgggccaccagggccacctggaaacctaggaccctgtgggccaagaggtaagccaggcaaggatggaaaaccaggaactcctggaccagctggagaaaaaggcaacaaaggttctaaaggagagccaggaccagctggatcagatggattgccaggtttgaaaggaaaacgtggagacagtggatcacctgcaacctggacaacgagaggctttgtcttcacccgacacagtcaaaccacagcaattccttcatgtccagaggggacagtgccactctacagtgggttttcttttctttttgtacaaggaaatcaacgagcccacggacaagaccttgatgcactgtttgtgaaggtcctgcgatcgccatagccgttcacagccaaaccactgacattcctccatgtcctcacggctggatttctctctggaaaggattttcattcatcatgttcacaagtgcaggttctgagggcaccgggcaagcactggcctcccctggctcctgcctggaagaattccgagccagcccatttctagaatgtcatggaagaggaacgtgcaactactattcaaattcctacagtttctggctggcttcattaaacccagaaagaatgttcagaaagcctattccatcaactgtgaaagctggggaattagaaaaaataataagtcgctgtcaggtgtgcatgaagaaaagacactgaagctaaaaaagacagcagaactgctatttttcatcctaaagaacaaagtaatgacagaacatgctgttatttaggtatttttctttaaccaaacaatattgctccatgatgacttagtacaaagtttcaatttgtttccccacaaaacaaagcaattctttcaagtcagttctgtgatctgggtctctaatctgtgctgtttcaaagttctctgtggcaaagcagcaactattcacaaaatatcaccaaaaacctattccacttacatccaaggcactgtcactacggtgattgtatgaagtttgaatgctgcaagttatgaaatatttggcccgctggattcccacatttgtcttctttctgtctttaagactcagggaggctaaatcagtgtttgattgccccgccaacccttcctgaaacttcagaccctgggtaggggaagagaagggggcatgtggtatcctggagcattgtgtatagaactggattttcagacctgctgaggaccgtaaggcctgatggaacacagaactgaactgaggttcatggattttccaggactgtttcaaacatgcccattactaacggcaaaagggggattccctgatggaaccataatacccttggaaatactgtatggttttgttttgttttgttggtttttaaagatttttgtttgtttattgaattcatttcactgtagctctaaaatctgcttgtattccaagcatataaaattttcccccttagtgaattagttttaaaatgatattgttatatacatactatgaaatatgtataactttaacttctgttttaccagcatacccacacaaataacaagaatactacttatgaaatgtgcactttatcctcattccataaatgtcggtgcataccttatgtaagggagcagttcaataatccatgaaagaacttaaggcatttgttggtttatcagactcggaatctattttctcattgctctgaatatgtcatcactctaggttttacagatttattcctttgttacttctctaattcttcctttgtaaaaaaaaaaaaaagcaacactttttatgttatatgttgttcttacaaaccatactgaaagagtccattgtttaaaaatcttaatgtatcaaactgtataacttggccgctgtatgtcttaaaacctgcttttcaatgtgttgatacattcccaaggttacttaattcaacttaactatcatcttattcagcaccaagcatgtcccaggcactgtactaacctacagagatgctaagagaaaaaaaagacttgtttctgatctaatatcccagaaaaagtaactcattgctctgttaataatctcacatatacaagtagcttccctcccctctagttttttcttccttttcactgctgttatatttcatcatgataattcagcaggcccaagtaaaggttaaaaataaggtctatgcctagggaaactcagggcttctagtttctcttagaaaagctaagagaagataaggtctgaataatagcagaaaaaccaacatctacaaaacattaaactagtgttatacttgatgataacactatttgatgagtcttagagtccagacacaaagagacaaagctttgaagatgctttttgatctacctaggtggagttggtggtgctgatatttaaattcaggctactgcttcaatctcaattgctttgtaagtgaaaaacatgacccagaggacagcacagactatggccatggctcacatggtttacatccttcactgctcacgtgtttgctgtcaagccatttttacatctaaactaagatgtgcagcatttcacttatttagattcacttaacaaacaaatttttctgctttaaaaatgtcttattgtcccaagtgtactatagcggcatatagagctagctaatctctacaaaccctctgtaggccagtagttctcaaagtgtggtctctggaagagcagtatcagcatcatctgggaacttgtcacagatgcagattctagggaccactccagacctacacaatcagaaactcttgggggagggcccgaaatatctatgttttaccaagcccaccacatgattctgatgtactctaaatactgagaaaacctgttctagacaaatacccaagcaacaactccgcaggcagttaccaagtacggctggctacaactgctccatccgtgcctctttttaaagttcaaactcacaggtgactctaaggttatctacttttactcataagtaaaagccctagactggtgctaatgtcaaaccactggcctccactcaggcctccatcttctcatgccctcttaccagtatttaacttctgaggaagacaagtgatgctaaaacctgaaattccaatgaagccatatgaacagctgttcagttgcacttctaagactttacttagcagtaaattatagctcatgtgcattattttccagataacttagcttatgagtagcttatacaattatgaagatttaatattacagataaaatgtaaactgtttctttaaaattggggcttcaactttggaatttcacagcgtgctaaaataacagatttctcagaagtctttcagcaagataaacattattaagtaacttatttatgaaagtattaaaatgcttacatttgaacttgatggctaacttacaaagattctctatgtatcaaatgtaacttactgcgactaaacttaatttaatatttactctataaccaaatgaaatatatttaaaatatattgaatattttatattgttatatcctgacaagattataatattttaatgtactaatatttctgtaattatatctaaaatattattttattatattgcctaagaataaacatttgttaaattgg

SEQ ID NO: 1094 - DNA, 7923 bp, Homo sapiens
gggagggacgaaccgcgcgaccgagccctacaaaacccgccccggccgagtggcgaggcgagctttccagccgggctcccagagccgcgctgcgcaggagacgcggtggcctgagagcctgagggtccccggactcgcccaggctctgagcgcgcgcccaccatgagcgcccggaccgcccccaggccgcaggtgctcctgctgccgctcctgctggtgctcctggcggcggcgcccgcagccagcaagggttgtgtctgtaaagacaaaggccagtgcttctgtgacggggccaaaggggagaagggggagaagggctttcctggaccccccggttctcctggccagaaaggattcacaggtcctgaaggcttgcctggaccgcagggacccaagtcgtttcgagctattcccagttatagtggaggaaaaagtcttcagggaataagtggattgccaggattttctggttctcctggacttccaggcaccccaggcaataccgggccttacggacttgtcggtgtaccaggatgcagtggttctaagggtgagcaggggtttccaggactcccagggacactgggctacccagggatcccgggaatacataacttgaaaattttcaagggtgctcctgctaaagaagaagatatagaacttgatgcaaaaggcgaccccgggttgccaggggctccaggaccccagggtttgccaggccctccaggttttcctgggcctgttggcccacctggtcctccgggattctttggctttccaggagccatgggacctagaggacctaagtcatttgttctatcttcccgtataagcactaaaggggaaaagggtgtgaaagggttaacaggacccccgggaccaccaggaacagttattgtgaccctaactggcccagataacagaacggacctcaagggggaaaagggagacaagggagcaatgggcgagcctggacctcctggaccctcaggactgcctggagaatcatatggatctgaaaagggtgctcctggagaccctggcctgcagggaaaacccggaaaagatggtgttcctggcttccctggaagtgagggagtcaagggcaacaggggtttccctgggttaatgggtgaagatggcattaaggaagaaaagagagatgtggcaattgtttctttctcctctaagacagaatattatgacacataccaggaaaagggagatgaaggcactccaggcccaccagggcccagaggagctcgtggcccacaaggtaagaataaatttcgttgtataccaggaagccaaggatcatcaaggcctggcctcagaggagcccctggatggccaggcctgaaaggaagtaaaggggaacgaggccgcccaggaaaggatgccatggggactcctgggtccccaggttgtgctggttcaccaggtcttccaggatcaccgggacctccaggaccgccaggtgacatcgtttttcgcaagggtccacctggagatcacggactgccaggctatctagggtctccaggaatcccaggagttgatgggcccaaaggagaaccaggcctcctgtgtacacagtgcccttatatcccagggcctcccggtctcccaggattgccagggttacatggtgtaaaaggaatcccaggaagacaaggcgcagctggcttgaaaggaagcccagggtccccaggaaatacaggtcttccaggatttccaggtttcccaggtgcccagggtgacccaggacttaaaggagaaaaaggtgaaacacttcagcctgaggggcaagtgggtgtcccaggtgacccggggctcagaggccaacctgggagaaagggcttggatggaattcctggaactccgggagtgaaaggattaccaggacctaaaggcgaactggctctgagtggtgagaaaggggaccaaggtcctccaggggatcctggctcccctgggtccccaggacctgcaggaccagctggaccacctggctacggaccccaaggagaacctggtctccagggcacgcaaggagttcctggagcccccggaccacccggagaagccggccctaggggagagctcagtgtttcaacaccagttccaggcccaccaggacctccagggccccctggccatcctggcccccaaggtccacctggtatccctggatccctggggaaatgtggagatcctggtcttccagggcctgatggtgaaccaggaattccaggaattggatttcctgggcctcctggacctaagggagaccaaggttttccaggtacaaaaggatcactgggttgtcctggaaaaatgggagagcctgggttacctggaaagccaggcctcccaggagccaagggagaaccagcagtagccatgcctggaggaccaggaacaccaggttttccaggagaaagaggcaattctggggaacatggagaaattggactccctggacttccaggtctccctggaactccaggaaatgaagggcttgatggaccacgaggagatccagggcagcctggaccacctggagaacaaggacccccaggaaggtgcatagagggtcccaggggagcccaaggacttccaggcttaaatggattgaaagggcaacaaggcagaagaggtaaaacggggccaaagggagacccaggaattccaggcttggatagatcaggatttcctggagaaactggatcaccaggaattccaggtcatcaaggtgaaatgggaccactgggtcaaagaggatatccaggaaatccgggaattttagggccaccaggtgaagatggagtgattgggatgatgggctttcctggagccattggccctccagggccccctgggaacccaggcacaccagggcagagggggagccctggaattccaggagtaaagggccagagaggaaccccaggagccaagggggaacaaggagataaaggaaatcccgggccttcagagatatcccacgtaataggggacaaaggagaaccaggtctcaaaggattcgcaggaaatccaggtgagaaaggaaacagaggcgttccagggatgccaggtttaaagggcctcaaaggactacccggaccagcaggaccaccaggccccagaggagatttgggcagcactgggaatcctggagaaccaggactgcgtggtataccaggaagcatggggaacatgggcatgccaggttctaaaggaaaaaggggaactttgggattcccaggtcgagcaggaagaccaggcctcccaggtattcatggtctccagggagataagggagagccaggttattcagaaggtacaaggccaggaccaccgggaccaacgggggatccaggactgccgggtgatatgggaaagaaaggagaaatggggcaacctggcccacctggacatttggggcctgctggacctgagggagcccctggaagtcctggaagtcctggcctcccaggaaagccaggtcctcatggtgatttgggttttaaaggaatcaaaggcctcctgggccctccaggaatcagaggccctccaggtcttccaggatttccaggatctcctggaccaatgggtataagaggtgaccaaggacgtgatggaattcctggtccagccggagaaaagggagaaacgggtttattgagggcccctccaggcccaagagggaaccctggtgctcaaggagccaaaggagacaggggagccccaggttttcctggcctcccgggcagaaaaggggccatgggagatgctggacctcgaggacccacaggcatagaaggattcccagggccaccaggtctgcccggtgcaattatccctggccagacaggaaatcgtggtccaccaggctcaagaggaagcccaggtgcgcctggtccccctggacctccagggagtcatgtaataggcataaaaggagacaaagggtctatgggccaccctggcccaaaaggtccacctggaactgcaggagacatgggaccaccaggtcgtctgggagcaccaggtactccaggtcttccaggacccagaggtgatcctggattccaggggtttccaggcgtgaaaggagaaaagggtaatcctggatttctaggatccattggacctccaggaccaattgggccaaaaggaccacctggtgtacgtggagaccctggcacacttaagattatctcccttccaggaagcccagggccacctggcacacctggagaaccagggatgcagggagaacctgggccaccagggccacctggaaacctaggaccctgtgggccaagaggtaagccaggcaaggatggaaaaccaggaactcctggaccagctggagaaaaaggcaacaaaggttctaaaggagagccaggaccagctggatcagatggattgccaggtttgaaaggaaaacgtggagacagtggatcacctgcaacctggacaacgagaggctttgtcttcacccgacacagtcaaaccacagcaattccttcatgtccagaggggacagtgccactctacagtgggttttcttttctttttgtacaaggaaatcaacgagcccacggacaagaccttggaactcttggcagctgcctgcagcgatttaccacaatgccattcttattctgcaatgtcaatgatgtatgtaattttgcatctcgaaatgattattcatactggctgtcaacaccagctctgatgccaatgaacatggctcccattactggcagagcccttgagccttatataagcagatgcactgtttgtgaaggtcctgcgatcgccatagccgttcacagccaaaccactgacattcctccatgtcctcacggctggatttctctctggaaaggattttcattcatcatgaaagcctattccatcaactgtgaaagctggggaattagaaaaaataataagtcgctgtcaggtgtgcatgaagaaaagacactgaagctaaaaaagacagcagaactgctatttttcatcctaaagaacaaagtaatgacagaacatgctgttatttaggtatttttctttaaccaaacaatattgctccatgatgacttagtacaaagtttcaatttgtttccccacaaaacaaagcaattctttcaagtcagttctgtgatctgggtctctaatctgtgctgtttcaaagttctctgtggcaaagcagcaactattcacaaaatatcaccaaaaacctattccacttacatccaaggcactgtcactacggtgattgtatgaagtttgaatgctgcaagttatgaaatatttggcccgctggattcccacatttgtcttctttctgtctttaagactcagggaggctaaatcagtgtttgattgccccgccaacccttcctgaaacttcagaccctgggtaggggaagagaagggggcatgtggtatcctggagcattgtgtatagaactggattttcagacctgctgaggaccgtaaggcctgatggaacacagaactgaactgaggttcatggattttccaggactgtttcaaacatgcccattactaacggcaaaagggggattccctgatggaaccataatacccttggaaatactgtatggttttgttttgttttgttggtttttaaagatttttgtttgtttattgaattcatttcactgtagctctaaaatctgcttgtattccaagcatataaaattttcccccttagtgaattagttttaaaatgatattgttatatacatactatgaaatatgtataactttaacttctgttttaccagcatacccacacaaataacaagaatactacttatgaaatgtgcactttatcctcattccataaatgtcggtgcataccttatgtaagggagcagttcaataatccatgaaagaacttaaggcatttgttggtttatcagactcggaatctattttctcattgctctgaatatgtcatcactctaggttttacagatttattcctttgttacttctctaattcttcctttgtaaaaaaaaaaaaaagcaacactttttatgttatatgttgttcttacaaaccatactgaaagagtccattgtttaaaaatcttaatgtatcaaactgtataacttggccgctgtatgtcttaaaacctgcttttcaatgtgttgatacattcccaaggttacttaattcaacttaactatcatcttattcagcaccaagcatgtcccaggcactgtactaacctacagagatgctaagagaaaaaaaagacttgtttctgatctaatatcccagaaaaagtaactcattgctctgttaataatctcacatatacaagtagcttccctcccctctagttttttcttccttttcactgctgttatatttcatcatgataattcagcaggcccaagtaaaggttaaaaataaggtctatgcctagggaaactcagggcttctagtttctcttagaaaagctaagagaagataaggtctgaataatagcagaaaaaccaacatctacaaaacattaaactagtgttatacttgatgataacactatttgatgagtcttagagtccagacacaaagagacaaagctttgaagatgctttttgatctacctaggtggagttggtggtgctgatatttaaattcaggctactgcttcaatctcaattgctttgtaagtgaaaaacatgacccagaggacagcacagactatggccatggctcacatggtttacatccttcactgctcacgtgtttgctgtcaagccatttttacatctaaactaagatgtgcagcatttcacttatttagattcacttaacaaacaaatttttctgctttaaaaatgtcttattgtcccaagtgtactatagcggcatatagagctagctaatctctacaaaccctctgtaggccagtagttctcaaagtgtggtctctggaagagcagtatcagcatcatctgggaacttgtcacagatgcagattctagggaccactccagacctacacaatcagaaactcttgggggagggcccgaaatatctatgttttaccaagcccaccacatgattctgatgtactctaaatactgagaaaacctgttctagacaaatacccaagcaacaactccgcaggcagttaccaagtacggctggctacaactgctccatccgtgcctctttttaaagttcaaactcacaggtgactctaaggttatctacttttactcataagtaaaagccctagactggtgctaatgtcaaaccactggcctccactcaggcctccatcttctcatgccctcttaccagtatttaacttctgaggaagacaagtgatgctaaaacctgaaattccaatgaagccatatgaacagctgttcagttgcacttctaagactttacttagcagtaaattatagctcatgtgcattattttccagataacttagcttatgagtagcttatacaattatgaagatttaatattacagataaaatgtaaactgtttctttaaaattggggcttcaactttggaatttcacagcgtgctaaaataacagatttctcagaagtctttcagcaagataaacattattaagtaacttatttatgaaagtattaaaatgcttacatttgaacttgatggctaacttacaaagattctctatgtatcaaatgtaacttactgcgactaaacttaatttaatatttactctataaccaaatgaaatatatttaaaatatattgaatattttatattgttatatcctgacaagattataatattttaatgtactaatatttctgtaattatatctaaaatattattttattatattgcctaagaataaacatttgttaaattgg

SEQ ID NO: 1095 - DNA, 7630 bp, Homo sapiens
gggagggacgaaccgcgcgaccgagccctacaaaacccgccccggccgagtggcgaggcgagctttccagccgggctcccagagccgcgctgcgcaggagacgcggtggcctgagagcctgagggtccccggactcgcccaggctctgagcgcgcgcccaccatgagcgcccggaccgcccccaggccgcaggtgctcctgctgccgctcctgctggtgctcctggcggcggcgcccgcagccagcaagggttgtgtctgtaaagacaaaggccagtgcttctgtgacggggccaaaggggagaagggggagaagggctttcctggaccccccggttctcctggccagaaaggattcacaggtcctgaaggcttgcctggaccgcagggacccaagtcgtttcgagctattcccagttatagtggaggaaaaagtcttcagggaataagtggattgccaggattttctggttctcctggacttccaggcaccccaggcaataccgggccttacggacttgtcggtgtaccaggatgcagtggttctaagggtgagcaggggtttccaggactcccagggacactgggctacccagggatcccgggaatacataacttgaaaattttcaagggtgctcctgctaaagaagaagatatagaacttgatgcaaaaggcgaccccgggttgccaggggctccaggaccccagggtttgccaggccctccaggttttcctgggcctgttggcccacctggtcctccgggattctttggctttccaggagccatgggacctagaggacctaagtcatttgttctatcttcccgtataagcactaaaggggaaaagggtgtgaaagggttaacaggacccccgggaccaccaggaacagttattgtgaccctaactggcccagataacagaacggacctcaagggggaaaagggagacaagggagcaatgggcgagcctggacctcctggaccctcaggactgcctggagaatcatatggatctgaaaagggtgctcctggagaccctggcctgcagggaaaacccggaaaagatggtgttcctggcttccctggaagtgagggagtcaagggcaacaggggtttccctgggttaatgggtgaagatggcattaaggaagaaaagagagatgtggcaattgtttctttctcctctaagacagaatattatgacacataccaggaaaagggagatgaaggcactccaggcccaccagggcccagaggagctcgtggcccacaaggtaagaataaatttcgttgtataccaggaagccaaggatcatcaaggcctggcctcagaggagcccctggatggccaggcctgaaaggaagtaaaggggaacgaggccgcccaggaaaggatgccatggggactcctgggtccccaggttgtgctggttcaccaggtcttccaggatcaccgggacctccaggaccgccaggtgacatcgtttttcgcaagggtccacctggagatcacggactgccaggctatctagggtctccaggaatcccaggagttgatgggcccaaaggagaaccaggcctcctgtgtacacagtgcccttatatcccagggcctcccggtctcccaggattgccagggttacatggtgtaaaaggaatcccaggaagacaaggcgcagctggcttgaaaggaagcccagggtccccaggaaatacaggtcttccaggatttccaggtttcccaggtgcccagggtgacccaggacttaaaggagaaaaaggtgaaacacttcagcctgaggggcaagtgggtgtcccaggtgacccggggctcagaggccaacctgggagaaagggcttggatggaattcctggaactccgggagtgaaaggattaccaggacctaaaggcgaactggctctgagtggtgagaaaggggaccaaggtcctccaggggatcctggctcccctgggtccccaggacctgcaggaccagctggaccacctggctacggaccccaaggagaacctggtctccagggcacgcaaggagttcctggagcccccggaccacccggagaagccggccctaggggagagctcagtgtttcaacaccagttccaggcccaccaggacctccagggccccctggccatcctggcccccaaggtccacctggtatccctggatccctggggaaatgtggagatcctggtcttccagggcctgatggtgaaccaggaattccaggaattggatttcctgggcctcctggacctaagggagaccaaggttttccaggtacaaaaggatcactgggttgtcctggaaaaatgggagagcctgggttacctggaaagccaggcctcccaggagccaagggagaaccagcagtagccatgcctggaggaccaggaacaccaggttttccaggagaaagaggcaattctggggaacatggagaaattggactccctggacttccaggtctccctggaactccaggaaatgaagggcttgatggaccacgaggagatccagggcagcctggaccacctggagaacaaggacccccaggaaggtgcatagagggtcccaggggagcccaaggacttccaggcttaaatggattgaaagggcaacaaggcagaagaggtaaaacggggccaaagggagacccaggaattccaggcttggatagatcaggatttcctggagaaactggatcaccaggaattccaggtcatcaaggtgaaatgggaccactgggtcaaagaggatatccaggaaatccgggaattttagggccaccaggtgaagatggagtgattgggatgatgggctttcctggagccattggccctccagggccccctgggaacccaggcacaccagggcagagggggagccctggaattccaggagtaaagggccagagaggaaccccaggagccaagggggaacaaggagataaaggaaatcccgggccttcagagatatcccacgtaataggggacaaaggagaaccaggtctcaaaggattcgcaggaaatccaggtgagaaaggaaacagaggcgttccagggatgccaggtttaaagggcctcaaaggactacccggaccagcaggaccaccaggccccagaggagatttgggcagcactgggaatcctggagaaccaggactgcgtggtataccaggaagcatggggaacatgggcatgccaggttctaaaggaaaaaggggaactttgggattcccaggtcgagcaggaagaccaggcctcccaggtattcatggtctccagggagataagggagagccaggttattcagaaggtacaaggccaggaccaccgggaccaacgggggatccaggactgccgggtgatatgggaaagaaaggagaaatggggcaacctggcccacctggacatttggggcctgctggacctgagggagcccctggaagtcctggaagtcctggcctcccaggaaagccaggtcctcatggtgatttgggttttaaaggaatcaaaggcctcctgggccctccaggaatcagaggccctccaggtcttccaggatttccaggatctcctggaccaatgggtataagaggtgaccaaggacgtgatggaattcctggtccagccggagaaaagggagaaacgggtttattgagggcccctccaggcccaagagggaaccctggtgctcaaggagccaaaggagacaggggagccccaggttttcctggcctcccgggcagaaaaggggccatgggagatgctggacctcgaggacccacaggcatagaaggattcccagggccaccaggtctgcccggtgcaattatccctggccagacaggaaatcgtggtccaccaggctcaagaggaagcccaggtgcgcctggtccccctggacctccagggagtcatgtaataggcataaaaggagacaaagggtctatgggccaccctggcccaaaaggtccacctggaactgcaggagacatgggaccaccaggtcgtctgggagcaccaggtactccaggtcttccaggacccagaggtgatcctggattccaggggtttccaggcgtgaaaggagaaaagggtaatcctggatttctaggatccattggacctccaggaccaattgggccaaaaggaccacctggtgtacgtggagaccctggcacacttaagattatctcccttccaggaagcccagggccacctggcacacctggagaaccagggatgcagggagaacctgggccaccagggccacctggaaacctaggaccctgtgggccaagaggtaagccaggcaaggatggaaaaccaggaactcctggaccagctggagaaaaaggcaacaaaggttctaaaggagagccaggaccagctggatcagatggattgccaggtttgaaaggaaaacgtggagacagtggatcacctgcaacctggacaacgagaggctttgtcttcacccgacacagtcaaaccacagcaattccttcatgtccagaggggacagtgccactctacagtgggttttcttttctttttgtacaaggaaatcaacgagcccacggacaagaccttgaaagcctattccatcaactgtgaaagctggggaattagaaaaaataataagtcgctgtcaggtgtgcatgaagaaaagacactgaagctaaaaaagacagcagaactgctatttttcatcctaaagaacaaagtaatgacagaacatgctgttatttaggtatttttctttaaccaaacaatattgctccatgatgacttagtacaaagtttcaatttgtttccccacaaaacaaagcaattctttcaagtcagttctgtgatctgggtctctaatctgtgctgtttcaaagttctctgtggcaaagcagcaactattcacaaaatatcaccaaaaacctattccacttacatccaaggcactgtcactacggtgattgtatgaagtttgaatgctgcaagttatgaaatatttggcccgctggattcccacatttgtcttctttctgtctttaagactcagggaggctaaatcagtgtttgattgccccgccaacccttcctgaaacttcagaccctgggtaggggaagagaagggggcatgtggtatcctggagcattgtgtatagaactggattttcagacctgctgaggaccgtaaggcctgatggaacacagaactgaactgaggttcatggattttccaggactgtttcaaacatgcccattactaacggcaaaagggggattccctgatggaaccataatacccttggaaatactgtatggttttgttttgttttgttggtttttaaagatttttgtttgtttattgaattcatttcactgtagctctaaaatctgcttgtattccaagcatataaaattttcccccttagtgaattagttttaaaatgatattgttatatacatactatgaaatatgtataactttaacttctgttttaccagcatacccacacaaataacaagaatactacttatgaaatgtgcactttatcctcattccataaatgtcggtgcataccttatgtaagggagcagttcaataatccatgaaagaacttaaggcatttgttggtttatcagactcggaatctattttctcattgctctgaatatgtcatcactctaggttttacagatttattcctttgttacttctctaattcttcctttgtaaaaaaaaaaaaaagcaacactttttatgttatatgttgttcttacaaaccatactgaaagagtccattgtttaaaaatcttaatgtatcaaactgtataacttggccgctgtatgtcttaaaacctgcttttcaatgtgttgatacattcccaaggttacttaattcaacttaactatcatcttattcagcaccaagcatgtcccaggcactgtactaacctacagagatgctaagagaaaaaaaagacttgtttctgatctaatatcccagaaaaagtaactcattgctctgttaataatctcacatatacaagtagcttccctcccctctagttttttcttccttttcactgctgttatatttcatcatgataattcagcaggcccaagtaaaggttaaaaataaggtctatgcctagggaaactcagggcttctagtttctcttagaaaagctaagagaagataaggtctgaataatagcagaaaaaccaacatctacaaaacattaaactagtgttatacttgatgataacactatttgatgagtcttagagtccagacacaaagagacaaagctttgaagatgctttttgatctacctaggtggagttggtggtgctgatatttaaattcaggctactgcttcaatctcaattgctttgtaagtgaaaaacatgacccagaggacagcacagactatggccatggctcacatggtttacatccttcactgctcacgtgtttgctgtcaagccatttttacatctaaactaagatgtgcagcatttcacttatttagattcacttaacaaacaaatttttctgctttaaaaatgtcttattgtcccaagtgtactatagcggcatatagagctagctaatctctacaaaccctctgtaggccagtagttctcaaagtgtggtctctggaagagcagtatcagcatcatctgggaacttgtcacagatgcagattctagggaccactccagacctacacaatcagaaactcttgggggagggcccgaaatatctatgttttaccaagcccaccacatgattctgatgtactctaaatactgagaaaacctgttctagacaaatacccaagcaacaactccgcaggcagttaccaagtacggctggctacaactgctccatccgtgcctctttttaaagttcaaactcacaggtgactctaaggttatctacttttactcataagtaaaagccctagactggtgctaatgtcaaaccactggcctccactcaggcctccatcttctcatgccctcttaccagtatttaacttctgaggaagacaagtgatgctaaaacctgaaattccaatgaagccatatgaacagctgttcagttgcacttctaagactttacttagcagtaaattatagctcatgtgcattattttccagataacttagcttatgagtagcttatacaattatgaagatttaatattacagataaaatgtaaactgtttctttaaaattggggcttcaactttggaatttcacagcgtgctaaaataacagatttctcagaagtctttcagcaagataaacattattaagtaacttatttatgaaagtattaaaatgcttacatttgaacttgatggctaacttacaaagattctctatgtatcaaatgtaacttactgcgactaaacttaatttaatatttactctataaccaaatgaaatatatttaaaatatattgaatattttatattgttatatcctgacaagattataatattttaatgtactaatatttctgtaattatatctaaaatattattttattatattgcctaagaataaacatttgttaaattgg

SEQ ID NO: 1096 - DNA, 7420 bp, Homo sapiens
gggagggacgaaccgcgcgaccgagccctacaaaacccgccccggccgagtggcgaggcgagctttccagccgggctcccagagccgcgctgcgcaggagacgcggtggcctgagagcctgagggtccccggactcgcccaggctctgagcgcgcgcccaccatgagcgcccggaccgcccccaggccgcaggtgctcctgctgccgctcctgctggtgctcctggcggcggcgcccgcagccagcaagggttgtgtctgtaaagacaaaggccagtgcttctgtgacggggccaaaggggagaagggggagaagggctttcctggaccccccggttctcctggccagaaaggattcacaggtcctgaaggcttgcctggaccgcagggacccaagtcgtttcgagctattcccagttatagtggaggaaaaagtcttcagggaataagtggattgccaggattttctggttctcctggacttccaggcaccccaggcaataccgggccttacggacttgtcggtgtaccaggatgcagtggttctaagggtgagcaggggtttccaggactcccagggacactgggctacccagggatcccgggaatacataacttgaaaattttcaagggtgctcctgctaaagaagaagatatagaacttgatgcaaaaggcgaccccgggttgccaggggctccaggaccccagggtttgccaggccctccaggttttcctgggcctgttggcccacctggtcctccgggattctttggctttccaggagccatgggacctagaggacctaagtcatttgttctatcttcccgtataagcactaaaggggaaaagggtgtgaaagggttaacaggacccccgggaccaccaggaacagttattgtgaccctaactggcccagataacagaacggacctcaagggggaaaagggagacaagggagcaatgggcgagcctggacctcctggaccctcaggactgcctggagaatcatatggatctgaaaagggtgctcctggagaccctggcctgcagggaaaacccggaaaagatggtgttcctggcttccctggaagtgagggagtcaagggcaacaggggtttccctgggttaatgggtgaagatggcattaaggaagaaaagagagatgtggcaattgtttctttctcctctaagacagaatattatgacacataccaggaaaagggagatgaaggcactccaggcccaccagggcccagaggagctcgtggcccacaaggtaagaataaatttcgttgtataccaggaagccaaggatcatcaaggcctggcctcagaggagcccctggatggccaggcctgaaaggaagtaaaggggaacgaggccgcccaggaaaggatgccatggggactcctgggtccccaggttgtgctggttcaccaggtcttccaggatcaccgggacctccaggaccgccaggtgacatcgtttttcgcaagggtccacctggagatcacggactgccaggctatctagggtctccaggaatcccaggagttgatgggcccaaaggagaaccaggcctcctgtgtacacagtgcccttatatcccagggcctcccggtctcccaggattgccagggttacatggtgtaaaaggaatcccaggaagacaaggcgcagctggcttgaaaggaagcccagggtccccaggaaatacaggtcttccaggatttccaggtttcccaggtgcccagggtgacccaggacttaaaggagaaaaaggtgaaacacttcagcctgaggggcaagtgggtgtcccaggtgacccggggctcagaggccaacctgggagaaagggcttggatggaattcctggaactccgggagtgaaaggattaccaggacctaaaggcgaactggctctgagtggtgagaaaggggaccaaggtcctccaggggatcctggctcccctgggtccccaggacctgcaggaccagctggaccacctggctacggaccccaaggagaacctggtctccagggcacgcaaggagttcctggagcccccggaccacccggagaagccggccctaggggagagctcagtgtttcaacaccagttccaggcccaccaggacctccagggccccctggccatcctggcccccaaggtccacctggtatccctggatccctggggaaatgtggagatcctggtcttccagggcctgatggtgaaccaggaattccaggaattggatttcctgggcctcctggacctaagggagaccaaggttttccaggtacaaaaggatcactgggttgtcctggaaaaatgggagagcctgggttacctggaaagccaggcctcccaggagccaagggagaaccagcagtagccatgcctggaggaccaggaacaccaggttttccaggagaaagaggcaattctggggaacatggagaaattggactccctggacttccaggtctccctggaactccaggaaatgaagggcttgatggaccacgaggagatccagggcagcctggaccacctggagaacaaggacccccaggaaggtgcatagagggtcccaggggagcccaaggacttccaggcttaaatggattgaaagggcaacaaggcagaagaggtaaaacggggccaaagggagacccaggaattccaggcttggatagatcaggatttcctggagaaactggatcaccaggaattccaggtcatcaaggtgaaatgggaccactgggtcaaagaggatatccaggaaatccgggaattttagggccaccaggtgaagatggagtgattgggatgatgggctttcctggagccattggccctccagggccccctgggaacccaggcacaccagggcagagggggagccctggaattccaggagtaaagggccagagaggaaccccaggagccaagggggaacaaggagataaaggaaatcccgggccttcagagatatcccacgtaataggggacaaaggagaaccaggtctcaaaggattcgcaggaaatccaggtgagaaaggaaacagaggcgttccagggatgccaggtttaaagggcctcaaaggactacccggaccagcaggaccaccaggccccagaggagatttgggcagcactgggaatcctggagaaccaggactgcgtggtataccaggaagcatggggaacatgggcatgccaggttctaaaggaaaaaggggaactttgggattcccaggtcgagcaggaagaccaggcctcccaggtattcatggtctccagggagataagggagagccaggttattcagaaggtacaaggccaggaccaccgggaccaacgggggatccaggactgccgggtgatatgggaaagaaaggagaaatggggcaacctggcccacctggacatttggggcctgctggacctgagggagcccctggaagtcctggaagtcctggcctcccaggaaagccaggtcctcatggtgatttgggttttaaaggaatcaaaggcctcctgggccctccaggaatcagaggccctccaggtcttccaggatttccaggatctcctggaccaatgggtataagaggtgaccaaggacgtgatggaattcctggtccagccggagaaaagggagaaacgggtttattgagggcccctccaggcccaagagggaaccctggtgctcaaggagccaaaggagacaggggagccccaggttttcctggcctcccgggcagaaaaggggccatgggagatgctggacctcgaggacccacaggcatagaaggattcccagggccaccaggtctgcccggtgcaattatccctggccagacaggaaatcgtggtccaccaggctcaagaggaagcccaggtgcgcctggtccccctggacctccagggagtcatgtaataggcataaaaggagacaaagggtctatgggccaccctggcccaaaaggtccacctggaactgcaggagacatgggaccaccaggtcgtctgggagcaccaggtactccaggtcttccaggacccagaggtgatcctggattccaggggtttccaggcgtgaaaggagaaaagggtaatcctggatttctaggatccattggacctccaggaccaattgggccaaaaggaccacctggtgtacgtggagaccctggcacacttaagattatctcccttccaggaagcccagggccacctggcacacctggagaaccagggatgcagggagaacctgggccaccagggccacctggaaacctaggaccctgtgggccaagaggtaagccaggcaaggatggaaaaccaggaactcctggaccagctggagaaaaaggcaacaaaggttctaaaggagagccagaaagcctattccatcaactgtgaaagctggggaattagaaaaaataataagtcgctgtcaggtgtgcatgaagaaaagacactgaagctaaaaaagacagcagaactgctatttttcatcctaaagaacaaagtaatgacagaacatgctgttatttaggtatttttctttaaccaaacaatattgctccatgatgacttagtacaaagtttcaatttgtttccccacaaaacaaagcaattctttcaagtcagttctgtgatctgggtctctaatctgtgctgtttcaaagttctctgtggcaaagcagcaactattcacaaaatatcaccaaaaacctattccacttacatccaaggcactgtcactacggtgattgtatgaagtttgaatgctgcaagttatgaaatatttggcccgctggattcccacatttgtcttctttctgtctttaagactcagggaggctaaatcagtgtttgattgccccgccaacccttcctgaaacttcagaccctgggtaggggaagagaagggggcatgtggtatcctggagcattgtgtatagaactggattttcagacctgctgaggaccgtaaggcctgatggaacacagaactgaactgaggttcatggattttccaggactgtttcaaacatgcccattactaacggcaaaagggggattccctgatggaaccataatacccttggaaatactgtatggttttgttttgttttgttggtttttaaagatttttgtttgtttattgaattcatttcactgtagctctaaaatctgcttgtattccaagcatataaaattttcccccttagtgaattagttttaaaatgatattgttatatacatactatgaaatatgtataactttaacttctgttttaccagcatacccacacaaataacaagaatactacttatgaaatgtgcactttatcctcattccataaatgtcggtgcataccttatgtaagggagcagttcaataatccatgaaagaacttaaggcatttgttggtttatcagactcggaatctattttctcattgctctgaatatgtcatcactctaggttttacagatttattcctttgttacttctctaattcttcctttgtaaaaaaaaaaaaaagcaacactttttatgttatatgttgttcttacaaaccatactgaaagagtccattgtttaaaaatcttaatgtatcaaactgtataacttggccgctgtatgtcttaaaacctgcttttcaatgtgttgatacattcccaaggttacttaattcaacttaactatcatcttattcagcaccaagcatgtcccaggcactgtactaacctacagagatgctaagagaaaaaaaagacttgtttctgatctaatatcccagaaaaagtaactcattgctctgttaataatctcacatatacaagtagcttccctcccctctagttttttcttccttttcactgctgttatatttcatcatgataattcagcaggcccaagtaaaggttaaaaataaggtctatgcctagggaaactcagggcttctagtttctcttagaaaagctaagagaagataaggtctgaataatagcagaaaaaccaacatctacaaaacattaaactagtgttatacttgatgataacactatttgatgagtcttagagtccagacacaaagagacaaagctttgaagatgctttttgatctacctaggtggagttggtggtgctgatatttaaattcaggctactgcttcaatctcaattgctttgtaagtgaaaaacatgacccagaggacagcacagactatggccatggctcacatggtttacatccttcactgctcacgtgtttgctgtcaagccatttttacatctaaactaagatgtgcagcatttcacttatttagattcacttaacaaacaaatttttctgctttaaaaatgtcttattgtcccaagtgtactatagcggcatatagagctagctaatctctacaaaccctctgtaggccagtagttctcaaagtgtggtctctggaagagcagtatcagcatcatctgggaacttgtcacagatgcagattctagggaccactccagacctacacaatcagaaactcttgggggagggcccgaaatatctatgttttaccaagcccaccacatgattctgatgtactctaaatactgagaaaacctgttctagacaaatacccaagcaacaactccgcaggcagttaccaagtacggctggctacaactgctccatccgtgcctctttttaaagttcaaactcacaggtgactctaaggttatctacttttactcataagtaaaagccctagactggtgctaatgtcaaaccactggcctccactcaggcctccatcttctcatgccctcttaccagtatttaacttctgaggaagacaagtgatgctaaaacctgaaattccaatgaagccatatgaacagctgttcagttgcacttctaagactttacttagcagtaaattatagctcatgtgcattattttccagataacttagcttatgagtagcttatacaattatgaagatttaatattacagataaaatgtaaactgtttctttaaaattggggcttcaactttggaatttcacagcgtgctaaaataacagatttctcagaagtctttcagcaagataaacattattaagtaacttatttatgaaagtattaaaatgcttacatttgaacttgatggctaacttacaaagattctctatgtatcaaatgtaacttactgcgactaaacttaatttaatatttactctataaccaaatgaaatatatttaaaatatattgaatattttatattgttatatcctgacaagattataatattttaatgtactaatatttctgtaattatatctaaaatattattttattatattgcctaagaataaacatttgttaaattgg

SEQ ID NO: 1097 - DNA, 8097 bp, Homo sapiens
gggagggacgaaccgcgcgaccgagccctacaaaacccgccccggccgagtggcgaggcgagctttccagccgggctcccagagccgcgctgcgcaggagacgcggtggcctgagagcctgagggtccccggactcgcccaggctctgagcgcgcgcccaccatgagcgcccggaccgcccccaggccgcaggtgctcctgctgccgctcctgctggtgctcctggcggcggcgcccgcagccagcaagggttgtgtctgtaaagacaaaggccagtgcttctgtgacggggccaaaggggagaagggggagaagggctttcctggaccccccggttctcctggccagaaaggattcacaggtcctgaaggcttgcctggaccgcagggacccaagggctttccaggacttccaggactcacgggttccaaaggtgtaaggggaataagtggattgccaggattttctggttctcctggacttccaggcaccccaggcaataccgggccttacggacttgtcggtgtaccaggatgcagtggttctaagggtgagcaggggtttccaggactcccagggacactgggctacccagggatcccgggtgctgctggtttgaaaggacaaaagggtgctcctgctaaagaagaagatatagaacttgatgcaaaaggcgaccccgggttgccaggggctccaggaccccagggtttgccaggccctccaggttttcctgggcctgttggcccacctggtcctccgggattctttggctttccaggagccatgggacctagaggacctaagggtcacatgggtgaaagagtgataggacataaaggagagcggggtgtgaaagggttaacaggacccccgggaccaccaggaacagttattgtgaccctaactggcccagataacagaacggacctcaagggggaaaagggagacaagggagcaatgggcgagcctggacctcctggaccctcaggactgcctggagaatcatatggatctgaaaagggtgctcctggagaccctggcctgcagggaaaacccggaaaagatggtgttcctggcttccctggaagtgagggagtcaagggcaacaggggtttccctgggttaatgggtgaagatggcattaagggacagaaaggggacattggccctccaggatttcgtggtccaacagaatattatgacacataccaggaaaagggagatgaaggcactccaggcccaccagggcccagaggagctcgtggcccacaaggtcccagtggtccccccggagttcctggaagtcctggatcatcaaggcctggcctcagaggagcccctggatggccaggcctgaaaggaagtaaaggggaacgaggccgcccaggaaaggatgccatggggactcctgggtccccaggttgtgctggttcaccaggtcttccaggatcaccgggacctccaggaccgccaggtgacatcgtttttcgcaagggtccacctggagatcacggactgccaggctatctagggtctccaggaatcccaggagttgatgggcccaaaggagaaccaggcctcctgtgtacacagtgcccttatatcccagggcctcccggtctcccaggattgccagggttacatggtgtaaaaggaatcccaggaagacaaggcgcagctggcttgaaaggaagcccagggtccccaggaaatacaggtcttccaggatttccaggtttcccaggtgcccagggtgacccaggacttaaaggagaaaaaggtgaaacacttcagcctgaggggcaagtgggtgtcccaggtgacccggggctcagaggccaacctgggagaaagggcttggatggaattcctggaactccgggagtgaaaggattaccaggacctaaaggcgaactggctctgagtggtgagaaaggggaccaaggtcctccaggggatcctggctcccctgggtccccaggacctgcaggaccagctggaccacctggctacggaccccaaggagaacctggtctccagggcacgcaaggagttcctggagcccccggaccacccggagaagccggccctaggggagagctcagtgtttcaacaccagttccaggcccaccaggacctccagggccccctggccatcctggcccccaaggtccacctggtatccctggatccctggggaaatgtggagatcctggtcttccagggcctgatggtgaaccaggaattccaggaattggatttcctgggcctcctggacctaagggagaccaaggttttccaggtacaaaaggatcactgggttgtcctggaaaaatgggagagcctgggttacctggaaagccaggcctcccaggagccaagggagaaccagcagtagccatgcctggaggaccaggaacaccaggttttccaggagaaagaggcaattctggggaacatggagaaattggactccctggacttccaggtctccctggaactccaggaaatgaagggcttgatggaccacgaggagatccagggcagcctggaccacctggagaacaaggacccccaggaaggtgcatagagggtcccaggggagcccaaggacttccaggcttaaatggattgaaagggcaacaaggcagaagaggtaaaacggggccaaagggagacccaggaattccaggcttggatagatcaggatttcctggagaaactggatcaccaggaattccaggtcatcaaggtgaaatgggaccactgggtcaaagaggatatccaggaaatccgggaattttagggccaccaggtgaagatggagtgattgggatgatgggctttcctggagccattggccctccagggccccctgggaacccaggcacaccagggcagagggggagccctggaattccaggagtaaagggccagagaggaaccccaggagccaagggggaacaaggagataaaggaaatcccgggccttcagagatatcccacgtaataggggacaaaggagaaccaggtctcaaaggattcgcaggaaatccaggtgagaaaggaaacagaggcgttccagggatgccaggtttaaagggcctcaaaggactacccggaccagcaggaccaccaggccccagaggagatttgggcagcactgggaatcctggagaaccaggactgcgtggtataccaggaagcatggggaacatgggcatgccaggttctaaaggaaaaaggggaactttgggattcccaggtcgagcaggaagaccaggcctcccaggtattcatggtctccagggagataagggagagccaggttattcagaaggtacaaggccaggaccaccgggaccaacgggggatccaggactgccgggtgatatgggaaagaaaggagaaatggggcaacctggcccacctggacatttggggcctgctggacctgagggagcccctggaagtcctggaagtcctggcctcccaggaaagccaggtcctcatggtgatttgggttttaaaggaatcaaaggcctcctgggccctccaggaatcagaggccctccaggtcttccaggatttccaggatctcctggaccaatgggtataagaggtgaccaaggacgtgatggaattcctggtccagccggagaaaagggagaaacgggtttattgagggcccctccaggcccaagagggaaccctggtgctcaaggagccaaaggagacaggggagccccaggttttcctggcctcccgggcagaaaaggggccatgggagatgctggacctcgaggacccacaggcatagaaggattcccagggccaccaggtctgcccggtgcaattatccctggccagacaggaaatcgtggtccaccaggctcaagaggaagcccaggtgcgcctggtccccctggacctccagggagtcatgtaataggcataaaaggagacaaagggtctatgggccaccctggcccaaaaggtccacctggaactgcaggagacatgggaccaccaggtcgtctgggagcaccaggtactccaggtcttccaggacccagaggtgatcctggattccaggggtttccaggcgtgaaaggagaaaagggtaatcctggatttctaggatccattggacctccaggaccaattgggccaaaaggaccacctggtgtacgtggagaccctggcacacttaagattatctcccttccaggaagcccagggccacctggcacacctggagaaccagggatgcagggagaacctgggccaccagggccacctggaaacctaggaccctgtgggccaagaggtaagccaggcaaggatggaaaaccaggaactcctggaccagctggagaaaaaggcaacaaaggttctaaaggagagccaggaccagctggatcagatggattgccaggtttgaaaggaaaacgtggagacagtggatcacctgcaacctggacaacgagaggctttgtcttcacccgacacagtcaaaccacagcaattccttcatgtccagaggggacagtgccactctacagtgggttttcttttctttttgtacaaggaaatcaacgagcccacggacaagaccttggaactcttggcagctgcctgcagcgatttaccacaatgccattcttattctgcaatgtcaatgatgtatgtaattttgcatctcgaaatgattattcatactggctgtcaacaccagctctgatgccaatgaacatggctcccattactggcagagcccttgagccttatataagcagatgcactgtttgtgaaggtcctgcgatcgccatagccgttcacagccaaaccactgacattcctccatgtcctcacggctggatttctctctggaaaggattttcattcatcatgttcacaagtgcaggttctgagggcaccgggcaagcactggcctcccctggctcctgcctggaagaattccgagccagcccatttctagaatgtcatggaagaggaacgtgcaactactattcaaattcctacagtttctggctggcttcattaaacccagaaagaatgttcagaaagcctattccatcaactgtgaaagctggggaattagaaaaaataataagtcgctgtcaggtgtgcatgaagaaaagacactgaagctaaaaaagacagcagaactgctatttttcatcctaaagaacaaagtaatgacagaacatgctgttatttaggtatttttctttaaccaaacaatattgctccatgatgacttagtacaaagtttcaatttgtttccccacaaaacaaagcaattctttcaagtcagttctgtgatctgggtctctaatctgtgctgtttcaaagttctctgtggcaaagcagcaactattcacaaaatatcaccaaaaacctattccacttacatccaaggcactgtcactacggtgattgtatgaagtttgaatgctgcaagttatgaaatatttggcccgctggattcccacatttgtcttctttctgtctttaagactcagggaggctaaatcagtgtttgattgccccgccaacccttcctgaaacttcagaccctgggtaggggaagagaagggggcatgtggtatcctggagcattgtgtatagaactggattttcagacctgctgaggaccgtaaggcctgatggaacacagaactgaactgaggttcatggattttccaggactgtttcaaacatgcccattactaacggcaaaagggggattccctgatggaaccataatacccttggaaatactgtatggttttgttttgttttgttggtttttaaagatttttgtttgtttattgaattcatttcactgtagctctaaaatctgcttgtattccaagcatataaaattttcccccttagtgaattagttttaaaatgatattgttatatacatactatgaaatatgtataactttaacttctgttttaccagcatacccacacaaataacaagaatactacttatgaaatgtgcactttatcctcattccataaatgtcggtgcataccttatgtaagggagcagttcaataatccatgaaagaacttaaggcatttgttggtttatcagactcggaatctattttctcattgctctgaatatgtcatcactctaggttttacagatttattcctttgttacttctctaattcttcctttgtaaaaaaaaaaaaaagcaacactttttatgttatatgttgttcttacaaaccatactgaaagagtccattgtttaaaaatcttaatgtatcaaactgtataacttggccgctgtatgtcttaaaacctgcttttcaatgtgttgatacattcccaaggttacttaattcaacttaactatcatcttattcagcaccaagcatgtcccaggcactgtactaacctacagagatgctaagagaaaaaaaagacttgtttctgatctaatatcccagaaaaagtaactcattgctctgttaataatctcacatatacaagtagcttccctcccctctagttttttcttccttttcactgctgttatatttcatcatgataattcagcaggcccaagtaaaggttaaaaataaggtctatgcctagggaaactcagggcttctagtttctcttagaaaagctaagagaagataaggtctgaataatagcagaaaaaccaacatctacaaaacattaaactagtgttatacttgatgataacactatttgatgagtcttagagtccagacacaaagagacaaagctttgaagatgctttttgatctacctaggtggagttggtggtgctgatatttaaattcaggctactgcttcaatctcaattgctttgtaagtgaaaaacatgacccagaggacagcacagactatggccatggctcacatggtttacatccttcactgctcacgtgtttgctgtcaagccatttttacatctaaactaagatgtgcagcatttcacttatttagattcacttaacaaacaaatttttctgctttaaaaatgtcttattgtcccaagtgtactatagcggcatatagagctagctaatctctacaaaccctctgtaggccagtagttctcaaagtgtggtctctggaagagcagtatcagcatcatctgggaacttgtcacagatgcagattctagggaccactccagacctacacaatcagaaactcttgggggagggcccgaaatatctatgttttaccaagcccaccacatgattctgatgtactctaaatactgagaaaacctgttctagacaaatacccaagcaacaactccgcaggcagttaccaagtacggctggctacaactgctccatccgtgcctctttttaaagttcaaactcacaggtgactctaaggttatctacttttactcataagtaaaagccctagactggtgctaatgtcaaaccactggcctccactcaggcctccatcttctcatgccctcttaccagtatttaacttctgaggaagacaagtgatgctaaaacctgaaattccaatgaagccatatgaacagctgttcagttgcacttctaagactttacttagcagtaaattatagctcatgtgcattattttccagataacttagcttatgagtagcttatacaattatgaagatttaatattacagataaaatgtaaactgtttctttaaaattggggcttcaactttggaatttcacagcgtgctaaaataacagatttctcagaagtctttcagcaagataaacattattaagtaacttatttatgaaagtattaaaatgcttacatttgaacttgatggctaacttacaaagattctctatgtatcaaatgtaacttactgcgactaaacttaatttaatatttactctataaccaaatgaaatatatttaaaatatattgaatattttatattgttatatcctgacaagattataatattttaatgtactaatatttctgtaattatatctaaaatattattttattatattgcctaagaataaacatttgttaaattgga

SEQ ID NO: 1098 - DNA, 6949 bp, Homo sapiens
gaccgttgcttggcagacactggatggttatgagcctgaacaagctgaaaaggggcaggaaaagaagtggaggcagcattcttcctatttaaagctgcatcgcttgaaaaaagttttcgcagactgtgctggagctggtgctgaaaaagggggtttgcagaggctgccctggggctggtgctgaaagaagagcccacagctgacttcatggtgctacaataacctcagaatctacttttcactctcaggagaacccacatgtctaatatttagacatgatggcaaactgggcggaagcaagacctctcctcattcttattgttttattagggcaatttgtctcaataaaagcccaggaagaagacgaggatgaaggatatggtgaagaaatagcctgcactcagaatggccagatgtacttaaacagggacatttggaaacctgccccttgtcagatctgtgtctgtgacaatggagccattctctgtgacaagatagaatgccaggatgtgctggactgtgccgaccctgtaacgccccctggggaatgctgtcctgtctgttcacaaacacctggaggtggcaataccaattttggtagaggaagaaagggacaaaagggagaaccaggattagtgcctgttgtaacaggcatacgtggtcgtccaggaccggcaggacctccaggatcacagggaccaagaggagagcgagggccaaaaggaagacctggccctcgtggacctcagggaattgatggagaaccaggtgttcctggtcaacctggtgctccaggacctcctggacatccgtcccacccaggacccgatggcttgagcaggccgttttcagctcaaatggctgggttggatgaaaaatctggacttgggagtcaagtaggactaatgcctggctctgtgggtcctgttggcccaaggggaccacagggtttacaaggacagcaaggtggtgcaggacctacaggacctcctggtgaacctggtgatcctggaccaatgggtccgattggttcacgtggaccagagggccctcctggtaaacctggggaagatggtgaacctggcagaaatggaaatcctggtgaagtgggatttgcaggatctccgggagctcgtggatttcctggggctcctggtcttccaggtctgaagggtcaccgaggacacaaaggtcttgaaggccctaaaggtgaagttggagcacctggttccaagggtgaagctggccccactggtccaatgggtgccatgggtcctctgggtccgaggggaatgccaggagagagagggagacttgggccacagggtgctcctggacaacgaggtgcacatggtatgcctggaaaacctggaccaatgggtcctcttgggataccaggctcttctggttttccaggaaatcctggaatgaagggagaagcaggtcctacaggggcgcgaggccctgaaggtcctcaggggcagagaggtgaaactgggcccccaggtccagttggctctccaggtcttcctggtgcaataggaactgatggtactcctggtgccaaaggcccaacgggctctccaggtacctctggtcctcctggctcagcagggcctcctggatctccaggacctcagggtagcactggtcctcagggaattcgaggccaaccgggtgatccaggagttccaggtttcaaaggagaagctggcccaaaaggggaaccagggccacatggtattcagggtccgataggcccacccggtgaagaaggcaaaagaggtcccagaggtgacccaggaacagttggtcctccagggccagtgggagaaaggggtgctcctggcaatcgtggttttccaggctctgatggtttacctgggccaaagggtgctcaaggagaacggggtcctgtaggttcttcaggacccaaaggaagccagggggatccaggacgtccaggggaacctgggcttccaggtgctcggggtttgacaggaaatcctggtgttcaaggtcctgaaggaaaacttggacctttgggtgcgccaggggaagatggccgtccaggtcctccaggctccataggaatcagagggcagcccgggagcatgggccttccaggccccaaaggtagcagtggtgaccctgggaaacctggagaagcaggaaatgctggagttcctgggcagaggggagctcctggaaaagatggtgaagttggtccttctggtcctgtgggcccgccgggtctagctggtgaaagaggagaacaaggacctccaggccccacaggttttcaggggcttcctggtcctccagggcctcctggagaaggtggaaaaccaggtgatcaaggtgttcctggagatcccggagcagttggcccgttaggacctagaggagaacgaggaaatcctggggaaagaggagaacctgggataactggactccctggtgagaagggaatggctggaggacatggtcctgatggcccaaaaggcagtccaggtccatctgggacccctggagatacaggcccaccaggtcttcaaggtatgccgggagaaagaggaattgcaggaactcctggccccaagggtgacagaggtggcataggagaaaaaggtgctgaaggcacagctggaaatgatggtgcaagaggtcttccaggtcctttgggccctccaggtccggcaggtcctactggagaaaagggtgaacctggtcctcgaggtttagttggccctcctggctcccggggcaatcctggttctcgaggtgaaaatgggccaactggagctgttggttttgccggaccccagggtcctgacggacagcctggagtaaaaggtgaacctggagagccaggacagaagggagatgctggttctcctggaccacaaggtttagcaggatcccctggccctcatggtcctaatggtgttcctggactaaaaggtggtcgaggaacccaaggtccgcctggtgctacaggatttcctggttctgcgggcagagttggacctccaggccctgctggagctccaggacctgcgggacccctaggggaacccgggaaggagggacctccaggtcttcgtggggaccctggctctcatgggcgtgtgggagatcgaggaccagctggcccccctggtggcccaggagacaaaggggacccaggagaagatgggcaacctggtccagatggcccccctggtccagctggaacgaccgggcagagaggaattgttggcatgcctgggcaacgtggagagagaggcatgcccggcctaccaggcccagcgggaacaccaggaaaagtaggaccaactggtgcaacaggagataaaggtccacctggacctgtggggcccccaggctccaatggtcctgtaggggaacctggaccagaaggtccagctggcaatgatggtaccccaggacgggatggtgctgttggagaacgtggtgatcgtggagaccctgggcctgcaggtctgccaggctctcagggtgcccctggaactcctggccctgtgggtgctccaggagatgcaggacaaagaggagatccgggttctcggggtcctataggaccacctggtcgagctgggaaacgtggattacctggaccccaaggacctcgtggtgacaaaggtgatcatggagaccgaggtgacagaggtcagaagggccacagaggctttactggtcttcagggtcttcctggccctcctggtccaaatggtgaacaaggaagtgctggaatccctggaccatttggcccaagaggtcctccaggcccagttggtccttcaggtaaagaaggaaaccctgggccacttgggccaattggacctccaggtgtacgaggcagtgtaggagaagcaggacctgagggccctcctggtgagcctggcccacctggccctccgggtccccctggccaccttacagctgctcttggggatatcatggggcactatgatgaaagcatgccagatccacttcctgagtttactgaagatcaggcggctcctgatgacaaaaacaaaacggacccaggggttcatgctaccctgaagtcactcagtagtcagattgaaaccatgcgcagccccgatggctcgaaaaagcacccagcccgcacgtgtgatgacctaaagctttgccattccgcaaagcagagtggtgaatactggattgatcctaaccaaggatctgttgaagatgcaatcaaagtttactgcaacatggaaacaggagaaacatgtatttcagcaaacccatccagtgtaccacgtaaaacctggtgggccagtaaatctcctgacaataaacctgtttggtatggtcttgatatgaacagagggtctcagttcgcttatggagaccaccaatcacctaatacagccattactcagatgacttttttgcgccttttatcaaaagaagcctcccagaacatcacttacatctgtaaaaacagtgtaggatacatggacgatcaagctaagaacctcaaaaaagctgtggttctcaaaggggcaaatgacttagatatcaaagcagagggaaatattagattccggtatatcgttcttcaagacacttgctctaagcggaatggaaatgtgggcaagactgtctttgaatatagaacacagaatgtggcacgcttgcccatcatagatcttgctcctgtggatgttggcggcacagaccaggaattcggcgttgaaattgggccagtttgttttgtgtaaagtaagccaagacacatcgacaatgagcaccaccatcaatgaccaccgccattcacaagaactttgactgtttgaagttgatcctgagactcttgaagtaatggctgatcctgcatcagcattgtatatatggtcttaagtgcctggcctccttatccttcagaatatttattttacttacaatcctcaagttttaattgattttaaatatttttcaatacaacagtttaggtttaagatgaccaatgacaatgaccacctttgcagaaagtaaactgattgaataaataaatctccgttttcttcaatttatttcagtgtaatgaaaaagttgcttagtatttatgaggaaattcttcttcctggcaggtagcttaaagagtggggtatatagagccacaacacatgtttattttgcttggctgcagttgaaaaatagaaattagtgcccttttgtgacctctcattccaagattgtcaattaaaaatgagtttaaaatgtttaacttgtgatcgagacctacatgcatgtcttgatattgtgtaactataatagagactctttaaggagaatcttaaaaaaaaaaaaacgtttctcactgtcttaaatagaatttttaaatagtatatattcagtggcattttggagaacaaagtgaatttacttcgacttcttaaatttttgtaaaagactataagtttagacatctttctcattcaaatttaaagatatctttctcctcttgatcaatctatcaatattgatagaagtcacactagtatataccatttaatacatttacactttcttatttaagaagatattgaatgcaaaataattgacatatagaactttacaaacatatgtccaaggactctaaattgagactcttccacatgtacaatctcatcatcctgaagcctataatgaagaaaaagatctagaaactgagttgtggagctgactctaatcaaatgtgatgattggaattagaccatttggcctttgaactttcataggaaaaatgacccaacatttcttagcatgagctacctcatctctagaagctgggatggacttactattcttgtttatattttagatactgaaaggtgctatgcttctgttattattccaagactggagataggcagggctaaaaaggtattattatttttcctttaatgatggtgctaaaattcttcctataaaattccttaaaaataaagatggtttaatcactaccattgtgaaaacataactgttagacttcccgtttctgaaagaaagagcatcgttccaatgcttgttcactgttcctctgtcatactgtatctggaatgctttgtaatacttgcatgcttcttagaccagaacatgtaggtccccttgtgtctcaatactttttttttcttaattgcatttgttggctctattttaatttttttcttttaaaataaacagctgggaccatcccaaaagacaagccatgcatacaactttggtcatgtatctctgcaaagcatcaaattaaatgcacgcttttgtcatgtcagtggtttttgttttgtgaaattcctttgaccatattagatctatttcatttccaatagtgaaaaggagatgtggtggtatactttgtttgccatttgtttaaaagatacaacggataccttctatcatgtatgtactggcttataaatgaaaatctatctacaacattacccacaaaggcaacatgacaccaattatcactgcctctgcccttaaaaatgtcagagtagtattattgataaaaagggcaagcaatagatttttcatgactgaataaactgtaataataaaacatatgtctcaaagtgtatcacatatgaatttagcctaattgttttcagtttcattctcaatatttagtttacaacatcattttcccctaaactggttatattttgacctgtatatcttaaatttgagtatttatatgcctaaatacatgtgtgagttttgtttgacttccaagtccaaactataagattatataagttcatatagatgaatcagaaatatgtggtaatactattaagtcacaaacactaacaatttccaactatagaaataacagttcttatttggattttgggaatgctaccaataaaagcctgcccagaccatt

SEQ ID NO: 1099 - DNA, 5575 bp, Homo sapiens
ttacctgggagaagacatagacttggacctccaggatcacagggaccaagaggagagcgagggccaaaaggaagacctggccctcgtggacctcagggaattgatggagaaccaggtgttcctggtcaacctggtgctccaggtggtgcaggacctacaggacctcctggtgaacctggtgatcctggaccaatgggtccgattggttcacgtggaccagagggccctcctggtaaacctggggaagatggtgaacctggcagaaatggaaatcctggtgaagtgggatttgcaggatctccgggagctcgtggatttcctggggctcctggtcttccaggtctgaagggtcaccgaggacacaaaggtcttgaaggccctaaaggtgaagttggagcacctggttccaagggagaagcaggtcctacagggcccagaggtgacccaggaacagttggtcctccagggccagtgggagaaaggggtgctcctggcaatcgtggttttccaggctctgatggtttacctgggccaaagggtgctcaaggagaacggggtcctgtaggttcttcaggacccaaaggaagccagggggatccaggacgtccaggggaacctgggcttccaggtgctcggggtttgacaggaaatcctggtgttcaaggtcctgaaggaaaacttggacctttgggtgcgccaggggaagatggccgtccaggtcctccaggctccataggaatcagagggcagcccgggagcatgggccttccaggccccaaaggtagcagtggtgaccctgggaaacctggagaagcaggaaatgctggagttcctgggcagaggggagctcctggaaaagatggtgaagttggtccttctggtcctgtgggcccgccgggtctagctggtgaaagaggagaacaaggacctccaggccccacaggttttcaggggcttcctggtcctccagggcctcctggagaaggtggaaaaccaggtgatcaaggtgttcctggagatcccggagcagttggcccgttaggacctagaggagaacgaggaaatcctggggaaagaggagaacctgggataactggactccctggtgagaagggaatggctggaggacatggtcctgatggcccaaaaggcagtccaggtccatctgggacccctggagatacaggcccaccaggtcttcaaggtatgccgggagaaagaggaattgcaggaactcctggccccaagggtgacagaggtggcataggagaaaaaggtgctgaaggcacagctggaaatgatggtgcaagaggtcttccaggtcctttgggccctccaggtccggcaggtcctactggagaaaagggtgaacctggtcctcgaggtttagttggccctcctggctcccggggcaatcctggttctcgaggtgaaaatgggccaactggagctgttggttttgccggaccccagggtcctgacggacagcctggagtaaaaggtgaacctggagagccaggacagaagggagatgctggttctcctggaccacaaggtttagcaggatcccctggccctcatggtcctaatggtgttcctggactaaaaggtggtcgaggaacccaaggtccgcctggtgctacaggatttcctggttctgcgggcagagttggacctccaggccctgctggagctccaggacctgcgggacccctaggggaacccgggaaggagggacctccaggtcttcgtggggaccctggctctcatgggcgtgtgggagatcgaggaccagctggcccccctggtggcccaggagacaaaggggacccaggagaagatgggcaacctggtccagatggcccccctggtccagctggaacgaccgggcagagaggaattgttggcatgcctgggcaacgtggagagagaggcatgcccggcctaccaggcccagcgggaacaccaggaaaagtaggaccaactggtgcaacaggagataaaggtccacctggacctgtggggcccccaggctccaatggtcctgtaggggaacctggaccagaaggtccagctggcaatgatggtaccccaggacgggatggtgctgttggagaacgtggtgatcgtggagaccctgggcctgcaggtctgccaggctctcagggtgcccctggaactcctggccctgtgggtgctccaggagatgcaggacaaagaggagatccgggttctcggggtcctataggaccacctggtcgagctgggaaacgtggattacctggaccccaaggacctcgtggtgacaaaggtgatcatggagaccgaggtgacagaggtcagaagggccacagaggctttactggtcttcagggtcttcctggccctcctggtccaaatggtgaacaaggaagtgctggaatccctggaccatttggcccaagaggtcctccaggcccagttggtccttcaggtaaagaaggaaaccctgggccacttgggccaattggacctccaggtgtacgaggcagtgtaggagaagcaggacctgagggccctcctggtgagcctggcccacctggccctccgggtccccctggccaccttacagctgctcttggggatatcatggggcactatgatgaaagcatgccagatccacttcctgagtttactgaagatcaggcggctcctgatgacaaaaacaaaacggacccaggggttcatgctaccctgaagtcactcagtagtcagattgaaaccatgcgcagccccgatggctcgaaaaagcacccagcccgcacgtgtgatgacctaaagctttgccattccgcaaagcagagtggtgaatactggattgatcctaaccaaggatctgttgaagatgcaatcaaagtttactgcaacatggaaacaggagaaacatgtatttcagcaaacccatccagtgtaccacgtaaaacctggtgggccagtaaatctcctgacaataaacctgtttggtatggtcttgatatgaacagagggtctcagttcgcttatggagaccaccaatcacctaatacagccattactcagatgacttttttgcgccttttatcaaaagaagcctcccagaacatcacttacatctgtaaaaacagtgtaggatacatggacgatcaagctaagaacctcaaaaaagctgtggttctcaaaggggcaaatgacttagatatcaaagcagagggaaatattagattccggtatatcgttcttcaagacacttgctctaagcggaatggaaatgtgggcaagactgtctttgaatatagaacacagaatgtggcacgcttgcccatcatagatcttgctcctgtggatgttggcggcacagaccaggaattcggcgttgaaattgggccagtttgttttgtgtaaagtaagccaagacacatcgacaatgagcaccaccatcaatgaccaccgccattcacaagaactttgactgtttgaagttgatcctgagactcttgaagtaatggctgatcctgcatcagcattgtatatatggtcttaagtgcctggcctccttatccttcagaatatttattttacttacaatcctcaagttttaattgattttaaatatttttcaatacaacagtttaggtttaagatgaccaatgacaatgaccacctttgcagaaagtaaactgattgaataaataaatctccgttttcttcaatttatttcagtgtaatgaaaaagttgcttagtatttatgaggaaattcttcttcctggcaggtagcttaaagagtggggtatatagagccacaacacatgtttattttgcttggctgcagttgaaaaatagaaattagtgcccttttgtgacctctcattccaagattgtcaattaaaaatgagtttaaaatgtttaacttgtgatcgagacctacatgcatgtcttgatattgtgtaactataatagagactctttaaggagaatcttaaaaaaaaaaaaacgtttctcactgtcttaaatagaatttttaaatagtatatattcagtggcattttggagaacaaagtgaatttacttcgacttcttaaatttttgtaaaagactataagtttagacatctttctcattcaaatttaaagatatctttctcctcttgatcaatctatcaatattgatagaagtcacactagtatataccatttaatacatttacactttcttatttaagaagatattgaatgcaaaataattgacatatagaactttacaaacatatgtccaaggactctaaattgagactcttccacatgtacaatctcatcatcctgaagcctataatgaagaaaaagatctagaaactgagttgtggagctgactctaatcaaatgtgatgattggaattagaccatttggcctttgaactttcataggaaaaatgacccaacatttcttagcatgagctacctcatctctagaagctgggatggacttactattcttgtttatattttagatactgaaaggtgctatgcttctgttattattccaagactggagataggcagggctaaaaaggtattattatttttcctttaatgatggtgctaaaattcttcctataaaattccttaaaaataaagatggtttaatcactaccattgtgaaaacataactgttagacttcccgtttctgaaagaaagagcatcgttccaatgcttgttcactgttcctctgtcatactgtatctggaatgctttgtaatacttgcatgcttcttagaccagaacatgtaggtccccttgtgtctcaatactttttttttcttaattgcatttgttggctctattttaatttttttcttttaaaataaacagctgggaccatcccaaaagacaagccatgcatacaactttggtcatgtatctctgcaaagcatcaaattaaatgcacgcttttgtcatgtcagtggtttttgttttgtgaaattcctttgaccatattagatctatttcatttccaatagtgaaaaggagatgtggtggtatactttgtttgccatttgtttaaaagatacaacggataccttctatcatgtatgtactggcttataaatgaaaatctatctacaacattacccacaaaggcaacatgacaccaattatcactgcctctgcccttaaaaatgtcagagtagtattattgataaaaagggcaagcaatagatttttcatgactgaataaactgtaataataaaacatatgtctcaaagtgtatcacatatgaatttagcctaattgttttcagtttcattctcaatatttagtttacaacatcattttcccctaaactggttatattttgacctgtatatcttaaatttgagtatttatatgcctaaatacatgtgtgagttttgtttgacttccaagtccaaactataagattatataagttcatatagatgaatcagaaatatgtggtaatactattaagtcacaaacactaacaatttccaactatagaaataacagttcttatttggattttgggaatgctaccaata

SEQ ID NO: 1100 - DNA, 7174 bp, Homo sapiens
acacagtactctcagcttgttggtggaagcccctcatctgccttcattctgaaggcagggcccggcagaggaaggatcagagggtcgcggccggagggtcccggccggtggggccaactcagagggagaggaaagggctagagacacgaagaacgcaaaccatcaaatttagaagaaaaagccctttgactttttccccctctccctccccaatggctgtgtagcaaacatccctggcgataccttggaaaggacgaagttggtctgcagtcgcaatttcgtgggttgagttcacagttgtgagtgcggggctcggagatggagccgtggtcctctaggtggaaaacgaaacggtggctctgggatttcaccgtaacaaccctcgcattgaccttcctcttccaagctagagaggtcagaggagctgctccagttgatgtactaaaagcactagattttcacaattctccagagggaatatcaaaaacaacgggattttgcacaaacagaaagaattctaaaggctcagatactgcttacagagtttcaaagcaagcacaactcagtgccccaacaaaacagttatttccaggtggaactttcccagaagacttttcaatactatttacagtaaaaccaaaaaaaggaattcagtctttccttttatctatatataatgagcatggtattcagcaaattggtgttgaggttgggagatcacctgtttttctgtttgaagaccacactggaaaacctgccccagaagactatcccctcttcagaactgttaacatcgctgacgggaagtggcatcgggtagcaatcagcgtggagaagaaaactgtgacaatgattgttgattgtaagaagaaaaccacgaaaccacttgatagaagtgagagagcaattgttgataccaatggaatcacggtttttggaacaaggattttggatgaagaagtttttgagggggacattcagcagtttttgatcacaggtgatcccaaggcagcatatgactactgtgagcattatagtccagactgtgactcttcagcacccaaggctgctcaagctcaggaacctcagatagatgaggcaaacatcgttgatgattttcaagaatacaactatggaacaatggaaagttaccagacagaagctcctaggcatgtttctgggacaaatgagccaaatccagttgaagaaatatttactgaagaatatctaacgggagaggattatgattcccagaggaaaaattctgaggatacactatatgaaaacaaagaaatagacggcagggattctgatcttctggtagatggagatttaggcgaatatgatttttatgaatataaagaatatgaagataaaccaacaagcccccctaatgaagaatttggtccaggtgtaccagcagaaactgatattacagaaacaagcataaatggccatggtgcatatggagagaaaggacagaaaggagaaccagcagtggttgagcctggtatgcttgtcgaaggaccaccaggaccagcaggacctgcaggtattatgggtcctccaggtctacaaggccccactggaccccctggtgaccctggcgataggggccccccaggacgtcctggcttaccaggggctgatggtctacctggtcctcctggtactatgttgatgttaccgttccgttatggtggtgatggttccaaaggaccaaccatctctgctcaggaagctcaggctcaagctattcttcagcaggctcggattgctctgagaggcccacctggcccaatgggtctaactggaagaccaggtcctgtgggggggcctggttcatctggggccaaaggtgagagtggtgatccaggtcctcagggccctcgaggcgtccagggtccccctggtccaacgggaaaacctggaaaaaggggtcgtccaggtgcagatggaggaagaggaatgccaggagaacctggggcaaagggagatcgagggtttgatggacttccgggtctgccaggtgacaaaggtcacaggggtgaacgaggtcctcaaggtcctccaggtcctcctggtgatgatggaatgaggggagaagatggagaaattggaccaagaggtcttccaggtgaagctggcccacgaggtttgctgggtccaaggggaactccaggagctccagggcagcctggtatggcaggtgtagatggccccccaggaccaaaagggaacatgggtccccaaggggagcctgggcctccaggtcaacaagggaatccaggacctcagggtcttcctggtccacaaggtccaattggtcctcctggtgaaaaaggaccacaaggaaaaccaggacttgctggacttcctggtgctgatgggcctcctggtcatcctgggaaagaaggccagtctggagaaaagggggctctgggtccccctggtccacaaggtcctattggatacccgggcccccggggagtaaagggagcagatggtgtcagaggtctcaagggatctaaaggtgaaaagggtgaagatggttttccaggattcaaaggtgacatgggtctaaaaggtgacagaggagaagttggtcaaattggcccaagaggggaagatggccctgaaggacccaaaggtcgagcaggcccaactggagacccaggtccttcaggtcaagcaggagaaaagggaaaacttggagttccaggattaccaggatatccaggaagacaaggtccaaagggttccactggattccctgggtttccaggtgccaatggagagaaaggtgcacggggagtagctggcaaaccaggccctcggggtcagcgtggtccaacgggtcctcgaggttcaagaggtgcaagaggtcccactgggaaacctgggccaaagggcacttcaggtggcgatggccctcctggccctccaggtgaaagaggtcctcaaggacctcagggtccagttggattccctggaccaaaaggccctcctggaccacctgggaaggatgggctgccaggacaccctgggcaacgtggggagactggatttcaaggcaagaccggccctcctgggccagggggagtggttggaccacagggaccaaccggtgagactggtccaataggggaacgtgggcatcctggccctcctggccctcctggtgagcaaggtcttcctggtgctgcaggaaaagaaggtgcaaagggtgatccaggtcctcaaggtatctcagggaaagatggaccagcaggattacgtggtttcccaggggaaagaggtcttcctggagctcagggtgcacctggactgaaaggaggggaaggtccccagggcccaccaggtccagttggctcaccaggagaacgtgggtcagcaggtacagctggcccaattggtttaccagggcgcccgggacctcagggtcctcctggtccagctggagagaaaggtgctcctggagaaaaaggtccccaagggcctgcagggagagatggagttcaaggtcctgttggtctcccagggccagctggtcctgccggctcccctggggaagacggagacaagggtgaaattggtgagccgggacaaaaaggcagcaagggtgacaagggagaaaatggccctcccggtcccccaggtcttcaaggaccagttggtgcccctggaattgctggaggtgatggtgaaccaggtcctagaggacagcaggggatgtttgggcaaaaaggtgatgagggtgccagaggcttccctggacctcctggtccaataggtcttcagggtctgccaggcccacctggtgaaaaaggtgaaaatggggatgttggtcccatggggccacctggtcctccaggcccaagaggccctcaaggtcccaatggagctgatggaccacaaggacccccagggtctgttggttcagttggtggtgttggagaaaagggtgaacctggagaagcagggaacccagggcctcctggggaagcaggtgtaggcggtcccaaaggagaaagaggagagaaaggggaagctggtccacctggagctgctggacctccaggtgccaaggggccaccaggtgatgatggccctaagggtaacccgggtcctgttggttttcctggagatcctggtcctcctggggaacctggccctgcaggtcaagatggtgttggtggtgacaagggtgaagatggagatcctggtcaaccgggtcctcctggcccatctggtgaggctggcccaccaggtcctcctggaaaacgaggtcctcctggagctgcaggtgcagagggaagacaaggtgaaaaaggtgctaagggggaagcaggtgcagaaggtcctcctggaaaaaccggcccagtcggtcctcagggacctgcaggaaagcctggtccagaaggtcttcggggcatccctggtcctgtgggagaacaaggtctccctggagctgcaggccaagatggaccacctggtcctatgggacctcctggcttacctggtctcaaaggtgaccctggctccaagggtgaaaagggacatcctggtttaattggcctgattggtcctccaggagaacaaggggaaaaaggtgaccgagggctccctggaactcaaggatctccaggagcaaaaggggatgggggaattcctggtcctgctggtcccttaggtccacctggtcctccaggtttaccaggtcctcaaggcccaaagggtaacaaaggctctactggacccgctggccagaaaggtgacagtggtcttccagggcctcctgggtctccaggtccacctggtgaagtcattcagcctttaccaatcttgtcctccaaaaaaacgagaagacatactgaaggcatgcaagcagatgcagatgataatattcttgattactcggatggaatggaagaaatatttggttccctcaattccctgaaacaagacattgagcatatgaaatttccaatgggtactcagaccaatccagcccgaacttgtaaagacctgcaactcagccatcctgacttcccagatggtgaatattggattgatcctaaccaaggttgctcaggagattccttcaaagtttactgtaatttcacatctggtggtgagacttgcatttatccagacaaaaaatctgagggagtaagaatttcatcatggccaaaggagaaaccaggaagttggtttagtgaatttaagaggggaaaactgctttcatacttagatgttgaaggaaattccatcaatatggtgcaaatgacattcctgaaacttctgactgcctctgctcggcaaaatttcacctaccactgtcatcagtcagcagcctggtatgatgtgtcatcaggaagttatgacaaagcacttcgcttcctgggatcaaatgatgaggagatgtcctatgacaataatccttttatcaaaacactgtatgatggttgtgcgtccagaaaaggctatgaaaagactgtcattgaaatcaatacaccaaaaattgatcaagtacctattgttgatgtcatgatcaatgactttggtgatcagaatcagaagttcggatttgaagttggtcctgtttgttttcttggctaagattaagacaaagaacatatcaaatcaacagaaaatataccttggtgccaccaacccattttgtgccacatgcaagttttgaataaggatggtatagaaaacaacgctgcatatacaggtaccatttaggaaataccgatgcctttgtgggggcagaatcacatggcaaaagctttgaaaatcataaagatataagttggtgtggctaagatggaaacagggctgattcttgattcccaattctcaactctccttttcctatttgaatttctttggtgctgtagaaaacaaaaaaagaaaaatatatattcataaaaaatatggtgctcattctcatccatccaggatgtactaaaacagtgtgtttaataaattgtaattattttgtgtacagttctatactgttatctgtgtccatttccaaaacttgcacgtgtccctgaattccatctgactctaattttatgagaattgcagaactctgatggcaataaatatatgtattatgaaaaaataaagttgtaatttctgatgactctaagtccctttctttggttaataataaaatgcctttgtatatattgatgttgaagagttcaattatttgatgtcgccaacaaaattctcagagggcaaaaatctggaagacttttggaagcacactctgatcaactcttctctgccgacagtcattttgctgaatttcagccaaaaatattatgcattttgatgctttattcaaggctatacctcaaactttttcttctcagaatccaggatttcacaggatacttgtatatatggaaaacaagcaagtttatatttttggacagggaaatgtgtgtaagaaagtatattaacaaatcaatgcctccgtcaagcaaacaatcatatgtatactttttttctacgttatctcatctccttgttttcagtgtgcttcaataatgcaggttaatattaaagatggaaattaagcaattatttatgaatttgtgcaatgttagattttcttatcaatcaagttcttgaatttgattctaagttgcatattataacagtctcgaaaattattttacttgcccaacaaatattacttttttcctttcaagataattttataaatcatttgacctacctaattgctaaatgaataacatatggtggactgttattaagagtatttgttttaagtcattcaggaaaatctaaacttttttttccactaaggtatttactttaaggtagcttgaaatagcaatacaatttaaaaattaaaaactgaattttgtatctattttaagtaatatatgtaagacttgaaaataaatgttttatttcttatataaagtgttaaattaattgataccagatttcactggaacagtttcaactgataatttatgacaaaagaacatacctgtaatattgaaattaaaaagtgaaatttgtcataaagaatttcttttatttttgaaatcgagtttgtaaatgtccttttaagaagggagatatgaatccaataaataaactcaagtcttggctacctgga

SEQ ID NO: 1101 - DNA, 7327 bp, Homo sapiens
acacagtactctcagcttgttggtggaagcccctcatctgccttcattctgaaggcagggcccggcagaggaaggatcagagggtcgcggccggagggtcccggccggtggggccaactcagagggagaggaaagggctagagacacgaagaacgcaaaccatcaaatttagaagaaaaagccctttgactttttccccctctccctccccaatggctgtgtagcaaacatccctggcgataccttggaaaggacgaagttggtctgcagtcgcaatttcgtgggttgagttcacagttgtgagtgcggggctcggagatggagccgtggtcctctaggtggaaaacgaaacggtggctctgggatttcaccgtaacaaccctcgcattgaccttcctcttccaagctagagaggtcagaggagctgctccagttgatgtactaaaagcactagattttcacaattctccagagggaatatcaaaaacaacgggattttgcacaaacagaaagaattctaaaggctcagatactgcttacagagtttcaaagcaagcacaactcagtgccccaacaaaacagttatttccaggtggaactttcccagaagacttttcaatactatttacagtaaaaccaaaaaaaggaattcagtctttccttttatctatatataatgagcatggtattcagcaaattggtgttgaggttgggagatcacctgtttttctgtttgaagaccacactggaaaacctgccccagaagactatcccctcttcagaactgttaacatcgctgacgggaagtggcatcgggtagcaatcagcgtggagaagaaaactgtgacaatgattgttgattgtaagaagaaaaccacgaaaccacttgatagaagtgagagagcaattgttgataccaatggaatcacggtttttggaacaaggattttggatgaagaagtttttgagggggacattcagcagtttttgatcacaggtgatcccaaggcagcatatgactactgtgagcattatagtccagactgtgactcttcagcacccaaggctgctcaagctcaggaacctcagatagatgagaaaaagaaatccaatttcaaaaagaagatgaggacagtggctactaaatcaaaggaaaaatccaaaaagtttacaccccccaaatctgaaaaattttcatccaagaagaagaaaagttatcaagcatcagcaaaagccaaactaggggtaaaggcaaacatcgttgatgattttcaagaatacaactatggaacaatggaaagttaccagacagaagctcctaggcatgtttctgggacaaatgagccaaatccagttgaagaaatatttactgaagaatatctaacgggagaggattatgattcccagaggaaaaattctgaggatacactatatgaaaacaaagaaatagacggcagggattctgatcttctggtagatggagatttaggcgaatatgatttttatgaatataaagaatatgaagataaaccaacaagcccccctaatgaagaatttggtccaggtgtaccagcagaaactgatattacagaaacaagcataaatggccatggtgcatatggagagaaaggacagaaaggagaaccagcagtggttgagcctggtatgcttgtcgaaggaccaccaggaccagcaggacctgcaggtattatgggtcctccaggtctacaaggccccactggaccccctggtgaccctggcgataggggccccccaggacgtcctggcttaccaggggctgatggtctacctggtcctcctggtactatgttgatgttaccgttccgttatggtggtgatggttccaaaggaccaaccatctctgctcaggaagctcaggctcaagctattcttcagcaggctcggattgctctgagaggcccacctggcccaatgggtctaactggaagaccaggtcctgtgggggggcctggttcatctggggccaaaggtgagagtggtgatccaggtcctcagggccctcgaggcgtccagggtccccctggtccaacgggaaaacctggaaaaaggggtcgtccaggtgcagatggaggaagaggaatgccaggagaacctggggcaaagggagatcgagggtttgatggacttccgggtctgccaggtgacaaaggtcacaggggtgaacgaggtcctcaaggtcctccaggtcctcctggtgatgatggaatgaggggagaagatggagaaattggaccaagaggtcttccaggtgaagctggcccacgaggtttgctgggtccaaggggaactccaggagctccagggcagcctggtatggcaggtgtagatggccccccaggaccaaaagggaacatgggtccccaaggggagcctgggcctccaggtcaacaagggaatccaggacctcagggtcttcctggtccacaaggtccaattggtcctcctggtgaaaaaggaccacaaggaaaaccaggacttgctggacttcctggtgctgatgggcctcctggtcatcctgggaaagaaggccagtctggagaaaagggggctctgggtccccctggtccacaaggtcctattggatacccgggcccccggggagtaaagggagcagatggtgtcagaggtctcaagggatctaaaggtgaaaagggtgaagatggttttccaggattcaaaggtgacatgggtctaaaaggtgacagaggagaagttggtcaaattggcccaagaggggaagatggccctgaaggacccaaaggtcgagcaggcccaactggagacccaggtccttcaggtcaagcaggagaaaagggaaaacttggagttccaggattaccaggatatccaggaagacaaggtccaaagggttccactggattccctgggtttccaggtgccaatggagagaaaggtgcacggggagtagctggcaaaccaggccctcggggtcagcgtggtccaacgggtcctcgaggttcaagaggtgcaagaggtcccactgggaaacctgggccaaagggcacttcaggtggcgatggccctcctggccctccaggtgaaagaggtcctcaaggacctcagggtccagttggattccctggaccaaaaggccctcctggaccacctgggaaggatgggctgccaggacaccctgggcaacgtggggagactggatttcaaggcaagaccggccctcctgggccagggggagtggttggaccacagggaccaaccggtgagactggtccaataggggaacgtgggcatcctggccctcctggccctcctggtgagcaaggtcttcctggtgctgcaggaaaagaaggtgcaaagggtgatccaggtcctcaaggtatctcagggaaagatggaccagcaggattacgtggtttcccaggggaaagaggtcttcctggagctcagggtgcacctggactgaaaggaggggaaggtccccagggcccaccaggtccagttggctcaccaggagaacgtgggtcagcaggtacagctggcccaattggtttaccagggcgcccgggacctcagggtcctcctggtccagctggagagaaaggtgctcctggagaaaaaggtccccaagggcctgcagggagagatggagttcaaggtcctgttggtctcccagggccagctggtcctgccggctcccctggggaagacggagacaagggtgaaattggtgagccgggacaaaaaggcagcaagggtgacaagggagaaaatggccctcccggtcccccaggtcttcaaggaccagttggtgcccctggaattgctggaggtgatggtgaaccaggtcctagaggacagcaggggatgtttgggcaaaaaggtgatgagggtgccagaggcttccctggacctcctggtccaataggtcttcagggtctgccaggcccacctggtgaaaaaggtgaaaatggggatgttggtcccatggggccacctggtcctccaggcccaagaggccctcaaggtcccaatggagctgatggaccacaaggacccccagggtctgttggttcagttggtggtgttggagaaaagggtgaacctggagaagcagggaacccagggcctcctggggaagcaggtgtaggcggtcccaaaggagaaagaggagagaaaggggaagctggtccacctggagctgctggacctccaggtgccaaggggccaccaggtgatgatggccctaagggtaacccgggtcctgttggttttcctggagatcctggtcctcctggggaacctggccctgcaggtcaagatggtgttggtggtgacaagggtgaagatggagatcctggtcaaccgggtcctcctggcccatctggtgaggctggcccaccaggtcctcctggaaaacgaggtcctcctggagctgcaggtgcagagggaagacaaggtgaaaaaggtgctaagggggaagcaggtgcagaaggtcctcctggaaaaaccggcccagtcggtcctcagggacctgcaggaaagcctggtccagaaggtcttcggggcatccctggtcctgtgggagaacaaggtctccctggagctgcaggccaagatggaccacctggtcctatgggacctcctggcttacctggtctcaaaggtgaccctggctccaagggtgaaaagggacatcctggtttaattggcctgattggtcctccaggagaacaaggggaaaaaggtgaccgagggctccctggaactcaaggatctccaggagcaaaaggggatgggggaattcctggtcctgctggtcccttaggtccacctggtcctccaggtttaccaggtcctcaaggcccaaagggtaacaaaggctctactggacccgctggccagaaaggtgacagtggtcttccagggcctcctgggtctccaggtccacctggtgaagtcattcagcctttaccaatcttgtcctccaaaaaaacgagaagacatactgaaggcatgcaagcagatgcagatgataatattcttgattactcggatggaatggaagaaatatttggttccctcaattccctgaaacaagacattgagcatatgaaatttccaatgggtactcagaccaatccagcccgaacttgtaaagacctgcaactcagccatcctgacttcccagatggtgaatattggattgatcctaaccaaggttgctcaggagattccttcaaagtttactgtaatttcacatctggtggtgagacttgcatttatccagacaaaaaatctgagggagtaagaatttcatcatggccaaaggagaaaccaggaagttggtttagtgaatttaagaggggaaaactgctttcatacttagatgttgaaggaaattccatcaatatggtgcaaatgacattcctgaaacttctgactgcctctgctcggcaaaatttcacctaccactgtcatcagtcagcagcctggtatgatgtgtcatcaggaagttatgacaaagcacttcgcttcctgggatcaaatgatgaggagatgtcctatgacaataatccttttatcaaaacactgtatgatggttgtgcgtccagaaaaggctatgaaaagactgtcattgaaatcaatacaccaaaaattgatcaagtacctattgttgatgtcatgatcaatgactttggtgatcagaatcagaagttcggatttgaagttggtcctgtttgttttcttggctaagattaagacaaagaacatatcaaatcaacagaaaatataccttggtgccaccaacccattttgtgccacatgcaagttttgaataaggatggtatagaaaacaacgctgcatatacaggtaccatttaggaaataccgatgcctttgtgggggcagaatcacatggcaaaagctttgaaaatcataaagatataagttggtgtggctaagatggaaacagggctgattcttgattcccaattctcaactctccttttcctatttgaatttctttggtgctgtagaaaacaaaaaaagaaaaatatatattcataaaaaatatggtgctcattctcatccatccaggatgtactaaaacagtgtgtttaataaattgtaattattttgtgtacagttctatactgttatctgtgtccatttccaaaacttgcacgtgtccctgaattccatctgactctaattttatgagaattgcagaactctgatggcaataaatatatgtattatgaaaaaataaagttgtaatttctgatgactctaagtccctttctttggttaataataaaatgcctttgtatatattgatgttgaagagttcaattatttgatgtcgccaacaaaattctcagagggcaaaaatctggaagacttttggaagcacactctgatcaactcttctctgccgacagtcattttgctgaatttcagccaaaaatattatgcattttgatgctttattcaaggctatacctcaaactttttcttctcagaatccaggatttcacaggatacttgtatatatggaaaacaagcaagtttatatttttggacagggaaatgtgtgtaagaaagtatattaacaaatcaatgcctccgtcaagcaaacaatcatatgtatactttttttctacgttatctcatctccttgttttcagtgtgcttcaataatgcaggttaatattaaagatggaaattaagcaattatttatgaatttgtgcaatgttagattttcttatcaatcaagttcttgaatttgattctaagttgcatattataacagtctcgaaaattattttacttgcccaacaaatattacttttttcctttcaagataattttataaatcatttgacctacctaattgctaaatgaataacatatggtggactgttattaagagtatttgttttaagtcattcaggaaaatctaaacttttttttccactaaggtatttactttaaggtagcttgaaatagcaatacaatttaaaaattaaaaactgaattttgtatctattttaagtaatatatgtaagacttgaaaataaatgttttatttcttatataaagtgttaaattaattgataccagatttcactggaacagtttcaactgataatttatgacaaaagaacatacctgtaatattgaaattaaaaagtgaaatttgtcataaagaatttcttttatttttgaaatcgagtttgtaaatgtccttttaagaagggagatatgaatccaataaataaactcaagtcttggctacctgga

SEQ ID NO: 1102 - DNA, 7253 bp, Homo sapiens
acacagtactctcagcttgttggtggaagcccctcatctgccttcattctgaaggcagggcccggcagaggaaggatcagagggtcgcggccggagggtcccggccggtggggccaactcagagggagaggaaagggctagagacacgaagaacgcaaaccatcaaatttagaagaaaaagccctttgactttttccccctctccctccccaatggctgtgtagcaaacatccctggcgataccttggaaaggacgaagttggtctgcagtcgcaatttcgtgggttgagttcacagttgtgagtgcggggctcggagatggagccgtggtcctctaggtggaaaacgaaacggtggctctgggatttcaccgtaacaaccctcgcattgaccttcctcttccaagctagagaggtcagaggagctgctccagttgatgtactaaaagcactagattttcacaattctccagagggaatatcaaaaacaacgggattttgcacaaacagaaagaattctaaaggctcagatactgcttacagagtttcaaagcaagcacaactcagtgccccaacaaaacagttatttccaggtggaactttcccagaagacttttcaatactatttacagtaaaaccaaaaaaaggaattcagtctttccttttatctatatataatgagcatggtattcagcaaattggtgttgaggttgggagatcacctgtttttctgtttgaagaccacactggaaaacctgccccagaagactatcccctcttcagaactgttaacatcgctgacgggaagtggcatcgggtagcaatcagcgtggagaagaaaactgtgacaatgattgttgattgtaagaagaaaaccacgaaaccacttgatagaagtgagagagcaattgttgataccaatggaatcacggtttttggaacaaggattttggatgaagaagtttttgagggggacattcagcagtttttgatcacaggtgatcccaaggcagcatatgactactgtgagcattatagtccagactgtgactcttcagcacccaaggctgctcaagctcaggaacctcagatagatgagtatgcaccagaggatataatcgaatatgactatgagtatggggaagcagagtataaagaggctgaaagtgtaacagagggacccactgtaactgaggagacaatagcacagacggaggcaaacatcgttgatgattttcaagaatacaactatggaacaatggaaagttaccagacagaagctcctaggcatgtttctgggacaaatgagccaaatccagttgaagaaatatttactgaagaatatctaacgggagaggattatgattcccagaggaaaaattctgaggatacactatatgaaaacaaagaaatagacggcagggattctgatcttctggtagatggagatttaggcgaatatgatttttatgaatataaagaatatgaagataaaccaacaagcccccctaatgaagaatttggtccaggtgtaccagcagaaactgatattacagaaacaagcataaatggccatggtgcatatggagagaaaggacagaaaggagaaccagcagtggttgagcctggtatgcttgtcgaaggaccaccaggaccagcaggacctgcaggtattatgggtcctccaggtctacaaggccccactggaccccctggtgaccctggcgataggggccccccaggacgtcctggcttaccaggggctgatggtctacctggtcctcctggtactatgttgatgttaccgttccgttatggtggtgatggttccaaaggaccaaccatctctgctcaggaagctcaggctcaagctattcttcagcaggctcggattgctctgagaggcccacctggcccaatgggtctaactggaagaccaggtcctgtgggggggcctggttcatctggggccaaaggtgagagtggtgatccaggtcctcagggccctcgaggcgtccagggtccccctggtccaacgggaaaacctggaaaaaggggtcgtccaggtgcagatggaggaagaggaatgccaggagaacctggggcaaagggagatcgagggtttgatggacttccgggtctgccaggtgacaaaggtcacaggggtgaacgaggtcctcaaggtcctccaggtcctcctggtgatgatggaatgaggggagaagatggagaaattggaccaagaggtcttccaggtgaagctggcccacgaggtttgctgggtccaaggggaactccaggagctccagggcagcctggtatggcaggtgtagatggccccccaggaccaaaagggaacatgggtccccaaggggagcctgggcctccaggtcaacaagggaatccaggacctcagggtcttcctggtccacaaggtccaattggtcctcctggtgaaaaaggaccacaaggaaaaccaggacttgctggacttcctggtgctgatgggcctcctggtcatcctgggaaagaaggccagtctggagaaaagggggctctgggtccccctggtccacaaggtcctattggatacccgggcccccggggagtaaagggagcagatggtgtcagaggtctcaagggatctaaaggtgaaaagggagaagttggtcaaattggcccaagaggggaagatggccctgaaggacccaaaggtcgagcaggcccaactggagacccaggtccttcaggtcaagcaggagaaaagggaaaacttggagttccaggattaccaggatatccaggaagacaaggtccaaaggatttcagatgtcattggttccactggattccctgggtttccaggtgccaatggagagaaaggtgcacggggagtagctggcaaaccaggccctcggggtcagcgtggtccaacgggtcctcgaggttcaagaggtgcaagaggtcccactgggaaacctgggccaaagggcacttcaggtggcgatggccctcctggccctccaggtgaaagaggtcctcaaggacctcagggtccagttggattccctggaccaaaaggccctcctggaccacctgggaaggatgggctgccaggacaccctgggcaacgtggggagactggatttcaaggcaagaccggccctcctgggccagggggagtggttggaccacagggaccaaccggtgagactggtccaataggggaacgtgggcatcctggccctcctggccctcctggtgagcaaggtcttcctggtgctgcaggaaaagaaggtgcaaagggtgatccaggtcctcaaggtatctcagggaaagatggaccagcaggattacgtggtttcccaggggaaagaggtcttcctggagctcagggtgcacctggactgaaaggaggggaaggtccccagggcccaccaggtccagttggctcaccaggagaacgtgggtcagcaggtacagctggcccaattggtttaccagggcgcccgggacctcagggtcctcctggtccagctggagagaaaggtgctcctggagaaaaaggtccccaagggcctgcagggagagatggagttcaaggtcctgttggtctcccagggccagctggtcctgccggctcccctggggaagacggagacaagggtgaaattggtgagccgggacaaaaaggcagcaagggtgacaagggagaaaatggccctcccggtcccccaggtcttcaaggaccagttggtgcccctggaattgctggaggtgatggtgaaccaggtcctagaggacagcaggggatgtttgggcaaaaaggtgatgagggtgccagaggcttccctggacctcctggtccaataggtcttcagggtctgccaggcccacctggtgaaaaaggtgaaaatggggatgttggtcccatggggccacctggtcctccaggcccaagaggccctcaaggtcccaatggagctgatggaccacaaggacccccagggtctgttggttcagttggtggtgttggagaaaagggtgaacctggagaagcagggaacccagggcctcctggggaagcaggtgtaggcggtcccaaaggagaaagaggagagaaaggggaagctggtccacctggagctgctggacctccaggtgccaaggggccaccaggtgatgatggccctaagggtaacccgggtcctgttggttttcctggagatcctggtcctcctggggaacctggccctgcaggtcaagatggtgttggtggtgacaagggtgaagatggagatcctggtcaaccgggtcctcctggcccatctggtgaggctggcccaccaggtcctcctggaaaacgaggtcctcctggagctgcaggtgcagagggaagacaaggtgaaaaaggtgctaagggggaagcaggtgcagaaggtcctcctggaaaaaccggcccagtcggtcctcagggacctgcaggaaagcctggtccagaaggtcttcggggcatccctggtcctgtgggagaacaaggtctccctggagctgcaggccaagatggaccacctggtcctatgggacctcctggcttacctggtctcaaaggtgaccctggctccaagggtgaaaagggacatcctggtttaattggcctgattggtcctccaggagaacaaggggaaaaaggtgaccgagggctccctggaactcaaggatctccaggagcaaaaggggatgggggaattcctggtcctgctggtcccttaggtccacctggtcctccaggtttaccaggtcctcaaggcccaaagggtaacaaaggctctactggacccgctggccagaaaggtgacagtggtcttccagggcctcctgggtctccaggtccacctggtgaagtcattcagcctttaccaatcttgtcctccaaaaaaacgagaagacatactgaaggcatgcaagcagatgcagatgataatattcttgattactcggatggaatggaagaaatatttggttccctcaattccctgaaacaagacattgagcatatgaaatttccaatgggtactcagaccaatccagcccgaacttgtaaagacctgcaactcagccatcctgacttcccagatggtgaatattggattgatcctaaccaaggttgctcaggagattccttcaaagtttactgtaatttcacatctggtggtgagacttgcatttatccagacaaaaaatctgagggagtaagaatttcatcatggccaaaggagaaaccaggaagttggtttagtgaatttaagaggggaaaactgctttcatacttagatgttgaaggaaattccatcaatatggtgcaaatgacattcctgaaacttctgactgcctctgctcggcaaaatttcacctaccactgtcatcagtcagcagcctggtatgatgtgtcatcaggaagttatgacaaagcacttcgcttcctgggatcaaatgatgaggagatgtcctatgacaataatccttttatcaaaacactgtatgatggttgtgcgtccagaaaaggctatgaaaagactgtcattgaaatcaatacaccaaaaattgatcaagtacctattgttgatgtcatgatcaatgactttggtgatcagaatcagaagttcggatttgaagttggtcctgtttgttttcttggctaagattaagacaaagaacatatcaaatcaacagaaaatataccttggtgccaccaacccattttgtgccacatgcaagttttgaataaggatggtatagaaaacaacgctgcatatacaggtaccatttaggaaataccgatgcctttgtgggggcagaatcacatggcaaaagctttgaaaatcataaagatataagttggtgtggctaagatggaaacagggctgattcttgattcccaattctcaactctccttttcctatttgaatttctttggtgctgtagaaaacaaaaaaagaaaaatatatattcataaaaaatatggtgctcattctcatccatccaggatgtactaaaacagtgtgtttaataaattgtaattattttgtgtacagttctatactgttatctgtgtccatttccaaaacttgcacgtgtccctgaattccatctgactctaattttatgagaattgcagaactctgatggcaataaatatatgtattatgaaaaaataaagttgtaatttctgatgactctaagtccctttctttggttaataataaaatgcctttgtatatattgatgttgaagagttcaattatttgatgtcgccaacaaaattctcagagggcaaaaatctggaagacttttggaagcacactctgatcaactcttctctgccgacagtcattttgctgaatttcagccaaaaatattatgcattttgatgctttattcaaggctatacctcaaactttttcttctcagaatccaggatttcacaggatacttgtatatatggaaaacaagcaagtttatatttttggacagggaaatgtgtgtaagaaagtatattaacaaatcaatgcctccgtcaagcaaacaatcatatgtatactttttttctacgttatctcatctccttgttttcagtgtgcttcaataatgcaggttaatattaaagatggaaattaagcaattatttatgaatttgtgcaatgttagattttcttatcaatcaagttcttgaatttgattctaagttgcatattataacagtctcgaaaattattttacttgcccaacaaatattacttttttcctttcaagataattttataaatcatttgacctacctaattgctaaatgaataacatatggtggactgttattaagagtatttgttttaagtcattcaggaaaatctaaacttttttttccactaaggtatttactttaaggtagcttgaaatagcaatacaatttaaaaattaaaaactgaattttgtatctattttaagtaatatatgtaagacttgaaaataaatgttttatttcttatataaagtgttaaattaattgataccagatttcactggaacagtttcaactgataatttatgacaaaagaacatacctgtaatattgaaattaaaaagtgaaatttgtcataaagaatttcttttatttttgaaatcgagtttgtaaatgtccttttaagaagggagatatgaatccaataaataaactcaagtcttggctacctgga

SEQ ID NO: 1103 - DNA, 7286 bp, Homo sapiens
gtactctcagcttgttggtggaagcccctcatctgccttcattctgaaggcagggcccggcagaggaaggatcagagggtcgcggccggagggtcccggccggtggggccaactcagagggagaggaaagggctagagacacgaagaacgcaaaccatcaaatttagaagaaaaagccctttgactttttccccctctccctccccaatggctgtgtagcaaacatccctggcgataccttggaaaggacgaagttggtctgcagtcgcaatttcgtgggttgagttcacagttgtgagtgcggggctcggagatggagccgtggtcctctaggtggaaaacgaaacggtggctctgggatttcaccgtaacaaccctcgcattgaccttcctcttccaagctagagaggtcagaggagctgctccagttgatgtactaaaagcactagattttcacaattctccagagggaatatcaaaaacaacgggattttgcacaaacagaaagaattctaaaggctcagatactgcttacagagtttcaaagcaagcacaactcagtgccccaacaaaacagttatttccaggtggaactttcccagaagacttttcaatactatttacagtaaaaccaaaaaaaggaattcagtctttccttttatctatatataatgagcatggtattcagcaaattggtgttgaggttgggagatcacctgtttttctgtttgaagaccacactggaaaacctgccccagaagactatcccctcttcagaactgttaacatcgctgacgggaagtggcatcgggtagcaatcagcgtggagaagaaaactgtgacaatgattgttgattgtaagaagaaaaccacgaaaccacttgatagaagtgagagagcaattgttgataccaatggaatcacggtttttggaacaaggattttggatgaagaagtttttgagggggacattcagcagtttttgatcacaggtgatcccaaggcagcatatgactactgtgagcattatagtccagactgtgactcttcagcacccaaggctgctcaagctcaggaacctcagatagatgagtatgcaccagaggatataatcgaatatgactatgagtatggggaagcagagtataaagaggctgaaagtgtaacagagggacccactgtaactgaggagacaatagcacagacggaggcaaacatcgttgatgattttcaagaatacaactatggaacaatggaaagttaccagacagaagctcctaggcatgtttctgggacaaatgagccaaatccagttgaagaaatatttactgaagaatatctaacgggagaggattatgattcccagaggaaaaattctgaggatacactatatgaaaacaaagaaatagacggcagggattctgatcttctggtagatggagatttaggcgaatatgatttttatgaatataaagaatatgaagataaaccaacaagcccccctaatgaagaatttggtccaggtgtaccagcagaaactgatattacagaaacaagcataaatggccatggtgcatatggagagaaaggacagaaaggagaaccagcagtggttgagcctggtatgcttgtcgaaggaccaccaggaccagcaggacctgcaggtattatgggtcctccaggtctacaaggccccactggaccccctggtgaccctggcgataggggccccccaggacgtcctggcttaccaggggctgatggtctacctggtcctcctggtactatgttgatgttaccgttccgttatggtggtgatggttccaaaggaccaaccatctctgctcaggaagctcaggctcaagctattcttcagcaggctcggattgctctgagaggcccacctggcccaatgggtctaactggaagaccaggtcctgtgggggggcctggttcatctggggccaaaggtgagagtggtgatccaggtcctcagggccctcgaggcgtccagggtccccctggtccaacgggaaaacctggaaaaaggggtcgtccaggtgcagatggaggaagaggaatgccaggagaacctggggcaaagggagatcgagggtttgatggacttccgggtctgccaggtgacaaaggtcacaggggtgaacgaggtcctcaaggtcctccaggtcctcctggtgatgatggaatgaggggagaagatggagaaattggaccaagaggtcttccaggtgaagctggcccacgaggtttgctgggtccaaggggaactccaggagctccagggcagcctggtatggcaggtgtagatggccccccaggaccaaaagggaacatgggtccccaaggggagcctgggcctccaggtcaacaagggaatccaggacctcagggtcttcctggtccacaaggtccaattggtcctcctggtgaaaaaggaccacaaggaaaaccaggacttgctggacttcctggtgctgatgggcctcctggtcatcctgggaaagaaggccagtctggagaaaagggggctctgggtccccctggtccacaaggtcctattggatacccgggcccccggggagtaaagggagcagatggtgtcagaggtctcaagggatctaaaggtgaaaagggtgaagatggttttccaggattcaaaggtgacatgggtctaaaaggtgacagaggagaagttggtcaaattggcccaagaggggaagatggccctgaaggacccaaaggtcgagcaggcccaactggagacccaggtccttcaggtcaagcaggagaaaagggaaaacttggagttccaggattaccaggatatccaggaagacaaggtccaaagggttccactggattccctgggtttccaggtgccaatggagagaaaggtgcacggggagtagctggcaaaccaggccctcggggtcagcgtggtccaacgggtcctcgaggttcaagaggtgcaagaggtcccactgggaaacctgggccaaagggcacttcaggtggcgatggccctcctggccctccaggtgaaagaggtcctcaaggacctcagggtccagttggattccctggaccaaaaggccctcctggaccacctgggaaggatgggctgccaggacaccctgggcaacgtggggagactggatttcaaggcaagaccggccctcctgggccagggggagtggttggaccacagggaccaaccggtgagactggtccaataggggaacgtgggcatcctggccctcctggccctcctggtgagcaaggtcttcctggtgctgcaggaaaagaaggtgcaaagggtgatccaggtcctcaaggtatctcagggaaagatggaccagcaggattacgtggtttcccaggggaaagaggtcttcctggagctcagggtgcacctggactgaaaggaggggaaggtccccagggcccaccaggtccagttggctcaccaggagaacgtgggtcagcaggtacagctggcccaattggtttaccagggcgcccgggacctcagggtcctcctggtccagctggagagaaaggtgctcctggagaaaaaggtccccaagggcctgcagggagagatggagttcaaggtcctgttggtctcccagggccagctggtcctgccggctcccctggggaagacggagacaagggtgaaattggtgagccgggacaaaaaggcagcaagggtgacaagggagaaaatggccctcccggtcccccaggtcttcaaggaccagttggtgcccctggaattgctggaggtgatggtgaaccaggtcctagaggacagcaggggatgtttgggcaaaaaggtgatgagggtgccagaggcttccctggacctcctggtccaataggtcttcagggtctgccaggcccacctggtgaaaaaggtgaaaatggggatgttggtcccatggggccacctggtcctccaggcccaagaggccctcaaggtcccaatggagctgatggaccacaaggacccccagggtctgttggttcagttggtggtgttggagaaaagggtgaacctggagaagcagggaacccagggcctcctggggaagcaggtgtaggcggtcccaaaggagaaagaggagagaaaggggaagctggtccacctggagctgctggacctccaggtgccaaggggccaccaggtgatgatggccctaagggtaacccgggtcctgttggttttcctggagatcctggtcctcctggggaacctggccctgcaggtcaagatggtgttggtggtgacaagggtgaagatggagatcctggtcaaccgggtcctcctggcccatctggtgaggctggcccaccaggtcctcctggaaaacgaggtcctcctggagctgcaggtgcagagggaagacaaggtgaaaaaggtgctaagggggaagcaggtgcagaaggtcctcctggaaaaaccggcccagtcggtcctcagggacctgcaggaaagcctggtccagaaggtcttcggggcatccctggtcctgtgggagaacaaggtctccctggagctgcaggccaagatggaccacctggtcctatgggacctcctggcttacctggtctcaaaggtgaccctggctccaagggtgaaaagggacatcctggtttaattggcctgattggtcctccaggagaacaaggggaaaaaggtgaccgagggctccctggaactcaaggatctccaggagcaaaaggggatgggggaattcctggtcctgctggtcccttaggtccacctggtcctccaggtttaccaggtcctcaaggcccaaagggtaacaaaggctctactggacccgctggccagaaaggtgacagtggtcttccagggcctcctgggtctccaggtccacctggtgaagtcattcagcctttaccaatcttgtcctccaaaaaaacgagaagacatactgaaggcatgcaagcagatgcagatgataatattcttgattactcggatggaatggaagaaatatttggttccctcaattccctgaaacaagacattgagcatatgaaatttccaatgggtactcagaccaatccagcccgaacttgtaaagacctgcaactcagccatcctgacttcccagatggtgaatattggattgatcctaaccaaggttgctcaggagattccttcaaagtttactgtaatttcacatctggtggtgagacttgcatttatccagacaaaaaatctgagggagtaagaatttcatcatggccaaaggagaaaccaggaagttggtttagtgaatttaagaggggaaaactgctttcatacttagatgttgaaggaaattccatcaatatggtgcaaatgacattcctgaaacttctgactgcctctgctcggcaaaatttcacctaccactgtcatcagtcagcagcctggtatgatgtgtcatcaggaagttatgacaaagcacttcgcttcctgggatcaaatgatgaggagatgtcctatgacaataatccttttatcaaaacactgtatgatggttgtgcgtccagaaaaggctatgaaaagactgtcattgaaatcaatacaccaaaaattgatcaagtacctattgttgatgtcatgatcaatgactttggtgatcagaatcagaagttcggatttgaagttggtcctgtttgttttcttggctaagattaagacaaagaacatatcaaatcaacagaaaatataccttggtgccaccaacccattttgtgccacatgcaagttttgaataaggatggtatagaaaacaacgctgcatatacaggtaccatttaggaaataccgatgcctttgtgggggcagaatcacatggcaaaagctttgaaaatcataaagatataagttggtgtggctaagatggaaacagggctgattcttgattcccaattctcaactctccttttcctatttgaatttctttggtgctgtagaaaacaaaaaaagaaaaatatatattcataaaaaatatggtgctcattctcatccatccaggatgtactaaaacagtgtgtttaataaattgtaattattttgtgtacagttctatactgttatctgtgtccatttccaaaacttgcacgtgtccctgaattccatctgactctaattttatgagaattgcagaactctgatggcaataaatatatgtattatgaaaaaataaagttgtaatttctgatgactctaagtccctttctttggttaataataaaatgcctttgtatatattgatgttgaagagttcaattatttgatgtcgccaacaaaattctcagagggcaaaaatctggaagacttttggaagcacactctgatcaactcttctctgccgacagtcattttgctgaatttcagccaaaaatattatgcattttgatgctttattcaaggctatacctcaaactttttcttctcagaatccaggatttcacaggatacttgtatatatggaaaacaagcaagtttatatttttggacagggaaatgtgtgtaagaaagtatattaacaaatcaatgcctccgtcaagcaaacaatcatatgtatactttttttctacgttatctcatctccttgttttcagtgtgcttcaataatgcaggttaatattaaagatggaaattaagcaattatttatgaatttgtgcaatgttagattttcttatcaatcaagttcttgaatttgattctaagttgcatattataacagtctcgaaaattattttacttgcccaacaaatattacttttttcctttcaagataattttataaatcatttgacctacctaattgctaaatgaataacatatggtggactgttattaagagtatttgttttaagtcattcaggaaaatctaaacttttttttccactaaggtatttactttaaggtagcttgaaatagcaatacaatttaaaaattaaaaactgaattttgtatctattttaagtaatatatgtaagacttgaaaataaatgttttatttcttatataaagtgttaaattaattgataccagatttcactggaacagtttcaactgataatttatgacaaaagaacatacctgtaatattgaaattaaaaagtgaaatttgtcataaagaatttcttttatttttgaaatcgagtttgtaaatgtccttttaagaagggagatatgaatccaataaataaactcaagtcttggctacctgga

SEQ ID NO: 1104 - DNA, 5442 bp, Homo sapiens
tgttggtggaagcccctcatctgccttcattctgaaggcagggcccggcagaggaaggatcagagggtcgcggccggagggtcccggccggtggggccaactcagagggagaggaaagggctagagacacgaagaacgcaaaccatcaaatttagaagaaaaagccctttgactttttccccctctccctccccaatggctgtgtagcaaacatccctggcgataccttggaaaggacgaagttggtctgcagtcgcaatttcgtgggttgagttcacagttgtgagtgcggggctcggagatggagccgtggtcctctaggtggaaaacgaaacggtggctctgggatttcaccgtaacaaccctcgcattgaccttcctcttccaagctagagaggtcagaggagctgctccagttgatgtactaaaagcactagattttcacaattctccagagggaatatcaaaaacaacgggattttgcacaaacagaaagaattctaaaggctcagatactgcttacagagtttcaaagcaagcacaactcagtgccccaacaaaacagttatttccaggtggaactttcccagaagacttttcaatactatttacagtaaaaccaaaaaaaggaattcagtctttccttttatctatatataatgagcatggtattcagcaaattggtgttgaggttgggagatcacctgtttttctgtttgaagaccacactggaaaacctgccccagaagactatcccctcttcagaactgttaacatcgctgacgggaagtggcatcgggtagcaatcagcgtggagaagaaaactgtgacaatgattgttgattgtaagaagaaaaccacgaaaccacttgatagaagtgagagagcaattgttgataccaatggaatcacggtttttggaacaaggattttggatgaagaagtttttgagggggacattcagcagtttttgatcacaggtgatcccaaggcagcatatgactactgtgagcattatagtccagactgtgactcttcagcacccaaggctgctcaagctcaggaacctcagatagatgagtatgcaccagaggatataatcgaatatgactatgagtatggggaagcagagtataaagaggctgaaagtgtaacagagggacccactgtaactgaggagacaatagcacagacggagataaatggccatggtgcatatggagagaaaggacagaaaggagaaccagcagtggttgagcctggtatgcttgtcgaaggaccaccaggaccagcaggacctgcaggtattatgggtcctccaggtctacaaggccccactggaccccctggtgaccctggcgataggggccccccaggacgtcctggcttaccaggggctgatggtctacctggtcctcctggtactatgttgatgttaccgttccgttatggtggtgatggttccaaaggaccaaccatctctgctcaggaagctcaggctcaagctattcttcagcaggctcggattgctctgagaggcccacctggcccaatgggtctaactggaagaccaggtcctgtgggggggcctggttcatctggggccaaaggtgagagtggtgatccaggtcctcagggccctcgaggcgtccagggtccccctggtccaacgggaaaacctggaaaaaggggtcgtccaggtgcagatggaggaagaggaatgccaggagaacctggggcaaagggagatcgagggtttgatggacttccgggtctgccaggtgacaaaggtcacaggggtgaacgaggtcctcaaggtcctccaggtcctcctggtgatgatggaatgaggggagaagatggagaaattggaccaagaggtcttccaggtgaagctggcccacgaggtttgctgggtccaaggggaactccaggagctccagggcagcctggtatggcaggtgtagatggccccccaggaccaaaagggaacatgggtccccaaggggagcctgggcctccaggtcaacaagggaatccaggacctcagggtcttcctggtccacaaggtccaattggtcctcctggtgaaaaaggaccacaaggaaaaccaggacttgctggacttcctggtgctgatgggcctcctggtcatcctgggaaagaaggccagtctggagaaaagggggctctgggtccccctggtccacaaggtcctattggatacccgggcccccggggagtaaagggagcagatggtgtcagaggtctcaagggatctaaaggtgaaaagggtgaagatggttttccaggattcaaaggtgacatgggtctaaaaggtgacagaggagaagttggtcaaattggcccaagaggggaagatggccctgaaggacccaaaggtcgagcaggcccaactggagacccaggtccttcaggtcaagcaggagaaaagggaaaacttggagttccaggattaccaggatatccaggaagacaaggtccaaagggttccactggattccctgggtttccaggtgccaatggagagaaaggtgcacggggagtagctggcaaaccaggccctcggggtcagcgtggtccaacgggtcctcgaggttcaagaggtgcaagaggtcccactgggaaacctgggccaaagggcacttcaggtggcgatggccctcctggccctccaggtgaaagaggtcctcaaggacctcagggtccagttggattccctggaccaaaaggccctcctggaccacctgggaaggatgggctgccaggacaccctgggcaacgtggggagactggatttcaaggcaagaccggccctcctgggccagggggagtggttggaccacagggaccaaccggtgagactggtccaataggggaacgtgggcatcctggccctcctggccctcctggtgagcaaggtcttcctggtgctgcaggaaaagaaggtgcaaagggtgatccaggtcctcaaggtatctcagggaaagatggaccagcaggattacgtggtttcccaggggaaagaggtcttcctggagctcagggtgcacctggactgaaaggaggggaaggtccccagggcccaccaggtccagttggctcaccaggagaacgtgggtcagcaggtacagctggcccaattggtttaccagggcgcccgggacctcagggtcctcctggtccagctggagagaaaggtgctcctggagaaaaaggtccccaagggcctgcagggagagatggagttcaaggtcctgttggtctcccagggccagctggtcctgccggctcccctggggaagacggagacaagggtgaaattggtgagccgggacaaaaaggcagcaagggtgacaagggagaaaatggccctcccggtcccccaggtcttcaaggaccagttggtgcccctggaattgctggaggtgatggtgaaccaggtcctagaggacagcaggggatgtttgggcaaaaaggtgatgagggtgccagaggcttccctggacctcctggtccaataggtcttcagggtctgccaggcccacctggtgaaaaaggtgaaaatggggatgttggtcccatggggccacctggtcctccaggcccaagaggccctcaaggtcccaatggagctgatggaccacaaggacccccagggtctgttggttcagttggtggtgttggagaaaagggtgaacctggagaagcagggaacccagggcctcctggggaagcaggtgtaggcggtcccaaaggagaaagaggagagaaaggggaagctggtccacctggagctgctggacctccaggtgccaaggggccaccaggtgatgatggccctaagggtaacccgggtcctgttggttttcctggagatcctggtcctcctggggaacctggccctgcaggtcaagatggtgttggtggtgacaagggtgaagatggagatcctggtcaaccgggtcctcctggcccatctggtgaggctggcccaccaggtcctcctggaaaacgaggtcctcctggagctgcaggtgcagagggaagacaaggtgaaaaaggtgctaagggggaagcaggtgcagaaggtcctcctggaaaaaccggcccagtcggtcctcagggacctgcaggaaagcctggtccagaaggtcttcggggcatccctggtcctgtgggagaacaaggtctccctggagctgcaggccaagatggaccacctggtcctatgggacctcctggcttacctggtctcaaaggtgaccctggctccaagggtgaaaagggacatcctggtttaattggcctgattggtcctccaggagaacaaggggaaaaaggtgaccgagggctccctggaactcaaggatctccaggagcaaaaggggatgggggaattcctggtcctgctggtcccttaggtccacctggtcctccaggtttaccaggtcctcaaggcccaaagggtaacaaaggctctactggacccgctggccagaaaggtgacagtggtcttccagggcctcctgggtctccaggtccacctggtgaagtcattcagcctttaccaatcttgtcctccaaaaaaacgagaagacatactgaaggcatgcaagcagatgcagatgataatattcttgattactcggatggaatggaagaaatatttggttccctcaattccctgaaacaagacattgagcatatgaaatttccaatgggtactcagaccaatccagcccgaacttgtaaagacctgcaactcagccatcctgacttcccagatggtgaatattggattgatcctaaccaaggttgctcaggagattccttcaaagtttactgtaatttcacatctggtggtgagacttgcatttatccagacaaaaaatctgagggagtaagaatttcatcatggccaaaggagaaaccaggaagttggtttagtgaatttaagaggggaaaactgctttcatacttagatgttgaaggaaattccatcaatatggtgcaaatgacattcctgaaacttctgactgcctctgctcggcaaaatttcacctaccactgtcatcagtcagcagcctggtatgatgtgtcatcaggaagttatgacaaagcacttcgcttcctgggatcaaatgatgaggagatgtcctatgacaataatccttttatcaaaacactgtatgatggttgtgcgtccagaaaaggctatgaaaagactgtcattgaaatcaatacaccaaaaattgatcaagtacctattgttgatgtcatgatcaatgactttggtgatcagaatcagaagttcggatttgaagttggtcctgtttgttttcttggctaagattaagacaaagaacatatcaaatcaacagaaaatataccttggtgccaccaacccattttgtgcca

SEQ ID NO: 1105 - DNA, 5924 bp, Homo sapiens
agaggccctcccgccgcccgcagctccagccgcactgccccgatggctccctacccctgtggctgccacatcctgctgctgctcttctgctgcctggcggctgcccgggccaacctgctgaacctgaactggctttggttcaataatgaggacaccagccatgcagctaccacgatccctgagccccaggggcccctgcctgtgcagcccacagcagataccaccacacacgtgaccccccggaatggttccacagagccagcgacagcccctggcagccctgagccaccctcagagctgctggaagatggccaggacacccccacttctgccgagagcccggacgcgccagaggagaacattgccggtgtcggagccgagatcctgaacgtggccaaaggcatccggagcttcgtccagctgtggaatgacactgtccccactgagagcttggccagggcggaaaccctggtcctggagactcctgtgggcccccttgccctcgctgggccttccagcaccccccaggagaatgggaccactctctggcccagccgtggcattcctagctctccgggcgcccacacaaccgaggctggcaccttgcctgcacccaccccatcgcctccctccctgggcaggccctgggcaccactcacggggccctcagtgccaccaccatcttcagagcgcatcagcgaggaggtggggctgctgcagctccttggggaccccccgccccagcaggtcacccagacggatgaccccgacgtcgggctggcctacgtctttgggccagatgccaacagtggccaagtggcccggtaccacttccccagcctcttcttccgtgacttctcactgctgttccacatccggccagccacagagggcccaggggtgctgttcgccatcacggactcggcgcaggccatggtcttgctgggcgtgaagctctctggggtgcaggacgggcaccaggacatctccctgctctacacagaaccaggtgcaggccagacccacacagccgccagcttccggctccccgccttcgtcggccagtggacacacttagccctcagtgtggcaggtggctttgtggccctctacgtggactgtgaggagttccagagaatgccgcttgctcggtcctcacggggcctggagctggagcctggcgccgggctcttcgtggctcaggcggggggagcggaccctgacaagttccagggggtgatcgctgagctgaaggtgcgcagggacccccaggtgagccccatgcactgcctggacgaggaaggcgatgactcagatggggcatccggagactctggcagcgggctcggggacgcccgggagcttctcagggaggagacgggcgcggccctaaaacccaggctccccgcgccaccccccgtcaccacgccacccttggctggaggcagcagcacggaagattccagaagtgaagaagtcgaggagcagaccacggtggcttcgttaggagctcagacacttcctggctcagattctgtctccacgtgggacgggagtgtccggacccctgggggccgcgtgaaagagggcggcctgaaggggcagaaaggggagccaggtgttccgggcccacctggccgggcaggccccccaggatccccatgcctacctggtcccccgggtctcccgtgcccagtgagtcccctgggtcctgcaggcccagcgttgcaaactgtccccggaccacaaggacccccagggcctccggggagggacggcacccctggaagggacggcgagccgggcgaccccggtgaagacggaaagccgggcgacaccgggccacaaggcttccccgggactccaggggacgtaggtcccaagggcgacaagggagaccctggggttggagagagagggcccccaggaccccaagggcctccagggcccccaggaccctccttcagacacgacaagctgaccttcattgacatggagggatctggcttcgggggcgatctggaggccctgcggggtcctcgaggcttccctggacctcccggaccccccggtgtcccaggcctgcccggcgagccaggccgctttggggtgaacagctccgacgtcccaggacccgccggccttcctggtgtgcctgggcgcgagggtccccccgggtttcctggcctcccgggacccccaggccctccgggaagagaggggcccccaggaaggactgggcagaaaggcagcctgggtgaagcaggcgccccaggacataaggggagcaagggagcccccggtcctgctggtgctcgtggggagagcggcctggcaggagcccccggacctgctggaccaccaggcccccctgggccccctgggcccccaggaccaggactccccgctggatttgatgacatggaaggctccggggggcccttctggtcaacagcccgaagcgctgatgggccacagggacctcccggcctgccgggacttaagggggatcctggcgtgcctgggctgccgggggcgaagggagaagttggagcagatggagtccccgggttccccggcctccctggcagagagggcattgctgggccccaggggccaaagggagacagaggcagccggggagaaaagggagatccagggaaggacggagtcgggcagccgggcctccctggcccccccggacccccgggacctgtggtctacgtgtcggagcaggacggatccgtcctgagcgtgccgggacctgagggccggccgggtttcgcaggctttcccggacctgcaggacccaagggcaacctgggctctaagggcgaacgaggctccccgggacccaagggtgagaagggtgaaccgggcagcatcttcagccccgacggcggtgccctgggccctgcccagaaaggagccaagggagagccgggcttccgaggacccccgggtccatacggacggccggggtacaagggagagattggctttcctggacggccgggtcgccccgggatgaacggattgaaaggagagaaaggggagccgggagatgccagccttggatttggcatgaggggaatgcccggccccccaggacctccagggcccccaggccctccagggactcctgtttacgacagcaatgtgtttgctgagtccagccgccccgggcctccaggattgccagggaatcagggccctccaggacccaagggcgccaaaggagaagtgggcccccccggaccaccagggcagtttccgtttgactttcttcagttggaggctgaaatgaagggggagaagggagaccgaggtgatgcaggacagaaaggcgaaaggggggagcccgggggcggcggtttcttcggctccagcctgcccggcccccccggccccccaggccccccaggcccacgtggctaccctgggattccaggtcccaagggagagagcatccggggccagcccggcccacctggacctcagggaccccccggcatcggctacgaggggcgccagggccctcccggccccccaggccccccagggcccccttcatttcctggccctcacaggcagactatcagcgttcccggccctccgggcccccctgggccccctgggccccctggaaccatgggcgcctcctcaggggtgaggctctgggctacacgccaggccatgctgggccaggtgcacgaggttcccgagggctggctcatcttcgtggccgagcaggaggagctctacgtccgcgtgcagaacgggttccggaaggtccagctggaggcccggacaccactcccacgagggacggacaatgaagtggccgccttgcagccccccgtggtgcagctgcacgacagcaacccctacccgcggcgggagcacccccaccccaccgcgcggccctggcgggcagatgacatcctggccagcccccctcgcctgcccgagccccagccctaccccggagccccgcaccacagctcctacgtgcacctgcggccggcgcgacccacaagcccacccgcccacagccaccgcgacttccagccggtgctccacctggttgcgctcaacagccccctgtcaggcggcatgcggggcatccgcggggccgacttccagtgcttccagcaggcgcgggccgtggggctggcgggcaccttccgcgccttcctgtcctcgcgcctgcaggacctgtacagcatcgtgcgccgtgccgaccgcgcagccgtgcccatcgtcaacctcaaggacgagctgctgtttcccagctgggaggctctgttctcaggctctgagggtccgctgaagcccggggcacgcatcttctcctttgacggcaaggacgtcctgaggcaccccacctggccccagaagagcgtgtggcatggctcggaccccaacgggcgcaggctgaccgagagctactgtgagacgtggcggacggaggctccctcggccacgggccaggcctcctcgctgctggggggcaggctcctggggcagagtgccgcgagctgccatcacgcctacatcgtgctctgcattgagaacagcttcatgactgcctccaagtagccaccgcctggatgcggatggccggagaggaccggcggctcggaggaagcccccaccgtgggcagggagcggccggccagcccctggccccaggacctggctgccatactttcctgtatagttcacgtttcatgtaatcctcaagaaataaaaggaagccaaagagtgtatttttttaaaagtttaaaacagaagcctgatgctgacattcacctgccccaactctcccctgacctgtgagcccagctgggtcaggcagggtgcagtatcatgccctgtgcaacctcttggcctgatcagaccacggctcgatttctccaggatttcctgctttgggaagccgtgctcgccccagcaggtgctgacttcatctcccacctagcagcaccgttctgtgcacaaaacccagacctgttagcagacaggccccgtgaggcaatgggagctgaggccacactcagcacaaggccatctgggctcctccagggtgtgtgctcgccctgcggtagatgggagggaggctcaggtccctggggctagggggagccccttctgctcagctctgggccattctccacagcaaccccaggctgaagcaggttcccaagctcagaggcgcactgtgacccccagctccggcctgtcctccaacaccaagcacagcagcctggggctggcctcccaaatgagccatgagatgatacatccaaagcagacagctccaccctggccgagtccaagctgggagattcaagggacccatgagttggggtctggcagcctcccatccagggcccccatctcatgcccctggctgggacgtggctcagccagcacttgtccagctgagcgccaggatggaacacggccacatcaaagaggctgaggctggcacaggacatgcggtagccagcacacagggcagtgagggagggctgtcatctgtgcactgcccatggacaggctggctccagatgcagggcagtcattggctgtctcctaggaaacccatatccttaccctccttgggactgaaggggaaccccggggtgcccacaggccgccctgcgggtgaacaaagcagccacgaggtgcaacaaggtcctctgtcagtcacagccacccctgagatccggcaacatcaacccgagtcattcgttctgtggagggacaagtggactcagggcagcgccaggctgaccacagcacagccaacacgcacctgcctcaggactgcgacgaaaccggtggggctggttctgtaattgtgtgtgatgtgaagccaattcagacaggcaaataaaagtgaccttttacactga

SEQ ID NO: 1106 - DNA, 6607 bp, Homo sapiens
agctccagccgcactgccccgatggctccctacccctgtggctgccacatcctgctgctgctcttctgctgcctggcggctgcccgggccaacctgctgaacctgaactggctttggttcaataatgaggacaccagccatgcagctaccacgatccctgagccccaggggcccctgcctgtgcagcccacagcagataccaccacacacgtgaccccccggaatggttccacagagccagcgacagcccctggcagccctgagccaccctcagagctgctggaagatggccaggacacccccacttctgccgagagcccggacgcgccagaggagaacattgccggtgtcggagccgagatcctgaacgtggccaaaggcatccggagcttcgtccagctgtggaatgacactgtccccactgagagcttggccagggcggaaaccctggtcctggagactcctgtgggcccccttgccctcgctgggccttccagcaccccccaggagaatgggaccactctctggcccagccgtggcattcctagctctccgggcgcccacacaaccgaggctggcaccttgcctgcacccaccccatcgcctccctccctgggcaggccctgggcaccactcacggggccctcagtgccaccaccatcttcaggtagagcttctctctcctccttgctgggcggggcccctccctggggaagcctgcaggacccagacagccaaggactctcgcccgccgcagccgctcccagccagcagctccaacgccctgacgtccgcctgcgcacgccacttctgcaccccctggtgatgggctccctgggcaagcacgcggccccctccgccttctcctctgggctcccgggcgcactgtctcaggtcgcagtcaccactttaaccagggacagcggtgcttgggtctcccacgtggctaactctgtggggccgggtcttgctaataactctgccctgctcggggctgaccccgaggcccccgccggtcgctgcctgcccctgccaccctccctgccagtctgcggccacctgggcatctcacgcttctggctgcccaaccacctccaccacgagagcggcgagcaggtgcgggccggggcacgggcgtgggggggcctgctgcagacgcactgccaccccttcctcgcctggttcttctgcctgctgctggtccccccatgcggcagcgtcccgccgcccgccccgccaccctgctgccagttctgcgaggccctgcaggatgcgtgttggagccgcctgggcgggggccggctgcccgtcgcctgtgcctcgctcccgacccaggaggatgggtactgtgtgctcattgggccggctgcagagcgcatcagcgaggaggtggggctgctgcagctccttggggaccccccgccccagcaggtcacccagacggatgaccccgacgtcgggctggcctacgtctttgggccagatgccaacagtggccaagtggcccggtaccacttccccagcctcttcttccgtgacttctcactgctgttccacatccggccagccacagagggcccaggggtgctgttcgccatcacggactcggcgcaggccatggtcttgctgggcgtgaagctctctggggtgcaggacgggcaccaggacatctccctgctctacacagaaccaggtgcaggccagacccacacagccgccagcttccggctccccgccttcgtcggccagtggacacacttagccctcagtgtggcaggtggctttgtggccctctacgtggactgtgaggagttccagagaatgccgcttgctcggtcctcacggggcctggagctggagcctggcgccgggctcttcgtggctcaggcggggggagcggaccctgacaagttccagggggtgatcgctgagctgaaggtgcgcagggacccccaggtgagccccatgcactgcctggacgaggaaggcgatgactcagatggggcatccggagactctggcagcgggctcggggacgcccgggagcttctcagggaggagacgggcgcggccctaaaacccaggctccccgcgccaccccccgtcaccacgccacccttggctggaggcagcagcacggaagattccagaagtgaagaagtcgaggagcagaccacggtggcttcgttaggagctcagacacttcctggctcagattctgtctccacgtgggacgggagtgtccggacccctgggggccgcgtgaaagagggcggcctgaaggggcagaaaggggagccaggtgttccgggcccacctggccgggcaggccccccaggatccccatgcctacctggtcccccgggtctcccgtgcccagtgagtcccctgggtcctgcaggcccagcgttgcaaactgtccccggaccacaaggacccccagggcctccggggagggacggcacccctggaagggacggcgagccgggcgaccccggtgaagacggaaagccgggcgacaccgggccacaaggcttccccgggactccaggggacgtaggtcccaagggcgacaagggagaccctggggttggagagagagggcccccaggaccccaagggcctccagggcccccaggaccctccttcagacacgacaagctgaccttcattgacatggagggatctggcttcgggggcgatctggaggccctgcggggtcctcgaggcttccctggacctcccggaccccccggtgtcccaggcctgcccggcgagccaggccgctttggggtgaacagctccgacgtcccaggacccgccggccttcctggtgtgcctgggcgcgagggtccccccgggtttcctggcctcccgggacccccaggccctccgggaagagaggggcccccaggaaggactgggcagaaaggcagcctgggtgaagcaggcgccccaggacataaggggagcaagggagcccccggtcctgctggtgctcgtggggagagcggcctggcaggagcccccggacctgctggaccaccaggcccccctgggccccctgggcccccaggaccaggactccccgctggatttgatgacatggaaggctccggggggcccttctggtcaacagcccgaagcgctgatgggccacagggacctcccggcctgccgggacttaagggggatcctggcgtgcctgggctgccgggggcgaagggagaagttggagcagatggagtccccgggttccccggcctccctggcagagagggcattgctgggccccaggggccaaagggagacagaggcagccggggagaaaagggagatccagggaaggacggagtcgggcagccgggcctccctggcccccccggacccccgggacctgtggtctacgtgtcggagcaggacggatccgtcctgagcgtgccgggacctgagggccggccgggtttcgcaggctttcccggacctgcaggacccaagggcaacctgggctctaagggcgaacgaggctccccgggacccaagggtgagaagggtgaaccgggcagcatcttcagccccgacggcggtgccctgggccctgcccagaaaggagccaagggagagccgggcttccgaggacccccgggtccatacggacggccggggtacaagggagagattggctttcctggacggccgggtcgccccgggatgaacggattgaaaggagagaaaggggagccgggagatgccagccttggatttggcatgaggggaatgcccggccccccaggacctccagggcccccaggccctccagggactcctgtttacgacagcaatgtgtttgctgagtccagccgccccgggcctccaggattgccagggaatcagggccctccaggacccaagggcgccaaaggagaagtgggcccccccggaccaccagggcagtttccgtttgactttcttcagttggaggctgaaatgaagggggagaagggagaccgaggtgatgcaggacagaaaggcgaaaggggggagcccgggggcggcggtttcttcggctccagcctgcccggcccccccggccccccaggccccccaggcccacgtggctaccctgggattccaggtcccaagggagagagcatccggggccagcccggcccacctggacctcagggaccccccggcatcggctacgaggggcgccagggccctcccggccccccaggccccccagggcccccttcatttcctggccctcacaggcagactatcagcgttcccggccctccgggcccccctgggccccctgggccccctggaaccatgggcgcctcctcaggggtgaggctctgggctacacgccaggccatgctgggccaggtgcacgaggttcccgagggctggctcatcttcgtggccgagcaggaggagctctacgtccgcgtgcagaacgggttccggaaggtccagctggaggcccggacaccactcccacgagggacggacaatgaagtggccgccttgcagccccccgtggtgcagctgcacgacagcaacccctacccgcggcgggagcacccccaccccaccgcgcggccctggcgggcagatgacatcctggccagcccccctcgcctgcccgagccccagccctaccccggagccccgcaccacagctcctacgtgcacctgcggccggcgcgacccacaagcccacccgcccacagccaccgcgacttccagccggtgctccacctggttgcgctcaacagccccctgtcaggcggcatgcggggcatccgcggggccgacttccagtgcttccagcaggcgcgggccgtggggctggcgggcaccttccgcgccttcctgtcctcgcgcctgcaggacctgtacagcatcgtgcgccgtgccgaccgcgcagccgtgcccatcgtcaacctcaaggacgagctgctgtttcccagctgggaggctctgttctcaggctctgagggtccgctgaagcccggggcacgcatcttctcctttgacggcaaggacgtcctgaggcaccccacctggccccagaagagcgtgtggcatggctcggaccccaacgggcgcaggctgaccgagagctactgtgagacgtggcggacggaggctccctcggccacgggccaggcctcctcgctgctggggggcaggctcctggggcagagtgccgcgagctgccatcacgcctacatcgtgctctgcattgagaacagcttcatgactgcctccaagtagccaccgcctggatgcggatggccggagaggaccggcggctcggaggaagcccccaccgtgggcagggagcggccggccagcccctggccccaggacctggctgccatactttcctgtatagttcacgtttcatgtaatcctcaagaaataaaaggaagccaaagagtgtatttttttaaaagtttaaaacagaagcctgatgctgacattcacctgccccaactctcccctgacctgtgagcccagctgggtcaggcagggtgcagtatcatgccctgtgcaacctcttggcctgatcagaccacggctcgatttctccaggatttcctgctttgggaagccgtgctcgccccagcaggtgctgacttcatctcccacctagcagcaccgttctgtgcacaaaacccagacctgttagcagacaggccccgtgaggcaatgggagctgaggccacactcagcacaaggccatctgggctcctccagggtgtgtgctcgccctgcggtagatgggagggaggctcaggtccctggggctagggggagccccttctgctcagctctgggccattctccacagcaaccccaggctgaagcaggttcccaagctcagaggcgcactgtgacccccagctccggcctgtcctccaacaccaagcacagcagcctggggctggcctcccaaatgagccatgagatgatacatccaaagcagacagctccaccctggccgagtccaagctgggagattcaagggacccatgagttggggtctggcagcctcccatccagggcccccatctcatgcccctggctgggacgtggctcagccagcacttgtccagctgagcgccaggatggaacacggccacatcaaagaggctgaggctggcacaggacatgcggtagccagcacacagggcagtgagggagggctgtcatctgtgcactgcccatggacaggctggctccagatgcagggcagtcattggctgtctcctaggaaacccatatccttaccctccttgggactgaaggggaaccccggggtgcccacaggccgccctgcgggtgaacaaagcagccacgaggtgcaacaaggtcctctgtcagtcacagccacccctgagatccggcaacatcaacccgagtcattcgttctgtggagggacaagtggactcagggcagcgccaggctgaccacagcacagccaacacgcacctgcctcaggactgcgacgaaaccggtggggctggttctgtaattgtgtgtgatgtgaagccaattcagacaggcaaataaaagtgaccttttacactg

SEQ ID NO: 1107 - DNA, 5436 bp, Homo sapiens
ctcccagcggcggcggctgcagcgcggcggtccgagcgggtgcaccgcggcggaggaggcagcatcccgcggcgctgacggtcctggggagagcatggcgccgaggtgcccctggccatggccgcggcggcggcgcctcctggacgtgctcgcgcccctggtcctgctgctcggggtccgcgcggcctccgcggagccagagcgcatcagcgaggaggtggggctgctgcagctccttggggaccccccgccccagcaggtcacccagacggatgaccccgacgtcgggctggcctacgtctttgggccagatgccaacagtggccaagtggcccggtaccacttccccagcctcttcttccgtgacttctcactgctgttccacatccggccagccacagagggcccaggggtgctgttcgccatcacggactcggcgcaggccatggtcttgctgggcgtgaagctctctggggtgcaggacgggcaccaggacatctccctgctctacacagaaccaggtgcaggccagacccacacagccgccagcttccggctccccgccttcgtcggccagtggacacacttagccctcagtgtggcaggtggctttgtggccctctacgtggactgtgaggagttccagagaatgccgcttgctcggtcctcacggggcctggagctggagcctggcgccgggctcttcgtggctcaggcggggggagcggaccctgacaagttccagggggtgatcgctgagctgaaggtgcgcagggacccccaggtgagccccatgcactgcctggacgaggaaggcgatgactcagatggggcatccggagactctggcagcgggctcggggacgcccgggagcttctcagggaggagacgggcgcggccctaaaacccaggctccccgcgccaccccccgtcaccacgccacccttggctggaggcagcagcacggaagattccagaagtgaagaagtcgaggagcagaccacggtggcttcgttaggagctcagacacttcctggctcagattctgtctccacgtgggacgggagtgtccggacccctgggggccgcgtgaaagagggcggcctgaaggggcagaaaggggagccaggtgttccgggcccacctggccgggcaggccccccaggatccccatgcctacctggtcccccgggtctcccgtgcccagtgagtcccctgggtcctgcaggcccagcgttgcaaactgtccccggaccacaaggacccccagggcctccggggagggacggcacccctggaagggacggcgagccgggcgaccccggtgaagacggaaagccgggcgacaccgggccacaaggcttccccgggactccaggggacgtaggtcccaagggcgacaagggagaccctggggttggagagagagggcccccaggaccccaagggcctccagggcccccaggaccctccttcagacacgacaagctgaccttcattgacatggagggatctggcttcgggggcgatctggaggccctgcggggtcctcgaggcttccctggacctcccggaccccccggtgtcccaggcctgcccggcgagccaggccgctttggggtgaacagctccgacgtcccaggacccgccggccttcctggtgtgcctgggcgcgagggtccccccgggtttcctggcctcccgggacccccaggccctccgggaagagaggggcccccaggaaggactgggcagaaaggcagcctgggtgaagcaggcgccccaggacataaggggagcaagggagcccccggtcctgctggtgctcgtggggagagcggcctggcaggagcccccggacctgctggaccaccaggcccccctgggccccctgggcccccaggaccaggactccccgctggatttgatgacatggaaggctccggggggcccttctggtcaacagcccgaagcgctgatgggccacagggacctcccggcctgccgggacttaagggggatcctggcgtgcctgggctgccgggggcgaagggagaagttggagcagatggagtccccgggttccccggcctccctggcagagagggcattgctgggccccaggggccaaagggagacagaggcagccggggagaaaagggagatccagggaaggacggagtcgggcagccgggcctccctggcccccccggacccccgggacctgtggtctacgtgtcggagcaggacggatccgtcctgagcgtgccgggacctgagggccggccgggtttcgcaggctttcccggacctgcaggacccaagggcaacctgggctctaagggcgaacgaggctccccgggacccaagggtgagaagggtgaaccgggcagcatcttcagccccgacggcggtgccctgggccctgcccagaaaggagccaagggagagccgggcttccgaggacccccgggtccatacggacggccggggtacaagggagagattggctttcctggacggccgggtcgccccgggatgaacggattgaaaggagagaaaggggagccgggagatgccagccttggatttggcatgaggggaatgcccggccccccaggacctccagggcccccaggccctccagggactcctgtttacgacagcaatgtgtttgctgagtccagccgccccgggcctccaggattgccagggaatcagggccctccaggacccaagggcgccaaaggagaagtgggcccccccggaccaccagggcagtttccgtttgactttcttcagttggaggctgaaatgaagggggagaagggagaccgaggtgatgcaggacagaaaggcgaaaggggggagcccgggggcggcggtttcttcggctccagcctgcccggcccccccggccccccaggccccccaggcccacgtggctaccctgggattccaggtcccaagggagagagcatccggggccagcccggcccacctggacctcagggaccccccggcatcggctacgaggggcgccagggccctcccggccccccaggccccccagggcccccttcatttcctggccctcacaggcagactatcagcgttcccggccctccgggcccccctgggccccctgggccccctggaaccatgggcgcctcctcaggggtgaggctctgggctacacgccaggccatgctgggccaggtgcacgaggttcccgagggctggctcatcttcgtggccgagcaggaggagctctacgtccgcgtgcagaacgggttccggaaggtccagctggaggcccggacaccactcccacgagggacggacaatgaagtggccgccttgcagccccccgtggtgcagctgcacgacagcaacccctacccgcggcgggagcacccccaccccaccgcgcggccctggcgggcagatgacatcctggccagcccccctcgcctgcccgagccccagccctaccccggagccccgcaccacagctcctacgtgcacctgcggccggcgcgacccacaagcccacccgcccacagccaccgcgacttccagccggtgctccacctggttgcgctcaacagccccctgtcaggcggcatgcggggcatccgcggggccgacttccagtgcttccagcaggcgcgggccgtggggctggcgggcaccttccgcgccttcctgtcctcgcgcctgcaggacctgtacagcatcgtgcgccgtgccgaccgcgcagccgtgcccatcgtcaacctcaaggacgagctgctgtttcccagctgggaggctctgttctcaggctctgagggtccgctgaagcccggggcacgcatcttctcctttgacggcaaggacgtcctgaggcaccccacctggccccagaagagcgtgtggcatggctcggaccccaacgggcgcaggctgaccgagagctactgtgagacgtggcggacggaggctccctcggccacgggccaggcctcctcgctgctggggggcaggctcctggggcagagtgccgcgagctgccatcacgcctacatcgtgctctgcattgagaacagcttcatgactgcctccaagtagccaccgcctggatgcggatggccggagaggaccggcggctcggaggaagcccccaccgtgggcagggagcggccggccagcccctggccccaggacctggctgccatactttcctgtatagttcacgtttcatgtaatcctcaagaaataaaaggaagccaaagagtgtatttttttaaaagtttaaaacagaagcctgatgctgacattcacctgccccaactctcccctgacctgtgagcccagctgggtcaggcagggtgcagtatcatgccctgtgcaacctcttggcctgatcagaccacggctcgatttctccaggatttcctgctttgggaagccgtgctcgccccagcaggtgctgacttcatctcccacctagcagcaccgttctgtgcacaaaacccagacctgttagcagacaggccccgtgaggcaatgggagctgaggccacactcagcacaaggccatctgggctcctccagggtgtgtgctcgccctgcggtagatgggagggaggctcaggtccctggggctagggggagccccttctgctcagctctgggccattctccacagcaaccccaggctgaagcaggttcccaagctcagaggcgcactgtgacccccagctccggcctgtcctccaacaccaagcacagcagcctggggctggcctcccaaatgagccatgagatgatacatccaaagcagacagctccaccctggccgagtccaagctgggagattcaagggacccatgagttggggtctggcagcctcccatccagggcccccatctcatgcccctggctgggacgtggctcagccagcacttgtccagctgagcgccaggatggaacacggccacatcaaagaggctgaggctggcacaggacatgcggtagccagcacacagggcagtgagggagggctgtcatctgtgcactgcccatggacaggctggctccagatgcagggcagtcattggctgtctcctaggaaacccatatccttaccctccttgggactgaaggggaaccccggggtgcccacaggccgccctgcgggtgaacaaagcagccacgaggtgcaacaaggtcctctgtcagtcacagccacccctgagatccggcaacatcaacccgagtcattcgttctgtggagggacaagtggactcagggcagcgccaggctgaccacagcacagccaacacgcacctgcctcaggactgcgacgaaaccggtggggctggttctgtaattgtgtgtgatgtgaagccaattcagacaggcaaataaaagtgaccttttacactga

SEQ ID NO: 1108 - DNA, 5399 bp, Homo sapiens
cgggtgcaccgcggcggaggaggcagcatcccgcggcgctgacggtcctggggagagcatggcgccgaggtgcccctggccatggccgcggcggcggcgcctcctggacgtgctcgcgcccctggtcctgctgctcggggtccgcgcggcctccgcggagccagagcgcatcagcgaggaggtggggctgctgcagctccttggggaccccccgccccagcaggtcacccagacggatgaccccgacgtcgggctggcctacgtctttgggccagatgccaacagtggccaagtggcccggtaccacttccccagcctcttcttccgtgacttctcactgctgttccacatccggccagccacagagggcccaggggtgctgttcgccatcacggactcggcgcaggccatggtcttgctgggcgtgaagctctctggggtgcaggacgggcaccaggacatctccctgctctacacagaaccaggtgcaggccagacccacacagccgccagcttccggctccccgccttcgtcggccagtggacacacttagccctcagtgtggcaggtggctttgtggccctctacgtggactgtgaggagttccagagaatgccgcttgctcggtcctcacggggcctggagctggagcctggcgccgggctcttcgtggctcaggcggggggagcggaccctgacaagttccagggggtgatcgctgagctgaaggtgcgcagggacccccaggtgagccccatgcactgcctggacgaggaaggcgatgactcagatggggcatccggagactctggcagcgggctcggggacgcccgggagcttctcagggaggagacgggcgcggccctaaaacccaggctccccgcgccaccccccgtcaccacgccacccttggctggaggcagcagcacggaagattccagaagtgaagaagtcgaggagcagaccacggtggcttcgttaggagctcagacacttcctggctcagattctgtctccacgtgggacgggagtgtccggacccctgggggccgcgtgaaagagggcggcctgaaggggcagaaaggggagccaggtgttccgggcccacctggccgggcaggccccccaggatccccatgcctacctggtcccccgggtctcccgtgcccagtgagtcccctgggtcctgcaggcccagcgttgcaaactgtccccggaccacaaggacccccagggcctccggggagggacggcacccctggaagggacggcgagccggtgagtcctcacgtccccccgagtccgggcgacaccgggccacaaggcttccccgggactccaggggacgtaggtcccaagggcgacaagggagaccctggggttggagagagagggcccccaggaccccaagggcctccagggcccccaggaccctccttcagacacgacaagctgaccttcattgacatggagggatctggcttcgggggcgatctggaggccctgcggggtcctcgaggcttccctggacctcccggaccccccggtgtcccaggcctgcccggcgagccaggccgctttggggtgaacagctccgacgtcccaggacccgccggccttcctggtgtgcctgggcgcgagggtccccccgggtttcctggcctcccgggacccccaggccctccgggaagagaggggcccccaggaaggactgggcagaaaggcagcctgcaaggagccggggccccaggcgtgcaggggagcaagggagcccccggtcctgctggtgctcgtggggagagcggcctggcaggagcccccggacctgctggaccaccaggcccccctgggccccctgggcccccaggaccaggactccccgctggatttgatgacatggaaggctccggggggcccttctggtcaacagcccgaagcgctgatgggccacaggagccaccggccttgcatgggatcggaggggatcctggcgtgcctgggctgccgggggcgaagggagaagttggagcagatggagtccccgggttccccggcctccctggcagagagggcattgctgggccccaggggccaaagggagacagaggcagccggggagaaaagggagatccagggaaggacggagtcgggcagccgggcctccctggcccccccggacccccgggacctgtggtctacgtgtcggagcaggacggatccgtcctgagcgtgccgggacctgagggccggccgggtttcgcaggctttcccggacctgcaggacccaagggcaacctgggctctaagggcgaacgaggctccccgggacccaagggtgagaagggtgaaccgggcagcatcttcagccccgacggcggtgccctgggccctgcccagaaaggagccaagggagagccgggcttccgaggacccccgggtccatacggacggccggggtacaagggagagattggctttcctggacggccgggtcgccccgggatgaacggattgaaaggagagaaaggggagccgggagatgccagccttggatttggcatgaggggaatgcccggccccccaggacctccagggcccccaggccctccagggactcctgtttacgacagcaatgtgtttgctgagtccagccgccccgggcctccaggattgccagggaatcagggccctccaggacccaagggcgccaaaggagaagtgggcccccccggaccaccagggcagtttccgtttgactttcttcagttggaggctgaaatgaagggggagaagggagaccgaggtgatgcaggacagaaaggcgaaaggggggagcccgggggcggcggtttcttcggctccagcctgcccggcccccccggccccccaggccccccaggcccacgtggctaccctgggattccaggtcccaagggagagagcatccggggccagcccggcccacctggacctcagggaccccccggcatcggctacgaggggcgccagggccctcccggccccccaggccccccagggcccccttcatttcctggccctcacaggcagactatcagcgttcccggccctccgggcccccctgggccccctgggccccctggaaccatgggcgcctcctcaggggtgaggctctgggctacacgccaggccatgctgggccaggtgcacgaggttcccgagggctggctcatcttcgtggccgagcaggaggagctctacgtccgcgtgcagaacgggttccggaaggtccagctggaggcccggacaccactcccacgagggacggacaatgaagtggccgccttgcagccccccgtggtgcagctgcacgacagcaacccctacccgcggcgggagcacccccaccccaccgcgcggccctggcgggcagatgacatcctggccagcccccctcgcctgcccgagccccagccctaccccggagccccgcaccacagctcctacgtgcacctgcggccggcgcgacccacaagcccacccgcccacagccaccgcgacttccagccggtgctccacctggttgcgctcaacagccccctgtcaggcggcatgcggggcatccgcggggccgacttccagtgcttccagcaggcgcgggccgtggggctggcgggcaccttccgcgccttcctgtcctcgcgcctgcaggacctgtacagcatcgtgcgccgtgccgaccgcgcagccgtgcccatcgtcaacctcaaggacgagctgctgtttcccagctgggaggctctgttctcaggctctgagggtccgctgaagcccggggcacgcatcttctcctttgacggcaaggacgtcctgaggcaccccacctggccccagaagagcgtgtggcatggctcggaccccaacgggcgcaggctgaccgagagctactgtgagacgtggcggacggaggctccctcggccacgggccaggcctcctcgctgctggggggcaggctcctggggcagagtgccgcgagctgccatcacgcctacatcgtgctctgcattgagaacagcttcatgactgcctccaagtagccaccgcctggatgcggatggccggagaggaccggcggctcggaggaagcccccaccgtgggcagggagcggccggccagcccctggccccaggacctggctgccatactttcctgtatagttcacgtttcatgtaatcctcaagaaataaaaggaagccaaagagtgtatttttttaaaagtttaaaacagaagcctgatgctgacattcacctgccccaactctcccctgacctgtgagcccagctgggtcaggcagggtgcagtatcatgccctgtgcaacctcttggcctgatcagaccacggctcgatttctccaggatttcctgctttgggaagccgtgctcgccccagcaggtgctgacttcatctcccacctagcagcaccgttctgtgcacaaaacccagacctgttagcagacaggccccgtgaggcaatgggagctgaggccacactcagcacaaggccatctgggctcctccagggtgtgtgctcgccctgcggtagatgggagggaggctcaggtccctggggctagggggagccccttctgctcagctctgggccattctccacagcaaccccaggctgaagcaggttcccaagctcagaggcgcactgtgacccccagctccggcctgtcctccaacaccaagcacagcagcctggggctggcctcccaaatgagccatgagatgatacatccaaagcagacagctccaccctggccgagtccaagctgggagattcaagggacccatgagttggggtctggcagcctcccatccagggcccccatctcatgcccctggctgggacgtggctcagccagcacttgtccagctgagcgccaggatggaacacggccacatcaaagaggctgaggctggcacaggacatgcggtagccagcacacagggcagtgagggagggctgtcatctgtgcactgcccatggacaggctggctccagatgcagggcagtcattggctgtctcctaggaaacccatatccttaccctccttgggactgaaggggaaccccggggtgcccacaggccgccctgcgggtgaacaaagcagccacgaggtgcaacaaggtcctctgtcagtcacagccacccctgagatccggcaacatcaacccgagtcattcgttctgtggagggacaagtggactcagggcagcgccaggctgaccacagcacagccaacacgcacctgcctcaggactgcgacgaaaccggtggggctggttctgtaattgtgtgtgatgtgaagccaattcagacaggcaaataaaagtgaccttttacactg

SEQ ID NO: 1109 - DNA, 6586 bp, Homo sapiens
atggctccctacccctgtggctgccacatcctgctgctgctcttctgctgcctggcggctgcccgggccaacctgctgaacctgaactggctttggttcaataatgaggacaccagccatgcagctaccacgatccctgagccccaggggcccctgcctgtgcagcccacagcagataccaccacacacgtgaccccccggaatggttccacagagccagcgacagcccctggcagccctgagccaccctcagagctgctggaagatggccaggacacccccacttctgccgagagcccggacgcgccagaggagaacattgccggtgtcggagccgagatcctgaacgtggccaaaggcatccggagcttcgtccagctgtggaatgacactgtccccactgagagcttggccagggcggaaaccctggtcctggagactcctgtgggcccccttgccctcgctgggccttccagcaccccccaggagaatgggaccactctctggcccagccgtggcattcctagctctccgggcgcccacacaaccgaggctggcaccttgcctgcacccaccccatcgcctccctccctgggcaggccctgggcaccactcacggggccctcagtgccaccaccatcttcaggtagagcttctctctcctccttgctgggcggggcccctccctggggaagcctgcaggacccagacagccaaggactctcgcccgccgcagccgctcccagccagcagctccaacgccctgacgtccgcctgcgcacgccacttctgcaccccctggtgatgggctccctgggcaagcacgcggccccctccgccttctcctctgggctcccgggcgcactgtctcaggtcgcagtcaccactttaaccagggacagcggtgcttgggtctcccacgtggctaactctgtggggccgggtcttgctaataactctgccctgctcggggctgaccccgaggcccccgccggtcgctgcctgcccctgccaccctccctgccagtctgcggccacctgggcatctcacgcttctggctgcccaaccacctccaccacgagagcggcgagcaggtgcgggccggggcacgggcgtgggggggcctgctgcagacgcactgccaccccttcctcgcctggttcttctgcctgctgctggtccccccatgcggcagcgtcccgccgcccgccccgccaccctgctgccagttctgcgaggccctgcaggatgcgtgttggagccgcctgggcgggggccggctgcccgtcgcctgtgcctcgctcccgacccaggaggatgggtactgtgtgctcattgggccggctgcagagcgcatcagcgaggaggtggggctgctgcagctccttggggaccccccgccccagcaggtcacccagacggatgaccccgacgtcgggctggcctacgtctttgggccagatgccaacagtggccaagtggcccggtaccacttccccagcctcttcttccgtgacttctcactgctgttccacatccggccagccacagagggcccaggggtgctgttcgccatcacggactcggcgcaggccatggtcttgctgggcgtgaagctctctggggtgcaggacgggcaccaggacatctccctgctctacacagaaccaggtgcaggccagacccacacagccgccagcttccggctccccgccttcgtcggccagtggacacacttagccctcagtgtggcaggtggctttgtggccctctacgtggactgtgaggagttccagagaatgccgcttgctcggtcctcacggggcctggagctggagcctggcgccgggctcttcgtggctcaggcggggggagcggaccctgacaagttccagggggtgatcgctgagctgaaggtgcgcagggacccccaggtgagccccatgcactgcctggacgaggaaggcgatgactcagatggggcatccggagactctggcagcgggctcggggacgcccgggagcttctcagggaggagacgggcgcggccctaaaacccaggctccccgcgccaccccccgtcaccacgccacccttggctggaggcagcagcacggaagattccagaagtgaagaagtcgaggagcagaccacggtggcttcgttaggagctcagacacttcctggctcagattctgtctccacgtgggacgggagtgtccggacccctgggggccgcgtgaaagagggcggcctgaaggggcagaaaggggagccaggtgttccgggcccacctggccgggcaggccccccaggatccccatgcctacctggtcccccgggtctcccgtgcccagtgagtcccctgggtcctgcaggcccagcgttgcaaactgtccccggaccacaaggacccccagggcctccggggagggacggcacccctggaagggacggcgagccggtgagtcctcacgtccccccgagtccgggcgacaccgggccacaaggcttccccgggactccaggggacgtaggtcccaagggcgacaagggagaccctggggttggagagagagggcccccaggaccccaagggcctccagggcccccaggaccctccttcagacacgacaagctgaccttcattgacatggagggatctggcttcgggggcgatctggaggccctgcggggtcctcgaggcttccctggacctcccggaccccccggtgtcccaggcctgcccggcgagccaggccgctttggggtgaacagctccgacgtcccaggacccgccggccttcctggtgtgcctgggcgcgagggtccccccgggtttcctggcctcccgggacccccaggccctccgggaagagaggggcccccaggaaggactgggcagaaaggcagcctgcaaggagccggggccccaggcgtgcaggggagcaagggagcccccggtcctgctggtgctcgtggggagagcggcctggcaggagcccccggacctgctggaccaccaggcccccctgggccccctgggcccccaggaccaggactccccgctggatttgatgacatggaaggctccggggggcccttctggtcaacagcccgaagcgctgatgggccacagggacctcccggcctgccgggacttaagggggatcctggcgtgcctgggctgccgggggcgaagggagaagttggagcagatggagtccccgggttccccggcctccctggcagagagggcattgctgggccccaggggccaaagggagacagaggcagccggggagaaaagggagatccagggaaggacggagtcgggcagccgggcctccctggcccccccggacccccgggacctgtggtctacgtgtcggagcaggacggatccgtcctgagcgtgccgggacctgagggccggccgggtttcgcaggctttcccggacctgcaggacccaagggcaacctgggctctaagggcgaacgaggctccccgggacccaagggtgagaagggtgaaccgggcagcatcttcagccccgacggcggtgccctgggccctgcccagaaaggagccaagggagagccgggcttccgaggacccccgggtccatacggacggccggggtacaagggagagattggctttcctggacggccgggtcgccccgggatgaacggattgaaaggagagaaaggggagccgggagatgccagccttggatttggcatgaggggaatgcccggccccccaggacctccagggcccccaggccctccagggactcctgtttacgacagcaatgtgtttgctgagtccagccgccccgggcctccaggattgccagggaatcagggccctccaggacccaagggcgccaaaggagaagtgggcccccccggaccaccagggcagtttccgtttgactttcttcagttggaggctgaaatgaagggggagaagggagaccgaggtgatgcaggacagaaaggcgaaaggggggagcccgggggcggcggtttcttcggctccagcctgcccggcccccccggccccccaggccccccaggcccacgtggctaccctgggattccaggtcccaagggagagagcatccggggccagcccggcccacctggacctcagggaccccccggcatcggctacgaggggcgccagggccctcccggccccccaggccccccagggcccccttcatttcctggccctcacaggcagactatcagcgttcccggccctccgggcccccctgggccccctgggccccctggaaccatgggcgcctcctcaggggtgaggctctgggctacacgccaggccatgctgggccaggtgcacgaggttcccgagggctggctcatcttcgtggccgagcaggaggagctctacgtccgcgtgcagaacgggttccggaaggtccagctggaggcccggacaccactcccacgagggacggacaatgaagtggccgccttgcagccccccgtggtgcagctgcacgacagcaacccctacccgcggcgggagcacccccaccccaccgcgcggccctggcgggcagatgacatcctggccagcccccctcgcctgcccgagccccagccctaccccggagccccgcaccacagctcctacgtgcacctgcggccggcgcgacccacaagcccacccgcccacagccaccgcgacttccagccggtgctccacctggttgcgctcaacagccccctgtcaggcggcatgcggggcatccgcggggccgacttccagtgcttccagcaggcgcgggccgtggggctggcgggcaccttccgcgccttcctgtcctcgcgcctgcaggacctgtacagcatcgtgcgccgtgccgaccgcgcagccgtgcccatcgtcaacctcaaggacgagctgctgtttcccagctgggaggctctgttctcaggctctgagggtccgctgaagcccggggcacgcatcttctcctttgacggcaaggacgtcctgaggcaccccacctggccccagaagagcgtgtggcatggctcggaccccaacgggcgcaggctgaccgagagctactgtgagacgtggcggacggaggctccctcggccacgggccaggcctcctcgctgctggggggcaggctcctggggcagagtgccgcgagctgccatcacgcctacatcgtgctctgcattgagaacagcttcatgactgcctccaagtagccaccgcctggatgcggatggccggagaggaccggcggctcggaggaagcccccaccgtgggcagggagcggccggccagcccctggccccaggacctggctgccatactttcctgtatagttcacgtttcatgtaatcctcaagaaataaaaggaagccaaagagtgtatttttttaaaagtttaaaacagaagcctgatgctgacattcacctgccccaactctcccctgacctgtgagcccagctgggtcaggcagggtgcagtatcatgccctgtgcaacctcttggcctgatcagaccacggctcgatttctccaggatttcctgctttgggaagccgtgctcgccccagcaggtgctgacttcatctcccacctagcagcaccgttctgtgcacaaaacccagacctgttagcagacaggccccgtgaggcaatgggagctgaggccacactcagcacaaggccatctgggctcctccagggtgtgtgctcgccctgcggtagatgggagggaggctcaggtccctggggctagggggagccccttctgctcagctctgggccattctccacagcaaccccaggctgaagcaggttcccaagctcagaggcgcactgtgacccccagctccggcctgtcctccaacaccaagcacagcagcctggggctggcctcccaaatgagccatgagatgatacatccaaagcagacagctccaccctggccgagtccaagctgggagattcaagggacccatgagttggggtctggcagcctcccatccagggcccccatctcatgcccctggctgggacgtggctcagccagcacttgtccagctgagcgccaggatggaacacggccacatcaaagaggctgaggctggcacaggacatgcggtagccagcacacagggcagtgagggagggctgtcatctgtgcactgcccatggacaggctggctccagatgcagggcagtcattggctgtctcctaggaaacccatatccttaccctccttgggactgaaggggaaccccggggtgcccacaggccgccctgcgggtgaacaaagcagccacgaggtgcaacaaggtcctctgtcagtcacagccacccctgagatccggcaacatcaacccgagtcattcgttctgtggagggacaagtggactcagggcagcgccaggctgaccacagcacagccaacacgcacctgcctcaggactgcgacgaaaccggtggggctggttctgtaattgtgtgtgatgtgaagccaattcagacaggcaaataaaagtgaccttttacactg

SEQ ID NO: 1110 - DNA, 3061 bp, Homo sapiens
agaggtgcgcgctgcgcgtgggatcagcccggcgccgacgggtggctccgaggagctcgctccttcctcgcccccgccccctcgccgcgcggggccagcccggccgctcctcccctgggtgggtccctgctccttttctggcagggtctatttgcatagaggaaactgcccaaagtggccgctgtggaggagctggctgcggcgaagggggcgtgcgcggcgatccgctgctacccggaggctaacccccgcgcccggcggacctcgtgcctcgggctgtcccgcctgctcctctcgcacccagcctctgccccagcagcaccgccccctcggagagtccacgcgcgacgaacgcgccatgggcccaggcgagcgcgccggtggcggcggcgacgcggggaagggcaatgcggcgggcggcggcggcggagggcgctcggcgacgacggccgggtcccgggcggtgagcgcgctgtgcctgctgctctccgtgggctcggcggctgcctgcctgctgctgggtgtccaggcggccgcgctgcagggccgggtggcggcgctcgaggaggagcgggagctgctgcggcgcgcggggccgccaggcgccctggacgcctgggccgagccgcacctggagcgcctgctgcgggagaagttggacggactagcgaagatccggactgctcgggaagctccatccgaatgtgtctgccccccagggccccctggacggcgcggcaagcctgggagaagaggcgaccctggtcctccagggcaatcaggacgagatggctacccgggacccctgggtttggatggcaagcccggacttccaggcccgaaaggggaaaagggtgcaccaggagactttggcccccggggagaccaaggacaagatggagctgctgggcctccggggccccctggacctcctggggcccggggccctcctggcgacactgggaaagatggccccaggggagcacaaggcccagcgggccccaaaggagagcccggacaagacggcgagatgggcccaaagggacccccagggcccaagggtgagcctggagtacctggaaagaagggcgacgatgggacaccaagccagcctggaccaccagggcccaagggcgagccagggagcatggggcctcggggagagaacggtgtggacggtgccccaggaccgaagggggagcctggccaccgaggcacggatggagctgcagggccccggggtgccccaggcctcaagggcgagcagggagacacagtggtgatcgactatgatggcaggatcttggatgccctcaaggggcctcccggaccacaggggcccccagggccaccagggatccctggagccaagggcgagcttggattgcccggtgccccaggaatcgatggagagaagggccccaaaggacagaaaggagacccaggagagcctgggccagcaggactcaaaggggaagcaggcgagatgggcttgtccggcctcccgggcgctgacggcctcaagggggagaagggggagtcggcgtctgacagcctacaggagagcctggctcagctcatagtggagccagggccccctggcccccctggccccccaggcccgatgggcctccagggaatccagggtcccaagggcttggatggagcaaagggagagaagggtgcgtcgggtgagagaggccccagcggcctgcctgggccagttggcccaccgggccttattgggctgccaggaaccaaaggagagaagggcagacccggggagccaggactagatggtttccctggaccccgaggagagaaaggtgatcggagcgagcgtggagagaagggagaacgaggggtccccggccggaaaggagtgaagggccagaagggcgagccgggaccaccaggcctggaccagccgtgtcccgtgggccccgacgggctgcctgtgcctggctgctggcataagtgacccacaggcccagctcacacctgtacagatccgtgtggacatttttaatttttgtaaaaacaaaacagtaatatattgatcttttttcatggaatgcgctacctgtggccttttaacattcaagagtatgcccacccagccccaaagccaccggcatgtgaagctgccggaaagtggacaggccagaccagggagatgtgtacctgaggggcacccttgggcctgggctttcccaggaaggagatgaaggtagaagcacctggctcgggcaaggctagaaagatgctacgttgggccttcagtcacctgatcagcagagagactctcagctgtggtactgccctgtaagaacctgcccccgcaaaactctggagtccctgggacacaccctatccaagaagacccaggggtggaacagcggctgctgttgctcctggcctcatcagcctccaaactcaaccacaaccagctgcctctgcagttggacaagacttggcccccggacaagactcgcccagcacttgcggctgggcccggggagcagtgagtggaaatcccccacgagggtctagctctaccacattcaggaggcctcaggaggccagcctgccatgagagcacatgtcctctggccaggagtagtggctgagctctgtgatcgctgtgatgtggacccagctccagggagcagagtgtcgaggatggaggggcccagcctggactgactgctacttcctgtctctgtttccattatcacccagagagggacaagataggacatggcctggaccagggaggcaggcctcccactcagagtctgggtctcactggccccaagtctcccacccagaactctggccaaaaatggctctctaggtgggctgtgcaggcaaagcaaagctcagggctggttcccagctggcctgagcagggggcctgccaccagacccacccacgctctgacgagaggcttttccacctccagcaagtgttcccagcaaccagctccatcctggctgcttgccttccatttccgtgtagatggagatcactgtgtgtaataaaccacaagtgcgtgtc

SEQ ID NO: 1111 - DNA, 930 bp, Homo sapiens
atggagtctcgctctggcatccaggctggagtgcggtgtcgcgatctcggctcactgcaacctccgcctctcgcgttaaagcagttctccagcctcagtctcccaagcagctgggattataggcgcctgccaccacgctgtggcttcctttttgaagtcagcgagaccacgaacccaccggcaggaaccaactccagacacactttgaccgtgaagttggacggactagcgaagatccggactgctcgggaagctccatccgaatgtgtctgccccccagggccccctggacggcgcggcaagcctgggagaagaggcgaccctggtcctccaggacccctgggtttggatggcaagcccggacttccaggcccgaaaggggaaaagggtgcaccaggagactttggcccccggggagaccaaggacaagatggagctgctgggcctccggggccccctggacctcctggggcccggggccctcctggcgacactgggaaagatggccccaggggagcacaaggcccagcgggccccaaaggagagcccggacaagacggcgagatgggcccaaagggacccccagggcccaagggtgagcctggagtacctggaaagaagggcgacgatgggacaccaagccagcctggaccaccagggcccaagggcgagccagggagcatggggcctcggggagagaacggtgtggacggtgccccaggaccgaagggggagcctggccaccgaggcacggatggagctgcagggccccggggtgacgtccgggatcctggcctcggctctgtctcctcatgctcccagaggctggcttcttcctccaaaaaaaatggatctgagcccccgcctggctgtgcagggtgccccaggcctcaagggcgagcagggagacacagtggtgatcgactatga

SEQ ID NO: 1112 - DNA, 4210 bp, Homo sapiens
gtgactaggaagacgcgcgagcggggctggccggccggcgggtgggggaggggaggcgggggaaggcggctgagtgggcctctggagtgtgtgtgtctgtgtcagtgtgtgtgtgtgtgtgtgtatgtgtgtgtctggcgcctggccagggtgatttcccataaaccacatgccccccagtcctctcttaaaaggctgtgccgagggctggccagtgaggctcggcccggggaaagtgaaagtttgcctgggtcctctcggcgccagagccgctctccgcatcccaggacagcggtgcggccctcggccggggcgcccactccgcagcagccagcgagcgagcgagcgagcgagggcggccgacgcgcccggccgggacccagctgcccgtatgaccgcgccgggcgccgccgggcgctgccctcccacgacatggctgggctccctgctgttgttggtctgtctcctggcgagcaggagtatcaccgaggaggtgtcggagtactgtagccacatgattgggagtggacacctgcagtctctgcagcggctgattgacagtcagatggagacctcgtgccaaattacatttgagtttgtagaccaggaacagttgaaagatccagtgtgctaccttaagaaggcatttctcctggtacaagacataatggaggacaccatgcgcttcagagataacacccccaatgccatcgccattgtgcagctgcaggaactctctttgaggctgaagagctgcttcaccaaggattatgaagagcatgacaaggcctgcgtccgaactttctatgagacacctctccagttgctggagaaggtcaagaatgtctttaatgaaacaaagaatctccttgacaaggactggaatattttcagcaagaactgcaacaacagctttgctgaatgctccagccaagatgtggtgaccaagcctgattgcaactgcctgtaccccaaagccatccctagcagtgacccggcctctgtctcccctcatcagcccctcgccccctccatggcccctgtggctggcttgacctgggaggactctgagggaactgagggcagctccctcttgcctggtgagcagcccctgcacacagtggatccaggcagtgccaagcagcggccacccaggagcacctgccagagctttgagccgccagagaccccagttgtcaaggacagcaccatcggtggctcaccacagcctcgcccctctgtcggggccttcaaccccgggatggaggatattcttgactctgcaatgggcactaattgggtcccagaagaagcctctggagaggccagtgagattcccgtaccccaagggacagagctttccccctccaggccaggagggggcagcatgcagacagagcccgccagacccagcaacttcctctcagcatcttctccactccctgcatcagcaaagggccaacagccggcagatgtaactggtaccgccttgcccagggtgggccccgtgaggcccactggccaggactggaatcacaccccccagaagacagaccatccatctgccctgctcagagaccccccggagccaggctctcccaggatctcatcactgcgcccccagggcctcagcaacccctccaccctctctgctcagccacagctttccagaagccactcctcgggcagcgtgctgccccttggggagctggagggcaggaggagcaccagggatcggaggagccccgcagagccagaaggaggaccagcaagtgaaggggcagccaggcccctgccccgttttaactccgttcctttgactgacacaggccatgagaggcagtccgagggatccttcagcccgcagctccaggagtctgtcttccacctgctggtgcccagtgtcatcctggtcttgctggccgtcggaggcctcttgttctacaggtggaggcggcggagccatcaagagcctcagagagcggattctcccttggagcaaccagagggcagccccctgactcaggatgacagacaggtggaactgccagtgtagagggaattctaagctggacgcacagaacagtctctccgtgggaggagacattatggggcgtccaccaccacccctccctggccatcctcctggaatgtggtctgccctccaccagagctcctgcctgccaggactggaccagagcagccaggctggggcccctctgtctcaacccgcagacccttgactgaatgagagaggccagaggatgctccccatgctgccactatttattgtgagccctggaggctcccatgtgcttgaggaaggctggtgagcccggctcaggaccctcttccctcaggggctgcaccctcctctcactcccttccatgccggaacccaggccagggacccaccggcctgtggtttgtgggaaagcagggtggacgctgaggagtgaaagaaccctgcacccagagggcctgcctggtgccaaggtatcccagcctggacaggcatggacctgtctccagagagaggagcctgaagttcgtggggcgggacagcgtcggcctgatttcccgtaaaggtgtgcagcctgagagacgggaagaggaggcctctggacctgctggtctgcactgacagcctgaagggtctacaccctcggctcacctaagtgccctgtgctggttgccaggcgcagaggggaggccagccctgccctcaggacctgcctgacctgccagtgatgccaagagggggatcaagcactggcctctgcccctcctccttccagcacctgccagagcttctccaggaggccaagcagaggctcccctcatgaaggaagccattgcactgtgaacactgtacctgcctgctgaacagcctgcccccgtccatccatgagccagcatccgtccgtcctccactctccagcctctccccagcctcctgcactgagctggcctcaccagtcgactgagggagcccctcagccctgaccttctcctgacctggcctttgactccccggagtggagtggggtgggagaacctcctgggccgccagccagagccggtctttaggctgtgttgttcgcccaggtttctgcatcttgcactttgacattcccaagagggaagggactagtgggagagagcaagggaggggagggcacagacagagaggctacagggcgagctctgactgaagatgggcctttgaaatataggtatgcacctgaggttgggggagggtctgcactcccaaaccccagcgcagtgtcctttccctgctgccgacaggaacctggggctgaacaggttatccctgtcaggagccctggactgggctgcatctcagccccacctgcatggtatccagctcccatccacttctcacccttctttcctcctgaccttggtcagcagtgatgacctccaactctcacccaccccctctaccatcacctctaaccaggcaagccagggtgggagagcaatcaggagagccaggcctcagcttccaatgcctggagggcctccactttgtggccagcctgtggtggtggctctgaggcctaggcaacgagcgacagggctgccagttgcccctgggttcctttgtgctgctgtgtgcctcctctcctgccgccctttgtcctccgctaagagaccctgccctacctggccgctgggccccgtgactttcccttcctgcccaggaaagtgagggtcggctggccccaccttccctgtcctgatgccgacagcttagggaagggcagtgaacttgcatatggggcttagccttctagtcacagcctctatatttgatgctagaaaacacatatttttaaatggaagaaaaataaaaaggcattcccccttcatccccctaccttaaacatataatattttaaaggtcaaaaaagcaatccaacccactgcagaagctctttttgagcacttggtggcatcagagcaggaggagccccagagccacctctggtgtccccccaggctacctgctcaggaaccccttctgttctctgagaagtcaagagaggacattggctcacgcactgtgagattttgtttttatacttggaagtggtgaattattttatataaagtcatttaaatatctatttaaaagataggaagctgcttatatatttaataataaaagaagtgcacaagctgc

SEQ ID NO: 1113 - DNA, 2625 bp, Homo sapiens
agtgcagcgcagaagacagagggtgactaggaagacgcgcgagcggggctggccggccggcgggtgggggaggggaggcgggggaaggcggctgagtgggcctctggagtgtgtgtgtctgtgtcagtgtgtgtgtgtgtgtgtgtatgtgtgtgtctggcgcctggccagggtgatttcccataaaccacatgccccccagtcctctcttaaaaggctgtgccgagggctggccagtgaggctcggcccggggaaagtgaaagtttgcctgggtcctctcggcgccagagccgctctccgcatcccaggacagcggtgcggccctcggccggggcgcccactccgcagcagccagcgagcgagcgagcgagcgagggcggccgacgcgcccggccgggacccagctgcccgtatgaccgcgccgggcgccgccgggcgctgccctcccacgacatggctgggctccctgctgttgttggtctgtctcctggcgagcaggagtatcaccgaggaggtgtcggagtactgtagccacatgattgggagtggacacctgcagtctctgcagcggctgattgacagtcagatggagacctcgtgccaaattacatttgagtttgtagaccaggaacagttgaaagatccagtgtgctaccttaagaaggcatttctcctggtacaagacataatggaggacaccatgcgcttcagagataacacccccaatgccatcgccattgtgcagctgcaggaactctctttgaggctgaagagctgcttcaccaaggattatgaagagcatgacaaggcctgcgtccgaactttctatgagacacctctccagttgctggagaaggtcaagaatgtctttaatgaaacaaagaatctccttgacaaggactggaatattttcagcaagaactgcaacaacagctttgctgaatgctccagccaagatgtggtgaccaagcctgattgcaactgcctgtaccccaaagccatccctagcagtgacccggcctctgtctcccctcatcagcccctcgccccctccatggcccctgtggctggcttgacctgggaggactctgagggaactgagggcagctccctcttgcctggtgagcagcccctgcacacagtggatccaggcagtgccaagcagcggccacccaggagcacctgccagagctttgagccgccagagaccccagttgtcaaggacagcaccatcggtggctcaccacagcctcgcccctctgtcggggccttcaaccccgggatggaggatattcttgactctgcaatgggcactaattgggtcccagaagaagcctctggagaggccagtgagattcccgtaccccaagggacagagctttccccctccaggccaggagggggcagcatgcagacagagcccgccagacccagcaacttcctctcagcatcttctccactccctgcatcagcaaagggccaacagccggcagatgtaactggccatgagaggcagtccgagggatccttcagcccgcagctccaggagtctgtcttccacctgctggtgcccagtgtcatcctggtcttgctggccgtcggaggcctcttgttctacaggtggaggcggcggagccatcaagagcctcagagagcggattctcccttggagcaaccagagggcagccccctgactcaggatgacagacaggtggaactgccagtgtagagggaattctaagctggacgcacagaacagtctctccgtgggaggagacattatggggcgtccaccaccacccctccctggccatcctcctggaatgtggtctgccctccaccagagctcctgcctgccaggactggaccagagcagccaggctggggcccctctgtctcaacccgcagacccttgactgaatgagagaggccagaggatgctccccatgctgccactatttattgtgagccctggaggctcccatgtgcttgaggaaggctggtgagcccggctcaggaccctcttccctcaggggctgcaccctcctctcactcccttccatgccggaacccaggccagggacccaccggcctgtggtttgtgggaaagcagggtggacgctgaggagtgaaagaaccctgcacccagagggcctgcctggtgccaaggtatcccagcctggacaggcatggacctgtctccagagagaggagcctgaagttcgtggggcgggacagcgtcggcctgatttcccgtaaaggtgtgcagcctgagagacgggaagaggaggcctctggacctgctggtctgcactgacagcctgaagggtctacaccctcggctcacctaagtgccctgtgctggttgccaggcgcagaggggaggccagccctgccctcaggacctgcctgacctgccagtgatgccaagagggggatcaagcactggcctctgcccctcctccttccagcacctgccagagcttctccaggaggccaagcagaggctcccctcatgaaggaagccattgcactgtgaacactgtacctgcctgctgaacagcctgcccccgtccatccatgagccagcatccgtccgtcctccactctccagcctctcccca

SEQ ID NO: 1114 - DNA, 597 bp, Homo sapiens
cttggaagtgcagcgcagaagacagaggtcctctcttaaaaggctgtgccgagggctggccagtgaggctcggcccggggaaagtgaaagtttgcctgggtcctctcggcgccagagccgctctccgcatcccaggacagcggtgcggccctcggccggggcgcccactccgcagcagccagcgagcgagcgagcgagcgagggcggccgacgcgcccggccgggacccagctgcccgtatgaccgcgccgggcgccgccgggcgctgccctcccacgacatggctgggctccctgctgttgttggtctgtctcctggcgagcaggagtatcaccgaggaggtgtcggagtactgtagccacatgattgggagtggacacctgcagtctctgcagcggctgattgacagtcagatggagacctcgtgccaaattacatttgagtttgtagaccaggaacagttgaaagatccagtgtgctaccttaagaaggcatttctcctggtacaagacataatggaggacaccatgcgcttcagagataacacccccaatgccatcgccattgtgcagctgcaggaactctctttgaggctga

SEQ ID NO: 1115 - DNA, 1364 bp, Homo sapiens
gggcggccgacgcgcccggccgggacccagctgcccgtatgaccgcgccgggcgccgccgggcgctgccctcccacgacatggctgggctccctgctgttgttggtctgtctcctggcgagcaggagtatcaccgaggaggtgtcggagtactgtagccacatgattgggagtggacacctgcagtctctgcagcggctgattgacagtcagatggagacctcgtgccaaattacatttgagtttgtagaccaggaacagttgaaagatccagtgtgctaccttaagaaggcatttctcctggtacaagacataatggaggacaccatgcgcttcagagataacacccccaatgccatcgccattgtgcagctgcaggaactctctttgaggctgaagagctgcttcaccaaggattatgaagagcatgacaaggcctgcgtccgaactttctatgagacacctctccagttgctggagaaggtcaagaatgtctttaatgaaacaaagaatctccttgacaaggactggaatattttcagcaagaactgcaacaacagctttgctgaatgctccagccaagatgtggtgaccaagcctgattgcaactgcctgtaccccaaagccatccctagcagtgacccggcctctgtctcccctcatcagcccctcgccccctccatggcccctgtggctggcttgacctgggaggactctgagggaactgagggcagctccctcttgcctggtgagcagcccctgcacacagtggatccaggcagtgccaagcagcggccacccaggagcacctgccagagctttgagccgccagagaccccagttgtcaaggacagcaccatcggtggctcaccacagcctcgcccctctgtcggggccttcaaccccgggatggaggatattcttgactctgcaatgggcactaattgggtcccagaagaagcctctggagaggccagtgagattcccgtaccccaagggacagagctttccccctccaggccaggagggggcagcatgcagacagagcccgccagacccagcaacttcctctcagcatcttctccactccctgcatcagcaaagggccaacagccggcagatgtaactggccatgagaggcagtccgagggatccttcagcccgcagctccaggagtctgtcttccacctgctggtgcccagtgtcatcctggtcttgctggccgtcggaggcctcttgttctacaggtggaggcggcggagccatcaagagcctcagagagcggattctcccttggagcaaccagagggcagccccctgactcaggatgacagacaggtggaactgccagtgtagagggaattc

SEQ ID NO: 1116 - DNA, 2484 bp, Homo sapiens
gagccgctctccgcatcccaggacagcggtgcggccctcggccggggcgcccactccgcagcagccagcgagcgagcgagcgagcgagggcggccgacgcgcccggccgggacccagctgcccgtatgaccgcgccgggcgccgccgggcgctgccctcccacgacatggctgggctccctgctgttgttggtctgtctcctggcgagcaggagtatcaccgaggaggtgtcggagtactgtagccacatgattgggagtggacacctgcagtctctgcagcggctgattgacagtcagatggagacctcgtgccaaattacatttgagtttgtagaccaggaacagttgaaagatccagtgtgctaccttaagaaggcatttctcctggtacaagacataatggaggacaccatgcgcttcagagataacacccccaatgccatcgccattgtgcagctgcaggaactctctttgaggctgaagagctgcttcaccaaggattatgaagagcatgacaaggcctgcgtccgaactttctatgagacacctctccagttgctggagaaggtcaagaatgtctttaatgaaacaaagaatctccttgacaaggactggaatattttcagcaagaactgcaacaacagctttgctgaatgctccagccaagatgtggtgaccaagcctgattgcaactgcctgtaccccaaagccatccctagcagtgacccggcctctgtctcccctcatcagcccctcgccccctccatggcccctgtggctggcttgacctgggaggactctgagggaactgagggcagctccctcttgcctggtgagcagcccctgcacacagtggatccaggcagtgccaagcagcggccacccaggagcacctgccagagctttgagccgccagagaccccagttgtcaaggacagcaccatcggtggctcaccacagcctcgcccctctgtcggggccttcaaccccgggatggaggatattcttgactctgcaatgggcactaattgggtcccagaagaagcctctggagaggccagtgagattcccgtaccccaagggacagagctttccccctccaggccaggagggggcagcatgcagacagagcccgccagacccagcaacttcctctcagcatcttctccactccctgcatcagcaaagggccaacagccggcagatgtaactggtaccgccttgcccagggtgggccccgtgaggcccactggccaggactggaatcacaccccccagaagacagaccatccatctgccctgctcagagaccccccggagccaggctctcccaggatctcatcactgcgcccccagggcctcagcaacccctccaccctctctgctcagccacagctttccagaagccactcctcgggcagcgtgctgccccttggggagctggagggcaggaggagcaccagggatcggaggagccccgcagagccagaaggaggaccagcaagtgaaggggcagccaggcccctgccccgttttaactccgttcctttgactgacacaggccatgagaggcagtccgagggatccttcagcccgcagctccaggagtctgtcttccacctgctggtgcccagtgtcatcctggtcttgctggccgtcggaggcctcttgttctacaggtggaggcggcggagccatcaagagcctcagagagcggattctcccttggagcaaccagagggcagccccctgactcaggatgacagacaggtggaactgccagtgtagagggaattctaagacccctcaccatcctggacacactcgtttgtcaatgtccctctgaaaatgtgacgcccagccccggacacagtactccagatgttgtctgaccagctcagagagagtacagtgggactgttaccttccttgatatggacagtattcttctatttgtgcagattaagattgcattagtttttttcttaacaactgcatcatactgttgtcatatgttgagcctgtggtctattaaaacccctagttccatttcccataaacttctgtcaagccagaccatctctaccctgtacttggacaacttaacttttttaaccaaagtgcagtttatgttcacctttgttaaagccaccttgttggtttctgcccatcacctgaacctactgaagttgtgtgaaatcctaattctgtcatctccgtagccctcccagttgtgcctcctgcacattgatgagtgcctgctgttgtctttgcccatgttgttgatgtagctgtgaccctattgttcctcacccctgccccccgccaaccccagctggcccacctcttccccctcccacccaagcccacagccagcccatcaggaagccttcctggcttctccacaaccttctgactgctcttttcagtcatgctcctcctgctcttttgtatttggctaatagtatatcaatttgcactt

SEQ ID NO: 1117 - DNA, 1083 bp, Homo sapiens
tccgcatcccaggacagcggtgcggccctcggccggggcgcccactccgcagcagccagcgagcgagcgagcgagcgagggcggccgacgcgcccggccgggacccagctgcccgtatgaccgcgccgggcgccgccgggcgctgccctcccacgacatggctgggctccctgctgttgttggtctgtctcctggcgagcaggagtatcaccgaggaggtgtcggagtactgtagccacatgattgggagtggacacctgcagtctctgcagcggctgattgacagtcagatggagacctcgtgccaaattacatttgagtttgtagaccaggaacagttgaaagatccagtgtgctaccttaagaaggcatttctcctggtacaagacataatggaggacaccatgcgcttcagagataacacccccaatgccatcgccattgtgcagctgcaggaactctctttgaggctgaagagctgcttcaccaaggattatgaagagcatgacaaggcctgcgtccgaactttctatgagacacctctccagttgctggagaaggtcaagaatgtctttaatgaaacaaagaatctccttgacaaggactggaatattttcagcaagaactgcaacaacagctttgctgaatgctccagccaaggccatgagaggcagtccgagggatccttcagcccgcagctccaggagtctgtcttccacctgctggtgcccagtgtcatcctggtcttgctggccgtcggaggcctcttgttctacaggtggaggcggcggagccatcaagagcctcagagagcggattctcccttggagcaaccagagggcagccccctgactcaggatgacagacaggtggaactgccagtgtagagggaattctaagctggacgcacagaacagtctctccgtgggaggagacattatggggcgtccaccaccacccctccctggccatcctcctggaatgtggtctgccctccaccagagctcctgcctgccaggactggaccagagcagccaggctggggcccctctgtctcaacccgcagacccttgactgaatgag

SEQ ID NO: 1118 - DNA, 1087 bp, Homo sapiens
gccactcctgctgggcagcccacagggtccctgggcggagggcaggagcatccagttggagttgacaacaggaggcagaggcatcatggagggtccccggggatggctggtgctctgtgtgctggccatatcgctggcctctatggtgaccgaggacttgtgccgagcaccagacgggaagaaaggggaggcaggaagacctggcagacgggggcggccaggcctcaagggggagcaaggggagccgggggcccctggcatccggacaggcatccaaggcctaaggagaccagggggaacctgggccctctggaaaccccggcaaggtgggctacccagggcccagcggccccctcggagcccatcccgggaattaaaggcaccaagggcagcccaggaaacatcaaggaccagccgaggccagccttctccgccattcggcggaaccccaatggggggcaacgtggtcattcgacacggtcatcaccaaccaggaagaaccgtaccagaaccactccggccgattcgtctgcactgtacccggctactactacttcaccttccaggtgctgtcccagtgggaaatctgcctgtccatcgtctcctcctcaaggggccaggtccgacgctccctgggcttctgtgacaccaccaacaaggggctcttccaggtggtgtcagggggcatggtgcttcagctgcagcagggtgaccaggtctgggttgaaaaagaccccaaaaagggtcacatttaccagggctctgaggccgacagcgtcttcagcggcttcctcatcttcccatctgcctgagccagggaaggaccccctcccccacccacctctctggcttccatgctccgcctgtaaaatgggggcgctattgcttcagctgctgaagggagggggctggctctgagagccccaggactggctgccccgtgacacatgctctaagaagctcgtttcttagacctcttcctggaataaacatctgtgtctgtgtctgctgaacatgagcttcagttgctactcggagcattgagagggaggcctaagaataataacaatccagtgcttaagagtca

SEQ ID NO: 1119 - DNA, 1143 bp, Homo sapiens
agtcttgctgaagtctgcttgaaatgtccctggtgagcttctggccactggggaagttcagggggcaggtctgaagaaggggaagtaggaagggatgtgaaacttggccacagcctggagccactcctgctgggcagcccacagggtccctgggcggagggcaggagcatccagttggagttgacaacaggaggcagaggcatcatggagggtccccggggatggctggtgctctgtgtgctggccatatcgctggcctctatggtgaccgaggacttgtgccgagcaccagacgggaagaaaggggaggcaggaagacctggcagacgggggcggccaggcctcaagggggagcaaggggagccgggggcccctggcatccggacaggcatccaaggccttaaaggagaccagggggaacctgggccctctggaaaccccggcaaggtgggctacccagggcccagcggccccctcggagcccgtggcatcccgggaattaaaggcaccaagggcagcccaggaaacatcaaggaccagccgaggccagccttctccgccattcggcggaaccccccaatggggggcaacgtggtcatcttcgacacggtcatcaccaaccaggaagaaccgtaccagaaccactccggccgattcgtctgcactgtacccggctactactacttcaccttccaggtgctgtcccagtgggaaatctgcctgtccatcgtctcctcctcaaggggccaggtccgacgctccctgggcttctgtgacaccaccaacaaggggctcttccaggtggtgtcagggggcatggtgcttcagctgcagcagggtgaccaggtctgggttgaaaaagaccccaaaaagggtcacatttaccagggctctgaggccgacagcgtcttcagcggcttcctcatcttcccatctgcctgagccagggaaggaccccctcccccacccacctctctggcttccatgctccgcctgtaaaatgggggcgctattgcttcagctgctgaagggagggggctggctctgagagccccaggactggctgccccgtgacacatgctctaagaagctcgtttcttagacctcttcctggaataaacatctgtgtctgtgtctgctgaa

SEQ ID NO: 1120 - DNA, 976 bp, Homo sapiens
acctgcccaggccctcccgtgtctccacagaggcatcatggagggtccccggggatggctggtgctctgtgtgctggccatatcgctggcctctatggtgaccgaggacttgtgccgagcaccagacgggaagaaaggggaggcaggaagacctggcagacgggggcggccaggcctcaagggggagcaaggggagccgggggcccctggcatccggacaggcatccaaggccttaaaggagaccagggggaacctgggccctctggaaaccccggcaaggtgggctacccagggcccagcggccccctcggagcccgtggcatcccgggaattaaaggcaccaagggcagcccaggaaacatcaaggaccagccgaggccagccttctccgccattcggcggaaccccccaatggggggcaacgtggtcatcttcgacacggtcatcaccaaccaggaagaaccgtaccagaaccactccggccgattcgtctgcactgtacccggctactactacttcaccttccaggtgctgtcccagtgggaaatctgcctgtccatcgtctcctcctcaaggggccaggtccgacgctccctgggcttctgtgacaccaccaacaaggggctcttccaggtggtgtcagggggcatggtgcttcagctgcagcagggtgaccaggtctgggttgaaaaagaccccaaaaagggtcacatttaccagggctctgaggccgacagcgtcttcagcggcttcctcatcttcccatctgcctgagccagggaaggaccccctcccccacccacctctctggcttccatgctccgcctgtaaaatgggggcgctattgcttcagctgctgaagggagggggctggctctgagagccccaggactggctgccccgtgacacatgctctaagaagctcgtttcttagacctcttcctggaataaacatctgtgtctgtgtctgctgaa

SEQ ID NO: 1121 - DNA, 768 bp, Homo sapiens
ccaggaggctgggcagctgaggcagggagggagggaaataactgtgcctgattctaggacagggatgggggtgcagcactgatccaggacccagaatggaggcatcatggagggtccccggggatggctggtgctctgtgtgctggccatatcgctggcctctatggtgaccgaggacttgtgccgagcaccagacgggaagaaaggggaggcaggaagacctggcagacgggggcggccaggcctcaagggggagcaaggggagccgggggcccctggcatccggacaggcatccaaggccttaaaggagaccagggggaacctgggccctctggaaaccccggcaaggtgggctacccagggcccagcggccccctcggagcccgtggcatcccgggaattaaaggcaccaagggcagcccaggaaacatcaaggaccagccgaggccagccttctccgccattcggcggaaccccccaatggggggcaacgtggtcatcttcgacacggtcatcaccaaccaggaagaaccgtaccagaaccactccggccgattcgtctgcactgtacccggctactactacttcaccttccaggtgctgtcccagtgggaaatctgcctgtccatcgtctcctcctcaaggggccaggtccgacgctccctgggcttctgtgacaccaccaacaaggggctcttccaggtggtgtcagggggcatggtgcttcagctgcagcagggtgaccaggtctgggttgaaaaagaccc

SEQ ID NO: 1122 - DNA, 2339 bp, Homo sapiens
cacacaacaactcttccccgctgagaggagacagccagtgcgactccaccctccagctcgacggcagccgccccggccgacagccccgagacgacagcccggcgcgtcccggtccccacctccgaccaccgccagcgctccaggccccgccgctccccgctcgccgccaccgcgccctccgctccgcccgcagtgccaaccatgaccgccgccagtatgggccccgtccgcgtcgccttcgtggtcctcctcgccctctgcagccggccggccgtcggccagaactgcagcgggccgtgccggtgcccggacgagccggcgccgcgctgcccggcgggcgtgagcctcgtgctggacggctgcggctgctgccgcgtctgcgccaagcagctgggcgagctgtgcaccgagcgcgacccatgcgacccgcacaagggcctattctgtcacttcggctccccggccaaccgcaagatcggcgtgtgcaccgccaaagatggtgctccctgcatcttcggtggtacggtgtaccgcagcggagagtccttccagagcagctgcaagtaccagtgcacgtgcctggacggggcggtgggctgcatgcccctgtgcagcatggacgttcgtctgcccagccctgactgccccttcccgaggagggtcaagctgcccgggaaatgctgcgaggagtgggtgtgtgacgagcccaaggaccaaaccgtggttgggcctgccctcgcggcttaccgactggaagacacgtttggcccagacccaactatgattagagccaactgcctggtccagaccacagagtggagcgcctgttccaagacctgtgggatgggcatctccacccgggttaccaatgacaacgcctcctgcaggctagagaagcagagccgcctgtgcatggtcaggccttgcgaagctgacctggaagagaacattaagaagggcaaaaagtgcatccgtactcccaaaatctccaagcctatcaagtttgagctttctggctgcaccagcatgaagacataccgagctaaattctgtggagtatgtaccgacggccgatgctgcaccccccacagaaccaccaccctgccggtggagttcaagtgccctgacggcgaggtcatgaagaagaacatgatgttcatcaagacctgtgcctgccattacaactgtcccggagacaatgacatctttgaatcgctgtactacaggaagatgtacggagacatggcatgaagccagagagtgagagacattaactcattagactggaacttgaactgattcacatctcatttttccgtaaaaatgatttcagtagcacaagttatttaaatctgtttttctaactgggggaaaagattcccacccaattcaaaacattgtgccatgtcaaacaaatagtctatcaaccccagacactggtttgaagaatgttaagacttgacagtggaactacattagtacacagcaccagaatgtatattaaggtgtggctttaggagcagtgggagggtaccagcagaaaggttagtatcatcagatagcatcttatacgagtaatatgcctgctatttgaagtgtaattgagaaggaaaattttagcgtgctcactgacctgcctgtagccccagtgacagctaggatgtgcattctccagccatcaagagactgagtcaagttgttccttaagtcagaacagcagactcagctctgacattctgattcgaatgacactgttcaggaatcggaatcctgtcgattagactggacagcttgtggcaagtgaatttgcctgtaacaagccagattttttaaaatttatattgtaaatattgtgtgtgtgtgtgtgtgtgtatatatatatatatgtacagttatctaagttaatttaaagttgtttgtgcctttttatttttgtttttaatgctttgatatttcaatgttagcctcaatttctgaacaccataggtagaatgtaaagcttgtctgatcgttcaaagcatgaaatggatacttatatggaaattctgctcagatagaatgacagtccgtcaaaacagattgtttgcaaaggggaggcatcagtgtccttggcaggctgatttctaggtaggaaatgtggtagcctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttctagttgaaaataaagtgtatattttttctataaa

SEQ ID NO: 1123 - DNA, 3625 bp, Homo sapiens
cgcgagaacaaagacgcgcgagcatcggcggcccggaaccggccttggaacaactgtggaacctgaggccgcttgccctcccgccccatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggaagtctgtgtacatcttttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttagtagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggagctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccggtcccttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatgagttgtcacttgttcactgtccccaaacctatggaagttgttgctatacatgttggaaatgtgtttttcccccatgaaaccattcttcagacatcagtcaatggaagaaatggctatgaacagaaactacatttctactatgatcagaagaacatgattttacaagtataacagttttgagtaattcaagcctctaaacagacaggaatttagaaaaagtcaatgtacttgtttgaatatttgttttaataccacagctatttagaagcatcatcacgacacatttgccttcagtcttggtaaaacattacttatttaactgattaaaaataccttctatgtattagtgtcaacttttaacttttgggcgtaagaccaaatgtagttttgtatacagagaagaaaacctcaagtaataggcattttaagtaaaagtctacctgtgtttttttctaaaaaggctgctcacaagttctatttcttgaagaataaattctacctccttgtgttgcactgaacaggttctcttcctggcatcataaggagttggtgtaatcattttaaattccactgaaaatttaacagtatccccttctcatcgaagggattgtgtatctgtgcttctaatattagttggctttcataaatcatgttgttgtgtgtatatgtatttaagatgtacatttaataatatcaaagagaagatgcctgttaatttataatgtatttgaaaattacatgttttttcatttgtaaaaatgagtcatttgtttaaacaatctttcatgtcttgtcatacaaatttataaaggtctgcactcctttatctgtaattgtaattccaaaatccaaaaagctctgaaaacaaggtttccataagcttggtgacaaaattcatttgcttgcaatctaatctgaactgaccttgaatctttttatcccatttagtgtgaatattcctttattttgctgcttgatgatgagagggagggctgctgccacagactgtggtgagggctggttaatgtagtatggtatatgcacaaaactacttttctaaaatctaaaatttcataattctgaaacaacttgccccaagggtttcagagaaaggactgtggacctctatcatctgctaagtaatttagaagatattatttgtcttaaaaaatgtgaaatgcttttatattctaatagtttttcactttgtgtattaaatggtttttaaattactttcttgatctctattcattataaaaatcagattataataaaacagttgaatatggcttaggaaaata

SEQ ID NO: 1124 - DNA, 3272 bp, Homo sapiens
gatgcggccccgcccccgccctcggaaccggaagtagagcctggtgcctgggagcggctggcgcggcggaatccagggccgacccgggccggaccgaccccaggcggcgacggaatcagtccccaatgcctggaaattcctcattggattactgtgttttaaacagaatttcgtgaacagccttttatctccaagcggaaagaaagatgtggaaagcttcagcaggccacgctgtgtccatcgcccaggatgacgcgggggccgatgactgggagaccgaccctgattttgtgaatgatgtgagtgagaaggagcaaagatggggtgccaagacggtgcagggctccgggcaccaggagcatatcaacatacacaagctgagggagaatgtctttcaagagcatcagacccttaaggagaaggaacttgaaacaggaccaaaagcttcccatggctatggagggaaatttggtgtggaacaagaccgaatggataagtcagctgtcggccacgaatatcagtcgaaactttccaagcactgctcgcaggtggactcggtccgtggcttcggaggcaagtttggtgtccagatggacagagttgatcagtctgctgtaggctttgaataccaggggaagactgagaagcatgcctcccagaaagactactccagtggttttggcggcaagtatggcgtgcaggccgaccgagtagacaagagcgcggtgggcttcgactaccagggcaagacggagaagcacgagtcacagagagattactccaaaggtttcggcggcaaatacggtatcgacaaggacaaagtggataagagcgccgttggctttgagtatcaaggcaaaacggagaagcacgagtcccagaaagactatgtgaaagggtttggaggaaaatttggtgtgcagacagacagacaagacaaatgtgcccttggctgggatcaccaggagaaattgcagctgcatgaatcccaaaaagattataagactggttttggaggcaaattcggtgttcagtcggagaggcaggactccgctgctgtggggtttgattacaaggagaagctggccaagcacgagtcccagcaagactactccaaaggattcggcgggaagtatggggtgcagaaggatcggatggataagaatgcgtcaacctttgaggatgtcacccaggtgtcctctgcctaccagaagacagtacctgtcgaagctgtgaccagcaaaacaagtaacatcagagctaactttgaaaacctcgctaaggagaaagagcaggaggacaggcggaaggcggaggcggagagagcccagcggatggccaaggagcggcaggagcaggaagaggccaggaggaagctggaggagcaagccagagccaaaacgcaaacgccccctgtgtcgcccgcacctcagccaaccgaggagaggctgccctcgagccccgtctatgaggatgcggcttccttcaaggcagagctgagctacagaggccctgtgagtgggacggagccggagcccgtgtacagcatggaggccgctgactaccgagaggccagcagccagcagggcctggcctatgccacagaggctgtctatgaaagcgcagaggccccgggccactatcccgcagaggacagcacctacgatgagtacgagaacgatctggggatcacagccgtcgccctgtacgactaccaggctgcgggcgatgatgagatctcatttgaccctgatgacatcatcaccaacatcgagatgattgacgacggctggtggcgcggggtgtgcaagggccggtacgggctcttcccagccaactatgtggagctgcggcagtagggcccccagcccccccccggagctgcgccctggatcctcacactacagatcaggccttctttggttcttgggtggttttgggttttttctgtttttttttttttttttttttttttgaaggtggggaggggaatatacacattgcttttatatttaatacttttgctgatgcttttgaaaatgtttatgccacagaatttgctaatatattgtaatcacattccttaggaggactttggtaattggttttatgcattgatggttttttttttcttttttgccaaattgactgtcacgcggcagcttcagggagctcgcattctcttgtgttcgtgttgccctcgtgcccatcaagtgcagtcgggacctcccaggacaagcacgaggcctcaggtcggccctgtggcgggtaggcaggaaggactgtcccagacgaggggcttcctctagagtctcactgctggggaggagaggactgggcctgatggaagttaacccggagctaagtcacccagagcacaggagctgccatgtcagatgggaaatctgcctatgtcataccgtgacagcccgcaggatcaggtgacttctagcagagaccctggtttttttcctgtgcccactccggcttgtcctcatctctacccatcccctgatgcccaggtcaccgggagggctgctgggagcctctcctgtccccgccgggcagtgtcactgagtccttgaaatcctcccctgccccgcgggtctctggattgggacgcacagtgcagttgaggtctgcgtcgggcttggcttttcacaaaggctgatgtcttaactgtcacccatatggtccctgggccaccgggcagcctggggcggtgtgtgtgccatgtcacagcatggcctctcggccttgggaaggaaggcagtgcctgctctgctgtgagccgccaggaaccctcctcctgtcaatgggggtgtagtatttttgccaaaatatcatgttcaatttcagtagtttgatcagttgaaggctagaagtgtgaagtgcagatgagtgtgtgttcttccccaaggtccccccacagctccaggacaccgctgtcctggcatttgtggccactcactttgtaggaaactcatctccttcctgaggagccgggaggctggaccagtcccgtcgtgcagtcaggtgggcggtgtgtctttccagaaggtcacgtggaaatgtctcgggacttgggtcccggagtgcccgtgaagcgtgtttttgctcctgaggtgcattttctcatcatccttgctttaccacaatgagcaatgaggtcgggttttatatgcaacttattgtatctgaattcctgtagcacacctcataggtatgatttttttaaattaaagaattcagaataaacattttttgatcca

SEQ ID NO: 1125 - DNA, 3272 bp, Homo sapiens
ggccgggctagcgcttagccagctgcgggcggacccccgggactcttgcgggccaagacgcgggaggaggcggggcagggggcggggtcgcgcggggacccggatgcggccccgcccccgccctcggaaccggaagtagagcctggtgcctgggagcggctggcgcggcggaatccagggccgacccgggccggaccgaccccaggcggcgacggaatcagtccccaatgcctggaaattcctcattggattactgtgttttaaacagaatttcgtgaacagccttttatctccaagcggaaagaaagatgtggaaagcttcagcaggccacgctgtgtccatcgcccaggatgacgcgggggccgatgactgggagaccgaccctgattttgtgaatgatgtgagtgagaaggagcaaagatggggtgccaagacggtgcagggctccgggcaccaggagcatatcaacatacacaagctgagggagaatgtctttcaagagcatcagacccttaaggagaaggaacttgaaacaggaccaaaagcttcccatggctatggagggaaatttggtgtggaacaagaccgaatggataagtcagctgtcggccacgaatatcagtcgaaactttccaagcactgctcgcaggtggactcggtccgtggcttcggaggcaagtttggtgtccagatggacagagttgatcagtctgctgtaggctttgaataccaggggaagactgagaagcatgcctcccagaaagactactccagtggttttggcggcaagtatggcgtgcaggccgaccgagtagacaagagcgcggtgggcttcgactaccagggcaagacggagaagcacgagtcacagagagattactccaaaggtttcggcggcaaatacggtatcgacaaggacaaagtggataagagcgccgttggctttgagtatcaaggcaaaacggagaagcacgagtcccagaaagactatgtgaaagggtttggaggaaaatttggtgtgcagacagacagacaagacaaatgtgcccttggctgggatcaccaggagaaattgcagctgcatgaatcccaaaaagactactccaaaggattcggcgggaagtatggggtgcagaaggatcggatggataagaatgcgtcaacctttgaggatgtcacccaggtgtcctctgcctaccagaagacagtacctgtcgaagctgtgaccagcaaaacaagtaacatcagagctaactttgaaaacctcgctaaggagaaagagcaggaggacaggcggaaggcggaggcggagagagcccagcggatggccaaggagcggcaggagcaggaagaggccaggaggaagctggaggagcaagccagagccaaaacgcaaacgccccctgtgtcgcccgcacctcagccaaccgaggagaggctgccctcgagccccgtctatgaggatgcggcttccttcaaggcagagctgagctacagaggccctgtgagtgggacggagccggagcccgtgtacagcatggaggccgctgactaccgagaggccagcagccagcagggcctggcctatgccacagaggctgtctatgaaagcgcagaggccccgggccactatcccgcagaggacagcacctacgatgagtacgagaacgatctggggatcacagccgtcgccctgtacgactaccaggctgcgggcgatgatgagatctcatttgaccctgatgacatcatcaccaacatcgagatgattgacgacggctggtggcgcggggtgtgcaagggccggtacgggctcttcccagccaactatgtggagctgcggcagtagggcccccagcccccccccggagctgcgccctggatcctcacactacagatcaggccttctttggttcttgggtggttttgggttttttctgtttttttttttttttttttttttttgaaggtggggaggggaatatacacattgcttttatatttaatacttttgctgatgcttttgaaaatgtttatgccacagaatttgctaatatattgtaatcacattccttaggaggactttggtaattggttttatgcattgatggttttttttttcttttttgccaaattgactgtcacgcggcagcttcagggagctcgcattctcttgtgttcgtgttgccctcgtgcccatcaagtgcagtcgggacctcccaggacaagcacgaggcctcaggtcggccctgtggcgggtaggcaggaaggactgtcccagacgaggggcttcctctagagtctcactgctggggaggagaggactgggcctgatggaagttaacccggagctaagtcacccagagcacaggagctgccatgtcagatgggaaatctgcctatgtcataccgtgacagcccgcaggatcaggtgacttctagcagagaccctggtttttttcctgtgcccactccggcttgtcctcatctctacccatcccctgatgcccaggtcaccgggagggctgctgggagcctctcctgtccccgccgggcagtgtcactgagtccttgaaatcctcccctgccccgcgggtctctggattgggacgcacagtgcagttgaggtctgcgtcgggcttggcttttcacaaaggctgatgtcttaactgtcacccatatggtccctgggccaccgggcagcctggggcggtgtgtgtgccatgtcacagcatggcctctcggccttgggaaggaaggcagtgcctgctctgctgtgagccgccaggaaccctcctcctgtcaatgggggtgtagtatttttgccaaaatatcatgttcaatttcagtagtttgatcagttgaaggctagaagtgtgaagtgcagatgagtgtgtgttcttccccaaggtccccccacagctccaggacaccgctgtcctggcatttgtggccactcactttgtaggaaactcatctccttcctgaggagccgggaggctggaccagtcccgtcgtgcagtcaggtgggcggtgtgtctttccagaaggtcacgtggaaatgtctcgggacttgggtcccggagtgcccgtgaagcgtgtttttgctcctgaggtgcattttctcatcatccttgctttaccacaatgagcaatgaggtcgggttttatatgcaacttattgtatctgaattcctgtagcacacctcataggtatgatttttttaaattaaagaattcagaataaacattttttgatccacttgcgtga

SEQ ID NO: 1126 - DNA, 2247 bp, Homo sapiens
agagcctggtgcctgggagcggctggcgcggcggaatccagggccgacccgggccggaccgaccccaggcggcgacggaatcagtccccaatgcctggaaattcctcattggattactgtgttttaaacagaatttcgtgaacagccttttatctccaagcggaaagaaagatgtggaaagcttcagcaggccacgctgtgtccatcgcccaggatgacgcgggggccgatgactgggagaccgaccctgattttgtgaatgatgtgagtgagaaggagcaaagatggggtgccaagacggtgcagggctccgggcaccaggagcatatcaacatacacaagctgagggagaatgtctttcaagagcatcagacccttaaggagaaggaacttgaaacaggaccaaaagcttcccatggctatggagggaaatttggtgtggaacaagaccgaatggataagtcagctgtcggccacgaatatcagtcgaaactttccaagcactgctcgcaggtggactcggtccgtggcttcggaggcaagtttggtgtccagatggacagagttgatcagtctgctgtaggctttgaataccaggggaagactgagaagcatgcctcccagaaagactactccagtggttttggcggcaagtatggcgtgcaggccgaccgagtagacaagagcgcggtgggcttcgactaccagggcaagacggagaagcacgagtcacagagagattactccaaaggtttcggcggcaaatacggtatcgacaaggacaaagtggataagagcgccgttggctttgagtatcaaggcaaaacggagaagcacgagtcccagaaagactatgtgaaagggtttggaggaaaatttggtgtgcagacagacagacaagacaaatgtgcccttggctgggatcaccaggagaaattgcagctgcatgaatcccaaaaagactactccaaaggattcggcgggaagtatggggtgcagaaggatcggatggataagaatgcgtcaacctttgaggatgtcacccaggtgtcctctgcctaccagaagacagtacctgtcgaagctgtgaccagcaaaacaagtaacatcagagctaactttgaaaacctcgctaaggagaaagagcaggaggacaggcggaaggcggaggcggagagagcccagcggatggccaaggagcggcaggagcaggaagaggccaggaggaagctggaggagcaagccagagccaaaacgcaaacgccccctgtgtcgcccgcacctcagccaaccgaggagaggctgccctcgagccccgtctatgaggatgcggcttccttcaaggcagagctgagctacagaggccctgtgagtgggacggagccggagcccgtgtacagcatggaggccgctgactaccgagaggccagcagccagcagggcctggcctatgccacagaggctgtctatgaaagcgcagaggccccgggccactatcccgcagaggacagcacctacgatgagtacgagaacgatctggggatcacagccgtcgccctgtacgactaccaggctgcgggcgatgatgagatctcatttgaccctgatgacatcatcaccaacatcgagatgattgacgacggctggtggcgcggggtgtgcaagggccgcttcagggagctcgcattctcttgtgttcgtgttgccctcgtgcccatcaagtgcagtcgggacctcccaggacaagcacgaggcctcaggtcggccctgtggcgggtaggcaggaaggactgtcccagacgaggggcttcctctagagtctcactgctggggaggagaggactgggcctgatggaagttaacccggagctaagtcacccagagcacaggagctgccatgtcagatgggaaatctgcctatgtcataccgtgacagcccgcaggatcaggaaactcatctccttcctgaggagccgggaggctggaccagtcccgtcgtgcagtcaggtgggcggtgtgtctttccagaaggtcacgtggaaatgtctcgggacttgggtcccggagtgcccgtgaagcgtgtttttgctcctgaggtgcattttctcatcatccttgctttaccacaatgagcaatgaggtcgggttttatatgcaacttattgtatctgaattcctgtagcacacctcataggtatgatttttttaaattaaagaattcagaataaacattttttgatccacttg

SEQ ID NO: 1127 - DNA, 1326 bp, Homo sapiens
gcatgaatcccaaaaagcaagagaacaaactgcgattgagcctctttttagcgctcagtagagcaggcgcacaggaagcagatgagaataagcccgtgctgactactccaaaggattcggcgggaagtatggggtgcagaaggatcggatggataagaatgcgtcaacctttgaggatgtcacccaggtgtcctctgcctaccagaagacagtacctgtcgaagctgtgaccagcaaaacaagtaacatcagagctaactttgaaaacctcgctaaggagaaagagcaggaggacaggcggaaggcggaggcggagagagcccagcggatggccaaggagcggcaggagcaggaagaggccaggaggaagctggaggagcaagccagagccaaaacgcaaacgccccctgtgtcgcccgcacctcagccaaccgaggagaggctgccctcgagccccgtctatgaggatgcggcttccttcaaggcagagctgagctacagaggccctgtgagtgggacggagccggagcccgtgtacagcatggaggccgctgactaccgagaggccagcagccagcagggcctggcctatgccacagaggctgtctatgaaagcgcagaggccccgggccactatcccgcagaggacagcacctacgatgagtacgagaacgatctggggatcacagccgtcgccctgtacgactaccaggctgcgggcgatgatgagatctcatttgaccctgatgacatcatcaccaacatcgagatgattgacgacggctggtggcgcggggtgtgcaagggccgcttcagggagctcgcattctcttgtgttcgtgttgccctcgtgcccatcaagtgcagtcgggacctcccaggacaagcacgaggcctcaggtcggccctgtggcgggtaggcaggaaggactgtcccagacgaggggcttcctctagagtctcactgctggggaggagaggactgggcctgatggaagttaacccggagctaagtcacccagagcacaggagctgccatgtcagatgggaaatctgcctatgtcataccgtgacagcccgcaggatcaggtgacttctagcagagaccctggtttttttcctgtgcccactccggcttgtcctcatctctacccatcccctgatgcccaggtcaccgggagggctgctgggagcctctcctgtccccgccgggcagtgtcactgagtccttgaaatcctcccctgccccgcgggtctctggattgggacgcacagtgcagttgaggtctgcgtcgggcttggcttttcacaaaggctgatgtctta

SEQ ID NO: 1128 - DNA, 3267 bp, Homo sapiens
ggggcctgtggtcaacgcgatttgcttccaagggacggccaccagtcggcacaggaaaggggcagaggcagtgagttcagcgtgtggacgagggtcaacaagtttgggatcaagcggctgccgctcctccaaaagcgaccgaagcgcgagcagattacccctccgagccagtgtagtaaacacacttcagaaacgtgaggtgccggtggtcacgaggggagcgcgccctccaatgaggagccgggggcggggccgaggccgctgacgcggcggcggcggcagagtcacccgggcagcctcgggaccggtcaccggccggcaaccgtccagcggcctcgaccaccgcctctagcctccgttcccggtcctttctcccgggccgagagacagcgtcgccgacaggggctcattcccctccggttctcctcggtgactcacctcgggcgggccgttttgtctttaggggccgccttggtggggcgaggtttccgtgacgaatctcctggggccgtccgtgccggctcgggccgtcgtggcggctcgagctcctggaacttgctcaggctccggaggtccgaggccctcgaagttatgcgtcgcctccaggcggttgcggcgggcgcgggctcctaaagggcgtcacacccggactccgccgactaggcaacctccattcatctttccactgcgcctccggcgcccccgccttctccggtcccctcctcggagtcattttttcctgttccccctctgccgccctttcctcacgccccgggtgaggcaattctcttggaagcgaaggtgtcggctatgagccggagcctccttccttgaatttctccgtggaggacccgccgcgccccccggcatgggggtgaacgccgtgcactggttccgaaaggggctccggctccacgacaaccccgccctgaaggagtgcattcagggcgccgacaccatccgctgcgtctacatcctggacccctggttcgccggctcctccaatgtgggcatcaacaggtggcgatttttgcttcagtgtcttgaggatcttgatgccaatctacgaaaattaaactcccgtctgtttgtgattcgtggacaaccagcagatgtgtttcccaggcttttcaaggaatggaacattactaaactttcaattgagtatgattctgagccctttggaaaggaacgagacgcagctattaagaaactggcaactgaagctggagtagaagtcattgtaagaatttcacatacattatatgacctagacaagatcatagaactcaatggtggacaaccgcctctaacttataaaagattccagactctcatcagcaaaatggaaccactagagataccagtagagacaattacttcagaagtgatagaaaagtgcacaactcctctgtctgatgaccatgatgagaaatatggagtcccttcactggaagagctaggttttgatacagatggcttatcctctgcagtgtggccaggtggagaaactgaagcacttactcgtttggaaaggcatttggaaagaaaagcttgggtggcaaattttgaaagacctcgaatgaatgcgaattctctgcttgcaagccctactggacttagtccttatctccgatttggttgtttgtcatgtcgactgttttacttcaaactaacagatctctacaaaaaggtaaagaagaacagttcccctcccctttccctttatgggcaactgttatggcgtgaatttttctatacagcagcaacaaataatccacgctttgataaaatggaaggaaaccctatctgtgttcagattccttgggataaaaatcctgaggctttagccaaatgggcggaaggccggacaggctttccatggattgatgccatcatgacacagcttcgtcaggagggttggattcatcatctagccaggcatgcagttgcttgcttcctgacacgaggggacctgtggattagttgggaagaaggaatgaaggtatttgaagaattattgcttgatgcagattggagcataaatgctggaagttggatgtggctgtcttgtagttccttttttcaacagttttttcactgctattgccctgttggttttggtaggagaacagatcccaatggagactatatcaggcgttatttgcctgtcctaagaggcttccctgcaaaatatatctatgatccctggaatgcaccagaaggtatccaaaaggtagccaaatgtttgataggagttaattatcctaaaccaatggtgaaccatgctgaggcaagccgtttgaatatcgaaaggatgaaacagatctatcagcagctttcacgatatagaggactaggtcttctggcatcagtaccttctaatcctaatgggaatggaggcttcatgggatattctgcagaaaatatcccaggttgtagcagcagtggaagttgctctcaagggagtggtattttacactatgctcatggcgacagtcagcaaactcacctgttgaagcaaggaagaagctccatgggcactggtctcagtggtgggaaacgtcctagtcaggaagaggacacacagagtattggtcctaaagtccagagacagagcactaattagaaaacattcaggaggaatactgttgcagctgaaattggtggggagttcaatacttttcaattaagttatttaaaaatattcttcattgatggaaagcagttacatattgaaatatgttgtttctaatgacatttctgtggtttttaactttttaatgaatttcacagaggacaattggtaatttgtatataaagaacttggcaagagaatttgcttaatgtaaatataaacagtcacaattagtatagacccatcgatatatttttgataatttttcatgtatggtaaagttaaaatgacaaattgatattctgatataaaactcaaagttttgaagtcagtgggaaaaaaggaggtttttagactttcttaaaagacgttaaaattttaggacagaattttcttgatgttgtttgatctaactttgcactctttgataataatgttttagataatgtgcgtaatccaaattggtattgtagcctctgttaacacagacagtatatgttttaaactttgatgtaaacctttttagacccaaacttgtggaagtatcatgtgttaagttctctgtctctgtttctttgttcatttattactaaaatgaacttgttattaaagtatatgcaaatatgaaa

SEQ ID NO: 1129 - DNA, 1217 bp, Homo sapiens
atgctggaagttggatgtggctgtcttgtagttccttttttcaacttttttcactgctattgccctgttggttttggtaggagaacagatcccaatggagactatatcaggcgttatttgcctgtcctaagaggcttccctgcaaaatatatctatgatccctggaatgcaccagaaggtatccaaaaggtagccaaatgtttgataggagttaattatcctaaaccaatggtgaaccatgctgaggcaagccgtttgaatatcgaaaggatgaaacagatctatcagcagctttcacgatatagaggactaggtcttctggcatcagtaccttctaatcctaatgggaatggaggcttcatgggatattctgcagaaaatatcccaggttgtagcagcagtggaagttgctctcaagggagtggtattttacactatgctcatggcgacagtcagcaaactcacctgttgaagcaaggaagaagctccatgggcactggtctcagtggtgggaaacgtcctagtcaggaagaggacacacagagtattggtcctaaagtccagagacagagcactaattagaaaacattcaggaggaatactgttgcagctgaaattggtggggagttcaatacttttcaattaagttatttaaaaatattcttcattgatggaaagcagttacatattgaaatatgttgtttctaatgacatttctgtggtttttaactttttaatgaatttcacagaggacaattggtaatttgtatataaagaacttggcaagagaatttgcttaatgtaaatataaacagtcacaattagtatagacccatcgatatatttttgataatttttcatgtatggtaaagttaaaatgacaaattgatattctgatataaaactcaaagttttgaagtcagtgggaaaaaaggaggtttttagactttcttaaaagacgttaaaattttaggacagaattttcttgatgttgtttgatctaactttgcactctttgataataatgttttagataatgtgcgtaatccaaattggtattgtagcctctgttaacacagacagtatatgttttaaactttgatgtaaacctttttagacccaaacttgtggaagtatcatgtgttaagttctctgtctctgtttctttgttcatttattactaaaatgaacttgttattaaagtatatgcaaatatg

SEQ ID NO: 1130 - DNA, 2297 bp, Homo sapiens
tgtccccgcccgcgcggtcgtcggagcgcggctcagcggcgcggcggagactcggcacggcggcggccaggcgcaggcgggcgggcggagcagcggacggcgccgaggccgccccacgcgccgggctcgcggcggcgcagcgcgccggagtggtcggggcccgcggccgctcgcgcctctcgatgggcagctcgcacttgctcaacaagggcctgccgcttggcgtccgacctccgatcatgaacgggcccctgcacccgcggcccctggtggcattgctggatggccgggactgcacagtggagatgcccatcctgaaggacgtggccactgtggccttctgcgacgcgcagtccacgcaggagatccatgagaaggtcctgaacgaggctgtgggggccctgatgtaccacaccatcactctcaccagggaggacctggagaagttcaaagccctccgcatcatcgtccggattggcagtggttttgacaacatcgacatcaagtcggccggggatttaggcattgccgtctgcaacgtgcccgcggcgtctgtggaggagacggccgactcgacgctgtgccacatcctgaacctgtaccggcgggccacctggctgcaccaggcgctgcgggagggcacacgagtccagagcgtcgagcagatccgcgaggtggcgtccggcgctgccaggatccgcggggagaccttgggcatcatcggacttggtcgcgtggggcaggcagtggcgctgcgggccaaggccttcggcttcaacgtgctcttctacgacccttacttgtcggatggcgtggagcgggcgctggggctgcagcgtgtcagcaccctgcaggacctgctcttccacagcgactgcgtgaccctgcactgcggcctcaacgagcacaaccaccacctcatcaacgacttcaccgtcaagcagatgagacaaggggccttcctggtgaacacagcccggggtggcctggtggatgagaaggcgctggcccaggccctgaaggagggccggatccgcggcgcggccctggatgtgcacgagtcggaacccttcagctttagccagggccctctgaaggatgcacccaacctcatctgcaccccccatgctgcatggtacagcgagcaggcatccatcgagatgcgagaggaggcggcacgggagatccgcagagccatcacaggccggatcccagacagcctgaagaactgtgtcaacaaggaccatctgacagccgccacccactgggccagcatggaccccgccgtcgtgcaccctgagctcaatggggctgcctataggtaccctccgggcgtggtgggcgtggcccccactggcatcccagctgctgtggaaggtatcgtccccagcgccatgtccctgtcccacggcctgccccctgtggcccacccgccccacgccccttctcctggccaaaccgtcaagcccgaggcggatagagaccacgccagtgaccagttgtagcccgggaggagctctccagcctcggcgcctgggcagagggcccggaaaccctcggaccagagtgtgtggaggaggcatctgtgtggtggccctggcactgcagagactggtccgggctgtcaggaggcgggagggggcagcgctgggcctcgtgtcgcttgtcgtcgtccgtcctgtgggcgctctgccctgtgtccttcgcgttcctcgttaagcagaagaagtcagtagttattctcccatgaacgttcttgtctgtgtacagtttttagaacattacaaaggatctgtttgcttagctgtcaacaaaaagaaaacctgaaggagcatttggaagtcaatttgaggtttttttttttgttttttttttttttgtatgttggaacgtgccccagaatgaggcagttggcaaacttctcaggacaatgaatccttcccgtttttctttttatgccacacagtgcattgttttttctacctgcttgtcttatttttagaataatttagaaaaacaaaacaaaggctgtttttcctaattttggcatgaacccccccttgttccaaatgaagacggcatcacgaagcagctccaaaaggaaaagcttgggcggtgcccagcgtgcccgctgcccatcgacgtctgtcctggggacgtggagggtggcagcgtccccgcctgcaccagtgccgtcctgctgatgtggtaggctagcaatattttggttaaaatcatgtttgtgactgtaaccatttgtatgaattattttaaagaaataaaaatcctggaaagag

SEQ ID NO: 1131 - DNA, 2467 bp, Homo sapiens
gcgcggctcagcggcgcggcggagactcggcacggcggcggccaggcgcaggcgggcgggcggagcagcggacggcgccgaggccgccccacgcgccgggctcgcggcggcgcagcgcgccggagtggtcggggcccgcggccgctcgcgcctctcgatgggcagctcgcacttgctcaacaagggcctgccgcttgtaagactttgaccccgacgcaggcttcagtgattgccgcggatcagaagcctgagcactttggctcgagacaattaaggacgtgggatgaggctccgagacaggacgcggttctgcctggggatcctgaagataaaaagctttgaaaagtcgaattcatggtcgtggaagctgagcccatattaagagatgtcaggcgtccgacctccgatcatgaacgggcccctgcacccgcggcccctggtggcattgctggatggccgggactgcacagtggagatgcccatcctgaaggacgtggccactgtggccttctgcgacgcgcagtccacgcaggagatccatgagaaggtcctgaacgaggctgtgggggccctgatgtaccacaccatcactctcaccagggaggacctggagaagttcaaagccctccgcatcatcgtccggattggcagtggttttgacaacatcgacatcaagtcggccggggatttaggcattgccgtctgcaacgtgcccgcggcgtctgtggaggagacggccgactcgacgctgtgccacatcctgaacctgtaccggcgggccacctggctgcaccaggcgctgcgggagggcacacgagtccagagcgtcgagcagatccgcgaggtggcgtccggcgctgccaggatccgcggggagaccttgggcatcatcggacttggtcgcgtggggcaggcagtggcgctgcgggccaaggccttcggcttcaacgtgctcttctacgacccttacttgtcggatggcgtggagcgggcgctggggctgcagcgtgtcagcaccctgcaggacctgctcttccacagcgactgcgtgaccctgcactgcggcctcaacgagcacaaccaccacctcatcaacgacttcaccgtcaagcagatgagacaaggggccttcctggtgaacacagcccggggtggcctggtggatgagaaggcgctggcccaggccctgaaggagggccggatccgcggcgcggccctggatgtgcacgagtcggaacccttcagctttagccagggccctctgaaggatgcacccaacctcatctgcaccccccatgctgcatggtacagcgagcaggcatccatcgagatgcgagaggaggcggcacgggagatccgcagagccatcacaggccggatcccagacagcctgaagaactgtgtcaacaaggaccatctgacagccgccacccactgggccagcatggaccccgccgtcgtgcaccctgagctcaatggggctgcctataggtaccctccgggcgtggtgggcgtggcccccactggcatcccagctgctgtggaaggtatcgtccccagcgccatgtccctgtcccacggcctgccccctgtggcccacccgccccacgccccttctcctggccaaaccgtcaagcccgaggcggatagagaccacgccagtgaccagttgtagcccgggaggagctctccagcctcggcgcctgggcagagggcccggaaaccctcggaccagagtgtgtggaggaggcatctgtgtggtggccctggcactgcagagactggtccgggctgtcaggaggcgggagggggcagcgctgggcctcgtgtcgcttgtcgtcgtccgtcctgtgggcgctctgccctgtgtccttcgcgttcctcgttaagcagaagaagtcagtagttattctcccatgaacgttcttgtctgtgtacagtttttagaacattacaaaggatctgtttgcttagctgtcaacaaaaagaaaacctgaaggagcatttggaagtcaatttgaggtttttttttttgttttttttttttttgtatgttggaacgtgccccagaatgaggcagttggcaaacttctcaggacaatgaatccttcccgtttttctttttatgccacacagtgcattgttttttctacctgcttgtcttatttttagaataatttagaaaaacaaaacaaaggctgtttttcctaattttggcatgaacccccccttgttccaaatgaagacggcatcacgaagcagctccaaaaggaaaagcttgggcggtgcccagcgtgcccgctgcccatcgacgtctgtcctggggacgtggagggtggcagcgtccccgcctgcaccagtgccgtcctgctgatgtggtaggctagcaatattttggttaaaatcatgtttgtgactgtaaccatttgtatgaattattttaaagaaataaaaatcctggaaagag

SEQ ID NO: 1132 - DNA, 704 bp, Homo sapiens
gggaagggtcttgcgcatgcgcgggccgctgcgtgtgcgcgagcgccgcagtctgctctccccgcccgcggcccgtgcagtaagactttgaccccgacgcaggcttcagtgattgccgcggatcagaagcctgagcactttggctcgagacaattaaggacgtgggatgaggctccgagacaggacgcggttctgcctggggatcctgaagataaaaagctttgaaaagtcgaattcatggtcgtggaagctgagcccatattaagagatgtcaggcgtccgacctccgatcatgaacgggcccctgcacccgcggcccctggtggcattgctggatggccgggactgcacagtggagatgcccatcctgaaggacgtggccactgtggccttctgcgacgcgcagtccacgcaggagatccatgagaaggtcctgaacgaggctgtgggggccctgatgtaccacaccatcactctcaccagggaggacctggagaagttcaaagccctccgcatcatcgtccggattggcagtggttttgacaacatcgacatcaagtcggccggggatttaggcattgccgtctgcaacgtgcccgcggcgtctgtggaggagacggccgactcgacgctgtgccacatcctgaacctgtaccggcgggccacctggctgcaccaggcgctgcgggagggcacacgagtcc

SEQ ID NO: 1133 - DNA, 985 bp, Homo sapiens
ggactttcgggccctcccgggtcggggcttcaccggtagcaggcagggctttgatattaatgcttaaagggaaagcagagctgagctgtcaggacgttggttagctacaaaccctactcttgttaaaagagaaatggggtcggggaaggggttctccagccctgaacttcccgggccgggcaggacgcggtccctccaggagtcggggctcccccgcctggggacgcactggggcaggcgcgcttctcctctcggggtcccatgtgccgccggctctcggacgtaagactttgaccccgacgcaggcttcagtgattgccgcggatcagaagcctgagcactttggctcgagacaattaaggacgtgggatgaggctccgagacaggacgcggttctgcctggggatcctgaagataaaaagctttgaaaagtcgaattcatggtcgtggaagctgagcccatattaagagatgtcaggcgtccgacctccgatcatgaacgggcccctgcacccgcggcccctggtggcattgctggatggccgggactgcacagtggagatgcccatcctgaaggacgtggccactgtggccttctgcgacgcgcagtccacgcaggagatccatgagaaggtcctgaacgaggctgtgggggccctgatgtaccacaccatcactctcaccagggaggacctggagaagttcaaagccctccgcatcatcgtccggattggcagtggttttgacaacatcgacatcaagtcggccggggatttaggcattgccgtctgcaacgtgcccgcggcgtctgtggaggagacggccgactcgacgctgtgccacatcctgaacctgtaccggcgggccacctggctgcaccaggcgctgcgggagggcacacgagtccagagcgtcgagcagatccgcgaggtggcgtccggcgctgccaggatccgcggggagaccttgggcatcatcggacttg

SEQ ID NO: 1134 - DNA, 3669 bp, Homo sapiens
aaacccccagttggttgtccctgccgtctcggaagggttagcacacagccaggtctgtttttgatgtatgtaattgaagatttataaagaaaagcttctcctctgcctcatccgcagtcattttttttccaatgccagttcccagcaggcatataaatattggtcgttctcagagctgggatgctgctgggtggtacgagggcccctgggagaacgccgagtccctgcggcctctggggaggagaagctccctgacgtatggcacagcagaggggacttggtttgagccaaaccaccgaccacaggacgctgccctgcccgtggccgccgagccctacctgtaccgggaggccgtttataactcagtggctgcaagaaaggggtctactcctgacttcaccttctacgacagcagacaggcagtgatgtctggtcgcagccccctgctgccacgggagtactacagtgatccgtctggagctgctagggtacccaaagagcctcccctctatcgggacccaggagtcagccggccggtccccagctacggagtgcttggcagcagaacgtcatgggatccaatgcaaggccggtcacctgccctgcaggacgccggtcacctgtaccgggatcctggaggtaaaatgatccctcaggggcggcagacacagagcagggctgcatctcccgggcggtatggacgggagcagcccgacaccaggtatggggcggaggtgcctgcctaccccctcagccaggtcttcagcgacatcagcgaaagacccattgaccctgcccctgccagacaggtggccccgacgtgcctggttgtggaccccagttcagctgctgcccccgaaggcagcacaggggtggccccaggggccctgaatcgtggctacgggcctgcccgggaaagcatcccatccaagatggcttacgagacttacgaagctgacctgtccaccttccagggtcctggtggcaagaggaccgtgctccctgagttcctggcctttctgcgggcggaggggctggcagaggccacgctgggagccctactgcagcagggctttgactccccggccgtcctggctaccctggaggacgcggatatcaagtctgtcgcacccaacctgggccaggcccgtgttctgagccgcctggccaatagctgcaggaccgaaatgcagctgcggaggcaggaccgggggggcccgctgccccgggcgcggtccagcagcttcagccaccgaagcgaactgctccatggtgacttggcttctctgggcgctgcggctcctctgcagacagcatccccccgagctggagacccggctcgccgtccctccagcgcaccatctcagcacctcctggagacggcagccacctattctgcccctggcgtgggcacccatgccccacacttcccctccaactccgggtacagctctcccaccccttgcgccctgacagcgcgtctgagccccacgtaccccctgcaggcaggggtggccttgactaacccgggcccctcaaacccccttcacccaggccccagaacagcctactccacggcatacacggtgcccatggagctgctaaagagggagcgcaacgtggccgcctctccgctgcccagccctcacggcagcccccaggtcttgcggaagccaggtgcacccctggggccatccaccctgccgccggccagccagagcctccacacgcctcactcaccgtaccagaaggtggcccggcgcacaggggcacccatcatcgtgtccaccatgcttgcaccagaaccaagtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacaggtcgcatcccagaaagcttaagaaattgtgtgaacaaggaattctttgtcacatcagcgccttggtcagtaatagaccagcaagcaattcatcctgagctcaatggtgccacatacagatatccgccaggcatcgtgggtgtggctccaggaggacttcctgcagccatggaagggatcatccctggaggcatcccagtgactcacaacctcccgacagtggcacatccttcccaagcgccctctcccaaccagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttcctttatcagtcccttgggcacagcaggtcctgaacaccctgctctacaatgttgcatcaagagttcaaacaacaaaataaaaaatattaagaggaaatccccatcctgtgacttgagtcccttaagtctacaggggctggtgacctctttttgctaataggaaaatcacattactacaaaatggggagaaaactgtttgcctgtggtagacacctgcacgcataggattgaagacagtacaggctgctgtacagagaagcgcctctcacatctgaactgcatactgagcggg

SEQ ID NO: 1135 - DNA, 3404 bp, Homo sapiens
gggagcggcccggaggagccggcggcggcccgaggagcgagggaccgaaccgggagccatgccgcgctgagggggggccgcacagccgccgccaccgccaccgccgccgggtggggtgggaggggcgggagacgccgccgccgccgcctccagggtgggcgcctttcgccgtggacgccgaccgtccgggacgagggtttcatcaccttaaatggttttgaaccaatgaaggtgtattcccttaaaaagacggacagcccatcgtgtgaactatagagtttgtggacagatttatattgggttcatagtggcgtcatgcacgcagactcctgcaagttcccctaagttcttagaggactgctttgccttttgatctgagagttgcaaagttccataaagaatggcccttgtggataagcacaaagtcaagagacagcgattggacagaatttgtgaaggtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacaggtcgcatcccagaaagcttaagaaattgtgtgaacaaggaattctttgtcacatcagcgccttggtcagtaatagaccagcaagcaattcatcctgagctcaatggtgccacatacagatatccgccaggcatcgtgggtgtggctccaggaggacttcctgcagccatggaagggatcatccctggaggcatcccagtgactcacaacctcccgacagtggcacatccttcccaagcgccctctcccaaccagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttcctttatcagtcccttgggcacagcaggtcctgaacaccctgctctacaatgttgcatcaagagttcaaacaacaaaataaaaaatattaagaggaaatccccatcctgtgacttgagtcccttaagtctacaggggctggtgacctctttttgctaataggaaaatcacattactacaaaatggggagaaaactgtttgcctgtggtagacacctgcacgcataggattgaagacagtacaggctgctgtacagagaagcgcctctcacatctgaactgcatactgagcgggcaagtcggttgtaagttcagtaaaaccctctgatgatgcaaaaaaaaaaaaaaaagtattaagtttcacaagctgtttgtactcaaatatattttctcagtttcagatcctctgctattttattgagtggaaagtcttgagctaaaagggttcaagaagaataatgttgcatttccttatgtctcaggaaacactttttatggtaacttgtcagattgtctatgaacaaacccacttttttagacattgataaagtcttcttttcttcacgtgatattttatacaagaacacttcagatgtattagatgtgactgattttaacaaatcctattagatttgtatcaactagttacatgttctattcatagtcttttgtgaatcattgcctttttgtttaaaaagatggcctattttgagcctttgtataggtacattcctgtttttgtgacaaaagaaaaactttaaaattgtcccaaacagaaaaataatggctatcagaagtatgttttgttttagtgtgagttaccgttactgtatttgtttattgtaaaggtggacatttagcgttcagtgcagttttcaataaaaagtaattaaaatttgttaagttctgaaattcaagtacatctcactaatgtaaatgttctctacttgagatgtttaaggcaattgcattgtcaattagccaatttccagctcttgttactacagggttccataaccagactcaagaccgctgacaattaattacctgtgataacaaaaagtttaattgaaaaatcaaaacctcacacaagtccatcattatcacgtcatgccatccttaagatgcaatggtgggttagtgctaaatcaattcaaaaaaaaacaaagttgctcaacttttagagttctgactttaatctaccccaaagcaaaatgacctggacctggttcaagggagggaagtgaaccttgaaactgttttgccaataacctaacaaacaaaatgatatttacaaagaagtgttgcaaatagtcccatgagttaagagcttgatttaatggatcttctttttaaatagaattaaacctttatactaaaa

SEQ ID NO: 1136 - DNA, 2036 bp, Homo sapiens
cgcctcccgcctagctcctgcgcagccagcgggtaccgggagctgcggccagcgccgcttctttcctttccttttctctccgttttccttctccttccccggaggagaaaacaaataaagaagagcaaatagccgggaggcgctcggcatccaggacgttccctcccccgatccaagttggaattagcatcctctcggggggtttcatcaccttaaatggttttgaaccaatgaaggtgtattcccttaaaaagacggacagcccatcgtgtgaactatagagtttgtggacagatttatattgggttcatagtggcgtcatgcacgcagactcctgcaagttcccctaagttcttagaggactgctttgccttttgatctgagagttgcaaagttccataaagaatggcccttgtggataagcacaaagtcaagagacagcgattggacagaatttgtgaaggtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacaggtcgcatcccagaaagcttaagaaattgtgtgaacaaggaattctttgtcacatcagcgccttggtcagtaatagaccagcaagcaattcatcctgagctcaatggtgccacatacagatatccgccaggcatcgtgggtgtggctccaggaggacttcctgcagccatggaagggatcatccctggaggcatcccagtgactcacaacctcccgacagtggcacatccttcccaagcgccctctcccaaccagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttccttta

SEQ ID NO: 1137 - DNA, 2014 bp, Homo sapiens
ggagccggcggcggcccgaggagcgagggaccgaaccgggagccatgccgcgctgagggggggccgcacagccgccgccaccgccaccgccgccgggtggggtgggaggggcgggagacgccgccgccgccgcctccagggtgggcgcctttcgccgtggacgccgaccgtccgggacgagatggagaaaacaaaggattcagattgaaggactgctcagacaccctccgaagaggtggccctgcctgcgctcctcctggctgcagagtaccccaccagcgcggttcatagtggcgtcatgcacgcagactcctgcaagttcccctaagttcttagaggactgctttgccttttgatctgagagttgcaaagttccataaagaatggcccttgtggataagcacaaagtcaagagacagcgattggacagaatttgtgaaggtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacaggtcgcatcccagaaagcttaagaaattgtgtgaacaaggaattctttgtcacatcagcgccttggtcagtaatagaccagcaagcaattcatcctgagctcaatggtgccacatacagatatccgccaggcatcgtgggtgtggctccaggaggacttcctgcagccatggaagggatcatccctggaggcatcccagtgactcacaacctcccgacagtggcacatccttcccaagcgccctctcccaaccagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttccttta

SEQ ID NO: 1138 - DNA, 578 bp, Homo sapiens
aggagcgaggagtgagcgagcggcgaccctcacctcgcctcccgcctagctcctgcgcagccagcgggtaccgggagctgcggccagcgccgcttctttcctttccttttctctccgttttccttctccttccccggaggagaaaacaaataaagaagagcaaatagccgggaggcgctcggcatccaggacgttccctcccccgatccaagttggaattagcatcctctcggggggtttcatcaccttaaatggttttgaaccaatgaaggtgtattcccttaaaaagacggacagcccatcgtgtgaactatagagtttgtggacagatttatattgaatcccccacagcggtccacgccccttgccaacttccttccactatcctggttctgttgttactcctgccgactgcagtgctgttccgtgagcttcttgaatgacatcgtacagtatctccgacgcacaggttcatagtggcgtcatgcacgcagactcctgcaagttcccctaagttcttagaggactgctttgccttttgatctgagagttgcaaagttccataaagaatggccctt

SEQ ID NO: 1139 - DNA, 1918 bp, Homo sapiens
aaatccccgctctgcgtgctcgtggtggaggctgctggcaatggcctacgtcgtcataccgggcttccttgccctgtccgggggtttcatcaccttaaatggttttgaaccaatgaaggtgtattcccttaaaaagacggacagcccatcgtgtgaactatagagtttgtggacagatttatattgggttcatagtggcgtcatgcacgcagactcctgcaagttcccctaagttcttagaggactgctttgccttttgatctgagagttgcaaagttccataaagaatggcccttgtggataagcacaaagtcaagagacagcgattggacagaatttgtgaaggtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacaggtcgcatcccagaaagcttaagaaattgtgtgaacaaggaattctttgtcacatcagcgccttggtcagtaatagaccagcaagcaattcatcctgagctcaatggtgccacatacagatatccgccaggcatcgtgggtgtggctccaggaggacttcctgcagccatggaagggatcatccctggaggcatcccagtgactcacaacctcccgacagtggcacatccttcccaagcgccctctcccaaccagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttccttta

SEQ ID NO: 1140 - DNA, 3208 bp, Homo sapiens
aggaggagggccgggcgggcaggggaggaggaggaggcgggcgccgtgtcgcacgcagctccaggcggggcagccccggtagctgagggacgcagctagaccttggcgggacggggctttcgccggggcccaggcccagggaccaggcggaggcgtcgcgggagcctttggggcaccacagagatgcgggtttgcctgcaatgagatttcattctctacatttaaaggacatcctttctgagctgctgtgaataaatttggaatggtactgtatattttcatctaatggagaactagctgtactttgaataaggattgctgcactggacgactttagaacatccctcacaatgtcgtcaacccggagccagaacccccacggcctgaagcagattggcctggaccagatctgggacgacctcagagccggcatccagcaggtgtacacacggcagagcatggccaagtccagatatatggagctctacactcatgtttataactactgtactagtgttcaccagtcaaaccaagcacgaggagctggagttcctccttctaagtcgaaaaaggggcagacacctggaggagctcagtttgttggcctggaattatataaacgacttaaggaatttttgaagaattacttgacaaatcttcttaaggatggagaagatttgatggatgagagtgtactgaaattctacactcaacaatgggaagattatcgattttcaagcaaagtgctgaatggaatttgtgcctacctcaatagacattgggttcgccgtgaatgtgacgaaggacgaaaaggaatatatgaaatctattcgcttgcattggtgacttggagagactgtctgttcaggccactgaataaacaggtaacaaatgctgttttaaagctgattgaaaaggaaaggaatggtgaaaccatcaatacaagattgattagtggagttgtacagtcttacgtggaattggggctgaatgaagatgatgcatttgcaaagggccctacgttaacagtgtataaagaatcctttgaatctcaatttttggctgacacagagagattttataccagagagagtactgaattcttgcagcagaacccagttactgaatatatgaaaaaggcagaggctcgtctgcttgaggaacaacgaagagttcaggtttaccttcatgaaagcacacaagatgaattagcaaggaaatgtgaacaagtcctcattgaaaaacacttggaaattttccacacagaatttcagaatttattggatgctgacaaaaatgaagatttgggacgcatgtataatcttgtatctagaatccaggatggcctaggagaattgaaaaaactgttggagacacacattcataatcagggtcttgcagccattgaaaagtgtggagaagctgctttaaatgaccccaaaatgtatgtacagacagtgcttgatgttcataaaaaatacaatgccctggtaatgtctgcattcaacaatgacgctggctttgtggctgctcttgataaggcttgtggtcgcttcataaacaacaacgcggttaccaagatggcccaatcatccagtaaatcccctgagttgctggctcgatactgtgactccttgttgaagaaaagttccaagaacccagaggaggcagaactagaagacacactcaatcaagtgatggttgtcttcaagtacatagaagacaaagacgtatttcagaagttctatgcgaagatgctcgccaagaggctcgtccaccagaacagtgcaagtgacgatgccgaagccagcatgatctccaagttaaagcaagcttgcgggttcgagtacacctctaaacttcagcgcatgtttcaagacattggcgtgagcaaagatctgaacgagcaattcaaaaagcacttgacaaactcagaacccctagacttggatttcagcattcaagtgctgagctccgggtcctggcccttccagcagtcttgtacatttgccttgccgtcagagttggaacgtagttatcagcgattcacagctttctacgccagccgccacagtggccgaaaattgacgtggttatatcagttgtctaaaggagaattggtaactaactgcttcaaaaacagatatactttgcaggcgtcgacattccagatggctatcctgcttcagtacaacacggaagatgcctacactgtgcagcagctgaccgacagcactcaaattaaaatggacattttggcgcaagttttacagattttattaaagtcgaagctattggtcttggaagatgaaaatgcaaatgttgatgaggtggaattgaagccagataccttaataaaattatatcttggttataaaaataagaaattaagggttaacatcaatgtgccaatgaaaaccgaacagaagcaggaacaagaaaccacacacaaaaacatcgaggaagaccgcaaactactgattcaggcggccatcgtgagaatcatgaagatgaggaaggttctgaaacaccagcagttacttggcgaggtcctcactcagctgtcctccaggttcaaacctcgagtccctgtgatcaagaaatgcattgacattctaattgagaaagaatatttggagcgagtggatggtgaaaaggacacctacagttacttggcttaacccttctggaagggtctgactgtgtgacccgcagcaaatagttcatgttggaaagaatgaaaacaactcaagttcatagcagccagcctgccgccattggacctcccttttaaaaactgagaccaagactcccatcagctggtctcggatttacatcggaactgctcaggattgatacatttcaagtctgtaaatacggacaccaacgccatttaccctaatttaagaacagcggggactgaccctccgtgccgagggctgcatgctaccgcactaagtcaatacatgggctccccgattcgcagctgtcgtcttggcagcacttgtcacgttggcagcactttgagagcaagtctgagtggacccacatgtaacctgctatgaaaaccatttgtatagtgtgtttcattttttaatgtgtgaaaataaagaaaattaaaggatttctgtacaagtcgcattgggttttgttttaagttttactaatttctatatgtaaataaaagatataatgattgtgcaaattt

SEQ ID NO: 1141 - DNA, 2857 bp, Homo sapiens
actattttatatcacgactcatgccatccgtatgtgtaatcaaagccttctaagtcttgatatgtccttacaaagacgaaggatagagtgaatgtcaaaatttgccaaacaggagttactgaaagtctgaaggggaaagcctagttaggttttatcttagaagtgatttttaaaacgaaacacgcagataagctcgagctttctggagccgattcctaaggccttgcaggtggtaagggggtcgagaattggctgaggttcctcggaagtccgcgccgattcggagggccacctctgactttctgatctggggtgcaacccccagtccctgtcccggtcgacaaaggtgtggagtcaggttccaggtttgcctgcaatgagatttcattctctacatttaaaggacatcctttctgagctgctgtgaataaatttggaatggtactgtatattttcatctaatggagaactagctgtactttgaataaggattgctgcactggacgactttagaacatccctcacaatgtcgtcaacccggagccagaacccccacggcctgaagcagattggcctggaccagatctgggacgacctcagagccggcatccagcaggtgtacacacggcagagcatggccaagtccagatatatggagctctacactcatgtttataactactgtactagtgttcaccagtcaaaccaagcacgaggagctggagttcctccttctaagtcgaaaaaggggcagacacctggaggagctcagtttgttggcctggaattatataaacgacttaaggaatttttgaagaattacttgacaaatcttcttaaggatggagaagatttgatggatgagagtgtactgaaattctacactcaacaatgggaagattatcgattttcaagcaaagtgctgaatggaatttgtgcctacctcaatagacattgggttcgccgtgaatgtgacgaaggacgaaaaggaatatatgaaatctattcgcttgcattggtgacttggagagactgtctgttcaggccactgaataaacaggtaacaaatgctgttttaaagctgattgaaaaggaaaggaatggtgaaaccatcaatacaagattgattagtggagttgtacagtcttacgtggaattggggctgaatgaagatgatgcatttgcaaagggccctacgttaacagtgtataaagaatcctttgaatctcaatttttggctgacacagagagattttataccagagagagtactgaattcttgcagcagaacccagttactgaatatatgaaaaaggcagaggctcgtctgcttgaggaacaacgaagagttcaggtttaccttcatgaaagcacacaagatgaattagcaaggaaatgtgaacaagtcctcattgaaaaacacttggaaattttccacacagaatttcagaatttattggatgctgacaaaaatgaagatttgggacgcatgtataatcttgtatctagaatccaggatggcctaggagaattgaaaaaactgttggagacacacattcataatcagggtcttgcagccattgaaaagtgtggagaagctgctttaaatgaccccaaaatgtatgtacagacagtgcttgatgttcataaaaaatacaatgccctggtaatgtctgcattcaacaatgacgctggctttgtggctgctcttgataaggcttgtggtcgcttcataaacaacaacgcggttaccaagatggcccaatcatccagtaaatcccctgagttgctggctcgatactgtgactccttgttgaagaaaagttccaagaacccagaggaggcagaactagaagacacactcaatcaagtgatggttgtcttcaagtacatagaagacaaagacgtatttcagaagttctatgcgaagatgctcgccaagaggctcgtccaccagaacagtgcaagtgacgatgccgaagccagcatgatctccaagttaaagcaagcttgcgggttcgagtacacctctaaacttcagcgcatgtttcaagacattggcgtgagcaaagatctgaacgagcaattcaaaaagcacttgacaaactcagaacccctagacttggatttcagcattcaagtgctgagctccgggtcctggcccttccagcagtcttgtacatttgccttgccgtcagagttggaacgtagttatcagcgattcacagctttctacgccagccgccacagtggccgaaaattgacgtggttatatcagttgtctaaaggagaattggtaactaactgcttcaaaaacagatatactttgcaggcgtcgacattccagatggctatcctgcttcagtacaacacggaagatgcctacactgtgcagcagctgaccgacagcactcaaattaaaatggacattttggcgcaagttttacagattttattaaagtcgaagctattggtcttggaagatgaaaatgcaaatgttgatgaggtggaattgaagccagataccttaataaaattatatcttggttataaaaataagaaattaagggttaacatcaatgtgccaatgaaaaccgaacagaagcaggaacaagaaaccacacacaaaaacatcgaggaagaccgcaaactactgattcaggcggccatcgtgagaatcatgaagatgaggaaggttctgaaacaccagcagttacttggcgaggtcctcactcagctgtcctccaggttcaaacctcgagtccctgtgatcaagaaatgcattgacattctaattgagaaagaatatttggagcgagtggatggtgaaaaggacacctacagttacttggcttaa

SEQ ID NO: 1142 - DNA, 2848 bp, Homo sapiens
agctccaggcggggcagccccggtagctgagggacgcagctagaccttggcgggacggggctttcgccggggcccaggcccagggaccaggcggaggcgtcgcgggagcctttggggcaccacagagatgcgggtttgcctgcaatgagatttcattctctacatttaaaggacatcctttctgagctgctgtgaataaatttggaatggtactgtatattttcatctaatggagaactagctgtactttgaataaggattgctgcactggacgactttagaacatccctcacaatgtcgtcaacccggagccagaacccccacggcctgaagcagattggcctggaccagatctgggacgacctcagagccggcatccagcaggtgtacacacggcagagcatggccaagtccagatatatggagctctacactcaacaatgggaagattatcgattttcaagcaaagtgctgaatggaatttgtgcctacctcaatagacattgggttcgccgtgaatgtgacgaaggacgaaaaggaatatatgaaatctattcgcttgcattggtgacttggagagactgtctgttcaggccactgaataaacaggtaacaaatgctgttttaaagctgattgaaaaggaaaggaatggtgaaaccatcaatacaagattgattagtggagttgtacagtcttacgtggaattggggctgaatgaagatgatgcatttgcaaagggccctacgttaacagtgtataaagaatcctttgaatctcaatttttggctgacacagagagattttataccagagagagtactgaattcttgcagcagaacccagttactgaatatatgaaaaaggcagaggctcgtctgcttgaggaacaacgaagagttcaggtttaccttcatgaaagcacacaagatgaattagcaaggaaatgtgaacaagtcctcattgaaaaacacttggaaattttccacacagaatttcagaatttattggatgctgacaaaaatgaagatttgggacgcatgtataatcttgtatctagaatccaggatggcctaggagaattgaaaaaactgttggagacacacattcataatcagggtcttgcagccattgaaaagtgtggagaagctgctttaaatgaccccaaaatgtatgtacagacagtgcttgatgttcataaaaaatacaatgccctggtaatgtctgcattcaacaatgacgctggctttgtggctgctcttgataaggcttgtggtcgcttcataaacaacaacgcggttaccaagatggcccaatcatccagtaaatcccctgagttgctggctcgatactgtgactccttgttgaagaaaagttccaagaacccagaggaggcagaactagaagacacactcaatcaagtgatggttgtcttcaagtacatagaagacaaagacgtatttcagaagttctatgcgaagatgctcgccaagaggctcgtccaccagaacagtgcaagtgacgatgccgaagccagcatgatctccaagttaaagcaagcttgcgggttcgagtacacctctaaacttcagcgcatgtttcaagacattggcgtgagcaaagatctgaacgagcaattcaaaaagcacttgacaaactcagaacccctagacttggatttcagcattcaagtgctgagctccgggtcctggcccttccagcagtcttgtacatttgccttgccgtcagagttggaacgtagttatcagcgattcacagctttctacgccagccgccacagtggccgaaaattgacgtggttatatcagttgtctaaaggagaattggtaactaactgcttcaaaaacagatatactttgcaggcgtcgacattccagatggctatcctgcttcagtacaacacggaagatgcctacactgtgcagcagctgaccgacagcactcaaattaaaatggacattttggcgcaagttttacagattttattaaagtcgaagctattggtcttggaagatgaaaatgcaaatgttgatgaggtggaattgaagccagataccttaataaaattatatcttggttataaaaataagaaattaagggttaacatcaatgtgccaatgaaaaccgaacagaagcaggaacaagaaaccacacacaaaaacatcgaggaagaccgcaaactactgattcaggcggccatcgtgagaatcatgaagatgaggaaggttctgaaacaccagcagttacttggcgaggtcctcactcagctgtcctccaggttcaaacctcgagtccctgtgatcaagaaatgcattgacattctaattgagaaagaatatttggagcgagtggatggtgaaaaggacacctacagttacttggcttaacccttctggaagggtctgactgtgtgacccgcagcaaatagttcatgttggaaagaatgaaaacaactcaagttcatagcagccagcctgccgccattggacctcccttttaaaaactgagaccaagactcccatcagctggtctcggatttacatcggaactgctcaggattgatacatttcaagtctgtaaatacggacaccaacgccatttaccctaatttaagaacagcggggactgaccctccgtgccgagggctgcatgctaccgcactaagtcaatacatgggctccccgattcgcagctgtcgtcttggcagcacttgtcacgttggcagcactttgagagcaagtctgagtggacccacatgtaacctgctatgaaaaccatttgtatagtgtgtttcattttttaatgtgtgaaaataaagaaaattaaagg

SEQ ID NO: 1143 - DNA, 2930 bp, Homo sapiens
ggaggcgggcgccgtgtcgcacgcagctccaggcggggcagccccggtagctgagggacgcagctagaccttggcgggacggggctttcgccggggcccaggcccagggaccaggcggaggcgtcgcgggagcctttggggcaccacagagatgcgggtttgcctgcaatgagatttcattctctacatttaaaggacatcctttctgagctgctgtgaataaatttggaatggtactgtatattttcatctaatggagaactagctgtactttgaataaggattgctgcactggacgactttagaacatccctcacaatgtcgtcaacccggagccagaacccccacggcctgaagcagatatatggagctctacactcatgtttataactactgtactagtgttcaccagtcaaaccaagcacgaggagctggagttcctccttctaagtcgaaaaaggggcagacacctggaggagctcagtttgttggcctggaattatataaacgacttaaggaatttttgaagaattacttgacaaatcttcttaaggatggagaagatttgatggatgagagtgtactgaaattctacactcaacaatgggaagattatcgattttcaagcaaagtgctgaatggaatttgtgcctacctcaatagacattgggttcgccgtgaatgtgacgaaggacgaaaaggaatatatgaaatctattcgcttgcattggtgacttggagagactgtctgttcaggccactgaataaacaggtaacaaatgctgttttaaagctgattgaaaaggaaaggaatggtgaaaccatcaatacaagattgattagtggagttgtacagtcttacgtggaattggggctgaatgaagatgatgcatttgcaaagggccctacgttaacagtgtataaagaatcctttgaatctcaatttttggctgacacagagagattttataccagagagagtactgaattcttgcagcagaacccagttactgaatatatgaaaaaggcagaggctcgtctgcttgaggaacaacgaagagttcaggtttaccttcatgaaagcacacaagatgaattagcaaggaaatgtgaacaagtcctcattgaaaaacacttggaaattttccacacagaatttcagaatttattggatgctgacaaaaatgaagatttgggacgcatgtataatcttgtatctagaatccaggatggcctaggagaattgaaaaaactgttggagacacacattcataatcagggtcttgcagccattgaaaagtgtggagaagctgctttaaatgaccccaaaatgtatgtacagacagtgcttgatgttcataaaaaatacaatgccctggtaatgtctgcattcaacaatgacgctggctttgtggctgctcttgataaggcttgtggtcgcttcataaacaacaacgcggttaccaagatggcccaatcatccagtaaatcccctgagttgctggctcgatactgtgactccttgttgaagaaaagttccaagaacccagaggaggcagaactagaagacacactcaatcaagtgatggttgtcttcaagtacatagaagacaaagacgtatttcagaagttctatgcgaagatgctcgccaagaggctcgtccaccagaacagtgcaagtgacgatgccgaagccagcatgatctccaagttaaagcaagcttgcgggttcgagtacacctctaaacttcagcgcatgtttcaagacattggcgtgagcaaagatctgaacgagcaattcaaaaagcacttgacaaactcagaacccctagacttggatttcagcattcaagtgctgagctccgggtcctggcccttccagcagtcttgtacatttgccttgccgtcagagttggaacgtagttatcagcgattcacagctttctacgccagccgccacagtggccgaaaattgacgtggttatatcagttgtctaaaggagaattggtaactaactgcttcaaaaacagatatactttgcaggcgtcgacattccagatggctatcctgcttcagtacaacacggaagatgcctacactgtgcagcagctgaccgacagcactcaaattaaaatggacattttggcgcaagttttacagattttattaaagtcgaagctattgtaagaaattaagggttaacatcaatgtgccaatgaaaaccgaacagaagcaggaacaagaaaccacacacaaaaacatcgaggaagaccgcaaactactgattcaggcggccatcgtgagaatcatgaagatgaggaaggttctgaaacaccagcagttacttggcgaggtcctcactcagctgtcctccaggttcaaacctcgagtccctgtgatcaagaaatgcattgacattctaattgagaaagaatatttggagcgagtggatggtgaaaaggacacctacagttacttggcttaacccttctggaagggtctgactgtgtgacccgcagcaaatagttcatgttggaaagaatgaaaacaactcaagttcatagcagccagcctgccgccattggacctcccttttaaaaactgagaccaagactcccatcagctggtctcggatttacatcggaactgctcaggattgatacatttcaagtctgtaaatacggacaccaacgccatttaccctaatttaagaacagcggggactgaccctccgtgccgagggctgcatgctaccgcactaagtcaatacatgggctccccgattcgcagctgtcgtcttggcagcacttgtcacgttggcagcactttgagagcaagtctgagtggacccacatgtaacctgctatgaaaaccatttgtatagtgtgtttcattttttaatgtgtgaaaataaagaaaattaaaggat

SEQ ID NO: 1144 - DNA, 2787 bp, Homo sapiens
attgctttccgggtggcgggggggatttggcagcagcggaagaaggagaccggagggtgtgtgttgggcaaagccggaggcagaggaggacgattgttttacggatcccgtgatcggcccgtccttctcccctttccccccctccctaccgcccctgtcccgccggggagcggcggcggccttggactttgctgtctttcctcgcggagacagatttcaacactacacttgcacaatgtctttgaaaccaagagtagtagattttgatgaaacatggaacaaacttttgacgacaataaaagccgtggtcatgttggaatacgtcgaaagagcaacatggaatgaccgtttctcagatatctatgctttatgtgtggcctatcctgaaccccttggagaaagactttatacagaaactaagatttttttggaaaatcatgttcggcatttgcataagagagttttggagtcagaagaacaagtacttgttatgtatcataggtactgggaagaatacagcaagggtgcagactatatggactgcttatataggtatctcaacacccagtttattaaaaagaataaattaacagaagcggaccttcagtatggctatggtggtgtagatatgaatgaaccacttatggaaataggagagctagcattggatatgtggaggaaattgatggttgaaccacttcaggccatccttatccgaatgctgctccgagaaatcaaaaatgatcgtggtggagaagacccaaaccagaaagtaatccatggggttattaactcctttgttcatgttgaacagtataagaaaaaattccccttaaagttttatcaggaaatttttgagtctccctttctgactgaaacaggagagtattacaaacaagaagcttcaaatttattacaagaatcaaactgctcacagtatatggaaaaggttctaggtagattaaaagatgaagaaattcgatgtcgaaaatacctacatccaagttcatatactaaggtgattcatgaatgtcaacaacgaatggtagcagaccacttacagtttttacatgcagaatgtcataatataattcgacaagagaaaaaaaatgacatggcaaatatgtacgtcttactccgtgctgtgtccactggtttacctcatatgattcaggagctgcaaaaccacatccatgatgagggccttcgagcaaccagcaaccttactcaggaaaacatgccaacactatttgtggagtcagttttggaagtgcatggtaaatttgttcagcttatcaacactgttttgaatggtgatcagcattttatgagtgcgttggataaggcccttacgtcagttgtaaattacagagaacctaagtctgtttgcaaagcacctgaactgcttgctaagtactgtgacaacttactgaagaagtcagcgaaagggatgacagagaatgaagtggaagacaggctcacgagcttcatcacagtgttcaaatacattgatgacaaggacgtctttcaaaagttctacgcaagaatgctggcaaaacgtttaattcatgggttatccatgtctatggactctgaagaagccatgatcaacaaattaaagcaagcctgtggttatgagtttaccagcaagctacatcggatgtatacagatatgagtgtcagcgctgatctcaacaataagttcaacaattttatcaaaaaccaagacacagtaatagatttgggaattagttttcaaatatatgttctacaggctggtgcgtggcctcttactcaggctccttcatctacgtttgcaattccccaggaattagaaaaaagtgtacagatgtttgaattattttatagccaacatttcagtggaaggaaacttacatggttacattatctgtgtacaggtgaagttaaaatgaactatttgggcaaaccatatgtagccatggttacaacataccaaatggcagttcttcttgcctttaacaacagtgaaactgtcagttataaagagcttcaggacagcactcagatgaatgaaaaggaactgacaaaaacaatcaaatcattacttgatgtgaaaatgattaaccatgattcagaaaaggaagatattgatgcagaatcttcgttttcattaaatatgaactttagcagtaaaagaacaaaatttaaaattactacatcaatgcagaaagacacaccacaagtgattagccagtcaagagctaggtttaatcccagtatcagcatgattaagaagtgtattgaagttctgatagacaaacaatacatagaacgcagccaggcgtcggcagatgaatacagctacgtcgcgtgatgtcgctctcctccagcgtggtgtgagaagatcattgccatcaccatttggtgtgttcctgtgggaaaaagcaggactgtgcctccataatttggtcatttggcagcccctgttttctgctgtttacaacatcaccagtgccacgtcatgagcgtcaaagaaaatgcctagagatatttcaagctcatgtcattatgacatttcttaaaactttattaaaagaatgagtgaagtattgctgaaaagtggaaattcggttgggtaccatgctttttctccccttcacgtttgcagttgatgtgtctttttttttttttttaatgtatcttaaaggacataaaatttaaaaacttaaatattgtaatatgacagataacctaataattgtatctacattaaaatgacaaacatgatactgctgcttgtcaaat

SEQ ID NO: 1145 - DNA, 3903 bp, Homo sapiens
atttcaacactacacttgcacaatgtctttgaaaccaagagtagtagattttgatgaaacatggaacaaacttttgacgacaataaaagccgtggtcatgttggaatacgtcgaaagagcaacatggaatgaccgtttctcagatatctatgctttatgtgtggcctatcctgaaccccttggagaaagactttatacagaaactaagatttttttggaaaatcatgttcggcatttgcataagagagttttggagtcagaagaacaagtacttgttatgtatcataggtactgggaagaatacagcaagggtgcagactatatggactgcttatataggtatctcaacacccagtttattaaaaagaataaattaacagaagcggaccttcagtatggctatggtggtgtagatatgaatgaaccacttatggaaataggagagctagcattggatatgtggaggaaattgatggttgaaccacttcaggccatccttatccgaatgctgctccgagaaatcaaaaatgatcgtggtggagaagacccaaaccagaaagtaatccatggggttattaactcctttgttcatgttgaacagtataagaaaaaattccccttaaagttttatcaggaaatttttgagtctccctttctgactgaaacaggagagtattacaaacaagaagcttcaaatttattacaagaatcaaactgctcacagtatatggaaaaggttctaggtagattaaaagatgaagaaattcgatgtcgaaaatacctacatccaagttcatatactaaggtgattcatgaatgtcaacaacgaatggtagcagaccacttacagtttttacatgcagaatgtcataatataattcgacaagagaaaaaaaatgacatggcaaatatgtacgtcttactccgtgctgtgtccactggtttacctcatatgattcaggagctgcaaaaccacatccatgatgagggccttcgagcaaccagcaaccttactcaggaaaacatgccaacactatttgtggagtcagttttggaagtgcatggtaaatttgttcagcttatcaacactgttttgaatggtgatcagcattttatgagtgcgttggataaggcccttacgtcagttgtaaattacagagaacctaagtctgtttgcaaagcacctgaactgcttgctaagtactgtgacaacttactgaagaagtcagcgaaagggatgacagagaatgaagtggaagacaggctcacgagcttcatcacagtgttcaaatacattgatgacaaggacgtctttcaaaagttctacgcaagaatgctggcaaaacgtttaattcatgggttatccatgtctatggactctgaagaagccatgatcaacaaattaaagcaagcctgtggttatgagtttaccagcaagctacatcggatgtatacagatatgagtgtcagcgctgatctcaacaataagttcaacaattttatcaaaaaccaagacacagtaatagatttgggaattagttttcaaatatatgttctacaggctggtgcgtggcctcttactcaggctccttcatctacgtttgcaattccccaggaattagaaaaaagtgtacagatgtttgaattattttatagccaacatttcagtggaaggaaacttacatggttacattatctgtgtacaggtgaagttaaaatgaactatttgggcaaaccatatgtagccatggttacaacataccaaatggcagttcttcttgcctttaacaacagtgaaactgtcagttataaagagcttcaggacagcactcagatgaatgaaaaggaactgacaaaaacaatcaaatcattacttgatgtgaaaatgattaaccatgattcagaaaaggaagatattgatgcagaatcttcgttttcattaaatatgaactttagcagtaaaagaacaaaatttaaaattactacatcaatgcagaaagacacaccacaagtgattagccagtcaagagctaggtttaatcccagtatcagcatgattaagaagtgtattgaagttctgatagacaaacaatacatagaacgcagccaggcgtcggcagatgaatacagctacgtcgcgtgatgtcgctctcctccagcgtggtgtgagaagatcattgccatcaccatttggtgtgttcctgtgggaaaaagcaggactgtgcctccataatttggtcatttggcagcccctgttttctgctgtttacaacatcaccagtgccacgtcatgagcgtcaaagaaaatgcctagagatatttcaagctcatgtcattatgacatttcttaaaactttattaaaagaatgagtgaagtattgctgaaaagtggaaattcggttgggtaccatgctttttctccccttcacgtttgcagttgatgtgtctttttttttttttttaatgtatcttaaaggacataaaatttaaaaacttaaatattgtaatatgacagataacctaataattgtatctacattaaaatgacaaacatgatactgctgcttgtcaaataaaaaaaaaataaagaaatagaatgccttttttatgtggatggagtatcaggttgaccacaaaatatattgactcaaagcagctaatgcatctttagttgcgtttttatctgaatggtttaattcacttgtactcctatttaaatcctacatgaaaaatgtctagattattgttcttgactgcataggactgcattcagcataaagaatgctttatttttatggattagatatattggatctaaacattttgaatcttgaagatgtaattccatcagcagtttctggtggtgtgctactccacagacatcgcagagtgtgagcaggatgcttggtgacctcaagtctggcacagagagagcttttcattcaaaagttgtctttcttcggttgcataatccattaattctagcatagactagtaccctagctctgtggccttccctgagtcttaggaaatctatgataccaacatattccttctatatgcctcccctacctgttacccttacaaccctcctccaacagtttagatactagagtcactctcatcaatcacagatgtgcttagcaatgcataacctaaatacttttttaaaaaagaaaattgtacattgtactgggtgccacatatataaatcccattattttgtttattttatatatatatatatatataatatatatatatatatatctcaacagcagtgttaagagtactgcgatctattatcatatttattgtctatccacaccatcaccaccaccaccacacccctcctccctcaacatacaatttttctttattttaaaaaaaataagagacggggtttcgccatgtttcccaggctagtctggaacttctggcctcaagcaatcctatctctgtctcccaaagtgctgggattacaagcatgagccactgcatccatccaacacaaaatttttaaaatcggaatattttaaagcaaatcacacaaattatttcacttataatacttcagtaaggcctttaaaaaatccacagtgatattattactcctaacaaaaacaataattacttagtatcatctaatatgtggttcatatttaaatttgttgttttgagatgggtcttacaattggtttattcaattgcattttttctaactcgtgtctcaagtgttttaaaaatctactgaacttataatgacttatataatgtatttctcattttacctttcttccaaaagaggaaataatggcaaaccatataatattgtacattcactgtcaaaaagcaaacccttgttttgataacttgttgattgataaaagttttccaaattga

SEQ ID NO: 1146 - DNA, 4312 bp, Homo sapiens
cggcggccggccggggaggcggcctcggcgcacagtaatggcagcgctgtgagcaggggaacgcgagctgacagccgccgccgccgccgcctccgcccaccttcctcgccggggcttcgtctttcactccttcgggctgcctccccctccccttgtcccctgccccttgccctgcttctgcagaagagcgctgacccgtaagccctgccaccccctggactggatcccgggcctccccaacccgatcttggccgcctctcccgcggccccattttccttcgaaggagggaagatttcaacactacacttgcacaatgtctttgaaaccaagagtagtagattttgatgaaacatggaacaaacttttgacgacaataaaagccgtggtcatgttggaatacgtcgaaagagcaacatggaatgaccgtttctcagatatctatgctttatgtgtggcctatcctgaaccccttggagaaagactttatacagaaactaagatttttttggaaaatcatgttcggcatttgcataagagagttttggagtcagaagaacaagtacttgttatgtatcataggtactgggaagaatacagcaagggtgcagactatatggactgcttatataggtatctcaacacccagtttattaaaaagaataaattaacagaagcggaccttcagtatggctatggtggtgtagatatgaatgaaccacttatggaaataggagagctagcattggatatgtggaggaaattgatggttgaaccacttcaggccatccttatccgaatgctgctccgagaaatcaaaaatgatcgtggtggagaagacccaaaccagaaagtaatccatggggttattaactcctttgttcatgttgaacagtataagaaaaaattccccttaaagttttatcaggaaatttttgagtctccctttctgactgaaacaggagagtattacaaacaagaagcttcaaatttattacaagaatcaaactgctcacagtatatggaaaaggttctaggtagattaaaagatgaagaaattcgatgtcgaaaatacctacatccaagttcatatactaaggtgattcatgaatgtcaacaacgaatggtagcagaccacttacagtttttacatgcagaatgtcataatataattcgacaagagaaaaaaaatgacatggcaaatatgtacgtcttactccgtgctgtgtccactggtttacctcatatgattcaggagctgcaaaaccacatccatgatgagggccttcgagcaaccagcaaccttactcaggaaaacatgccaacactatttgtggagtcagttttggaagtgcatggtaaatttgttcagcttatcaacactgttttgaatggtgatcagcattttatgagtgcgttggataaggcccttacgtcagttgtaaattacagagaacctaagtctgtttgcaaagcacctgaactgcttgctaagtactgtgacaacttactgaagaagtcagcgaaagggatgacagagaatgaagtggaagacaggctcacgagcttcatcacagtgttcaaatacattgatgacaaggacgtctttcaaaagttctacgcaagaatgctggcaaaacgtttaattcatgggttatccatgtctatggactctgaagaagccatgatcaacaaattaaagcaagcctgtggttatgagtttaccagcaagctacatcggatgtatacagatatgagtgtcagcgctgatctcaacaataagttcaacaattttatcaaaaaccaagacacagtaatagatttgggaattagttttcaaatatatgttctacaggctggtgcgtggcctcttactcaggctccttcatctacgtttgcaattccccaggaattagaaaaaagtgtacagatgtttgaattattttatagccaacatttcagtggaaggaaacttacatggttacattatctgtgtacaggtgaagttaaaatgaactatttgggcaaaccatatgtagccatggttacaacataccaaatggcagttcttcttgcctttaacaacagtgaaactgtcagttataaagagcttcaggacagcactcagatgaatgaaaaggaactgacaaaaacaatcaaatcattacttgatgtgaaaatgattaaccatgattcagaaaaggaagatattgatgcagaatcttcgttttcattaaatatgaactttagcagtaaaagaacaaaatttaaaattactacatcaatgcagaaagacacaccacaagaaatggagcagactagaagtgcagttgatgaggaccggaaaatgtatctccaagctgctatagttcgtatcatgaaagcacgaaaagtgcttcggcacaatgcccttattcaagaggtgattagccagtcaagagctaggtttaatcccagtatcagcatgattaagaagtgtattgaagttctgatagacaaacaatacatagaacgcagccaggcgtcggcagatgaatacagctacgtcgcgtgatgtcgctctcctccagcgtggtgtgagaagatcattgccatcaccatttggtgtgttcctgtgggaaaaagcaggactgtgcctccataatttggtcatttggcagcccctgttttctgctgtttacaacatcaccagtgccacgtcatgagcgtcaaagaaaatgcctagagatatttcaagctcatgtcattatgacatttcttaaaactttattaaaagaatgagtgaagtattgctgaaaagtggaaattcggttgggtaccatgctttttctccccttcacgtttgcagttgatgtgtctttttttttttttttaatgtatcttaaaggacataaaatttaaaaacttaaatattgtaatatgacagataacctaataattgtatctacattaaaatgacaaacatgatactgctgcttgtcaaataaaaaaaaaataaagaaatagaatgccttttttatgtggatggagtatcaggttgaccacaaaatatattgactcaaagcagctaatgcatctttagttgcgtttttatctgaatggtttaattcacttgtactcctatttaaatcctacatgaaaaatgtctagattattgttcttgactgcataggactgcattcagcataaagaatgctttatttttatggattagatatattggatctaaacattttgaatcttgaagatgtaattccatcagcagtttctggtggtgtgctactccacagacatcgcagagtgtgagcaggatgcttggtgacctcaagtctggcacagagagagcttttcattcaaaagttgtctttcttcggttgcataatccattaattctagcatagactagtaccctagctctgtggccttccctgagtcttaggaaatctatgataccaacatattccttctatatgcctcccctacctgttacccttacaaccctcctccaacagtttagatactagagtcactctcatcaatcacagatgtgcttagcaatgcataacctaaatacttttttaaaaaagaaaattgtacattgtactgggtgccacatatataaatcccattattttgtttattttatatatatatatatatataatatatatatatatatatctcaacagcagtgttaagagtactgcgatctattatcatatttattgtctatccacaccatcaccaccaccaccacacccctcctccctcaacatacaatttttctttattttaaaaaaaataagagacggggtttcgccatgtttcccaggctagtctggaacttctggcctcaagcaatcctatctctgtctcccaaagtgctgggattacaagcatgagccactgcatccatccaacacaaaatttttaaaatcggaatattttaaagcaaatcacacaaattatttcacttataatacttcagtaaggcctttaaaaaatccacagtgatattattactcctaacaaaaacaataattacttagtatcatctaatatgtggttcatatttaaatttgttgttttgagatgggtcttacaattggtttattcaattgcattttttctaactcgtgtctcaagtgttttaaaaatctactgaacttataatgacttatataatgtatttctcattttacctttcttccaaaagaggaaataatggcaaaccatataatattgtacattcactgtcaaaaagcaaacccttgttttgataacttgttgattgataaaagttttccaaattga

SEQ ID NO: 1147 - DNA, 4208 bp, Homo sapiens
ggcggcggccggccggggaggcggcctcggcgcacagtaatggcagcgctgtgagcaggggaacgcgagctgacagccgccgccgccgccgcctccgcccaccttcctcgccggggcttcgtctttcactccttcgggctgcctccccctccccttgtcccctgccccttgccctgcttctgcagaagatttcaacactacacttgcacaatgtctttgaaaccaagagtagtagattttgatgaaacatggaacaaacttttgacgacaataaaagccgtggtcatgttggaatacgtcgaaagagcaacatggaatgaccgtttctcagatatctatgctttatgtgtggcctatcctgaaccccttggagaaagactttatacagaaactaagatttttttggaaaatcatgttcggcatttgcataagagagttttggagtcagaagaacaagtacttgttatgtatcataggtactgggaagaatacagcaagggtgcagactatatggactgcttatataggtatctcaacacccagtttattaaaaagaataaattaacagaagcggaccttcagtatggctatggtggtgtagatatgaatgaaccacttatggaaataggagagctagcattggatatgtggaggaaattgatggttgaaccacttcaggccatccttatccgaatgctgctccgagaaatcaaaaatgatcgtggtggagaagacccaaaccagaaagtaatccatggggttattaactcctttgttcatgttgaacagtataagaaaaaattccccttaaagttttatcaggaaatttttgagtctccctttctgactgaaacaggagagtattacaaacaagaagcttcaaatttattacaagaatcaaactgctcacagtatatggaaaaggttctaggtagattaaaagatgaagaaattcgatgtcgaaaatacctacatccaagttcatatactaaggtgattcatgaatgtcaacaacgaatggtagcagaccacttacagtttttacatgcagaatgtcataatataattcgacaagagaaaaaaaatgacatggcaaatatgtacgtcttactccgtgctgtgtccactggtttacctcatatgattcaggagctgcaaaaccacatccatgatgagggccttcgagcaaccagcaaccttactcaggaaaacatgccaacactatttgtggagtcagttttggaagtgcatggtaaatttgttcagcttatcaacactgttttgaatggtgatcagcattttatgagtgcgttggataaggcccttacgtcagttgtaaattacagagaacctaagtctgtttgcaaagcacctgaactgcttgctaagtactgtgacaacttactgaagaagtcagcgaaagggatgacagagaatgaagtggaagacaggctcacgagcttcatcacagtgttcaaatacattgatgacaaggacgtctttcaaaagttctacgcaagaatgctggcaaaacgtttaattcatgggttatccatgtctatggactctgaagaagccatgatcaacaaattaaagcaagcctgtggttatgagtttaccagcaagctacatcggatgtatacagatatgagtgtcagcgctgatctcaacaataagttcaacaattttatcaaaaaccaagacacagtaatagatttgggaattagttttcaaatatatgttctacaggctggtgcgtggcctcttactcaggctccttcatctacgtttgcaattccccaggaattagaaaaaagtgtacagatgtttgaattattttatagccaacatttcagtggaaggaaacttacatggttacattatctgtgtacaggtgaagttaaaatgaactatttgggcaaaccatatgtagccatggttacaacataccaaatggcagttcttcttgcctttaacaacagtgaaactgtcagttataaagagcttcaggacagcactcagatgaatgaaaaggaactgacaaaaacaatcaaatcattacttgatgtgaaaatgattaaccatgattcagaaaaggaagatattgatgcagaatcttcgttttcattaaatatgaactttagcagtaaaagaacaaaatttaaaattactacatcaatgcagaaagacacaccacaagaaatggagcagactagaagtgcagttgatgaggaccggaaaatgtatctccaagctgctatagttcgtatcatgaaagcacgaaaagtgcttcggcacaatgcccttattcaagaggtgattagccagtcaagagctaggtttaatcccagtatcagcatgattaagaagtgtattgaagttctgatagacaaacaatacatagaacgcagccaggcgtcggcagatgaatacagctacgtcgcgtgatgtcgctctcctccagcgtggtgtgagaagatcattgccatcaccatttggtgtgttcctgtgggaaaaagcaggactgtgcctccataatttggtcatttggcagcccctgttttctgctgtttacaacatcaccagtgccacgtcatgagcgtcaaagaaaatgcctagagatatttcaagctcatgtcattatgacatttcttaaaactttattaaaagaatgagtgaagtattgctgaaaagtggaaattcggttgggtaccatgctttttctccccttcacgtttgcagttgatgtgtctttttttttttttttaatgtatcttaaaggacataaaatttaaaaacttaaatattgtaatatgacagataacctaataattgtatctacattaaaatgacaaacatgatactgctgcttgtcaaataaaaaaaaaataaagaaatagaatgccttttttatgtggatggagtatcaggttgaccacaaaatatattgactcaaagcagctaatgcatctttagttgcgtttttatctgaatggtttaattcacttgtactcctatttaaatcctacatgaaaaatgtctagattattgttcttgactgcataggactgcattcagcataaagaatgctttatttttatggattagatatattggatctaaacattttgaatcttgaagatgtaattccatcagcagtttctggtggtgtgctactccacagacatcgcagagtgtgagcaggatgcttggtgacctcaagtctggcacagagagagcttttcattcaaaagttgtctttcttcggttgcataatccattaattctagcatagactagtaccctagctctgtggccttccctgagtcttaggaaatctatgataccaacatattccttctatatgcctcccctacctgttacccttacaaccctcctccaacagtttagatactagagtcactctcatcaatcacagatgtgcttagcaatgcataacctaaatacttttttaaaaaagaaaattgtacattgtactgggtgccacatatataaatcccattattttgtttattttatatatatatatatatataatatatatatatatatatctcaacagcagtgttaagagtactgcgatctattatcatatttattgtctatccacaccatcaccaccaccaccacacccctcctccctcaacatacaatttttctttattttaaaaaaaataagagacggggtttcgccatgtttcccaggctagtctggaacttctggcctcaagcaatcctatctctgtctcccaaagtgctgggattacaagcatgagccactgcatccatccaacacaaaatttttaaaatcggaatattttaaagcaaatcacacaaattatttcacttataatacttcagtaaggcctttaaaaaatccacagtgatattattactcctaacaaaaacaataattacttagtatcatctaatatgtggttcatatttaaatttgttgttttgagatgggtcttacaattggtttattcaattgcattttttctaactcgtgtctcaagtgttttaaaaatctactgaacttataatgacttatataatgtatttctcattttacctttcttccaaaagaggaaataatggcaaaccatataatattgtacattcactgtcaaaaagcaaacccttgttttgataacttgttgattgataaaagttttccaaattga

SEQ ID NO: 1148 - DNA, 4233 bp, Homo sapiens
attgctttccgggtggcgggggggatttggcagcagcggaagaaggagaccggagggtgtgtgttgggcaaagccggaggcagaggaggacgattgttttacggatcccgtgatcggcccgtccttctcccctttccccccctccctaccgcccctgtcccgccggggagcggcggcggccttggactttgctgtctttcctcgcggagacagatttcaacactacacttgcacaatgtctttgaaaccaagagtagtagattttgatgaaacatggaacaaacttttgacgacaataaaagccgtggtcatgttggaatacgtcgaaagagcaacatggaatgaccgtttctcagatatctatgctttatgtgtggcctatcctgaaccccttggagaaagactttatacagaaactaagatttttttggaaaatcatgttcggcatttgcataagagagttttggagtcagaagaacaagtacttgttatgtatcataggtactgggaagaatacagcaagggtgcagactatatggactgcttatataggtatctcaacacccagtttattaaaaagaataaattaacagaagcggaccttcagtatggctatggtggtgtagatatgaatgaaccacttatggaaataggagagctagcattggatatgtggaggaaattgatggttgaaccacttcaggccatccttatccgaatgctgctccgagaaatcaaaaatgatcgtggtggagaagacccaaaccagaaagtaatccatggggttattaactcctttgttcatgttgaacagtataagaaaaaattccccttaaagttttatcaggaaatttttgagtctccctttctgactgaaacaggagagtattacaaacaagaagcttcaaatttattacaagaatcaaactgctcacagtatatggaaaaggttctaggtagattaaaagatgaagaaattcgatgtcgaaaatacctacatccaagttcatatactaaggtgattcatgaatgtcaacaacgaatggtagcagaccacttacagtttttacatgcagaatgtcataatataattcgacaagagaaaaaaaatgacatggcaaatatgtacgtcttactccgtgctgtgtccactggtttacctcatatgattcaggagctgcaaaaccacatccatgatgagggccttcgagcaaccagcaaccttactcaggaaaacatgccaacactatttgtggagtcagttttggaagtgcatggtaaatttgttcagcttatcaacactgttttgaatggtgatcagcattttatgagtgcgttggataaggcccttacgtcagttgtaaattacagagaacctaagtctgtttgcaaagcacctgaactgcttgctaagtactgtgacaacttactgaagaagtcagcgaaagggatgacagagaatgaagtggaagacaggctcacgagcttcatcacagtgttcaaatacattgatgacaaggacgtctttcaaaagttctacgcaagaatgctggcaaaacgtttaattcatgggttatccatgtctatggactctgaagaagccatgatcaacaaattaaagcaagcctgtggttatgagtttaccagcaagctacatcggatgtatacagatatgagtgtcagcgctgatctcaacaataagttcaacaattttatcaaaaaccaagacacagtaatagatttgggaattagttttcaaatatatgttctacaggctggtgcgtggcctcttactcaggctccttcatctacgtttgcaattccccaggaattagaaaaaagtgtacagatgtttgaattattttatagccaacatttcagtggaaggaaacttacatggttacattatctgtgtacaggtgaagttaaaatgaactatttgggcaaaccatatgtagccatggttacaacataccaaatggcagttcttcttgcctttaacaacagtgaaactgtcagttataaagagcttcaggacagcactcagatgaatgaaaaggaactgacaaaaacaatcaaatcattacttgatgtgaaaatgattaaccatgattcagaaaaggaagatattgatgcagaatcttcgttttcattaaatatgaactttagcagtaaaagaacaaaatttaaaattactacatcaatgcagaaagacacaccacaagaaatggagcagactagaagtgcagttgatgaggaccggaaaatgtatctccaagctgctatagttcgtatcatgaaagcacgaaaagtgcttcggcacaatgcccttattcaagaggtgattagccagtcaagagctaggtttaatcccagtatcagcatgattaagaagtgtattgaagttctgatagacaaacaatacatagaacgcagccaggcgtcggcagatgaatacagctacgtcgcgtgatgtcgctctcctccagcgtggtgtgagaagatcattgccatcaccatttggtgtgttcctgtgggaaaaagcaggactgtgcctccataatttggtcatttggcagcccctgttttctgctgtttacaacatcaccagtgccacgtcatgagcgtcaaagaaaatgcctagagatatttcaagctcatgtcattatgacatttcttaaaactttattaaaagaatgagtgaagtattgctgaaaagtggaaattcggttgggtaccatgctttttctccccttcacgtttgcagttgatgtgtctttttttttttttttaatgtatcttaaaggacataaaatttaaaaacttaaatattgtaatatgacagataacctaataattgtatctacattaaaatgacaaacatgatactgctgcttgtcaaataaaaaaaaaataaagaaatagaatgccttttttatgtggatggagtatcaggttgaccacaaaatatattgactcaaagcagctaatgcatctttagttgcgtttttatctgaatggtttaattcacttgtactcctatttaaatcctacatgaaaaatgtctagattattgttcttgactgcataggactgcattcagcataaagaatgctttatttttatggattagatatattggatctaaacattttgaatcttgaagatgtaattccatcagcagtttctggtggtgtgctactccacagacatcgcagagtgtgagcaggatgcttggtgacctcaagtctggcacagagagagcttttcattcaaaagttgtctttcttcggttgcataatccattaattctagcatagactagtaccctagctctgtggccttccctgagtcttaggaaatctatgataccaacatattccttctatatgcctcccctacctgttacccttacaaccctcctccaacagtttagatactagagtcactctcatcaatcacagatgtgcttagcaatgcataacctaaatacttttttaaaaaagaaaattgtacattgtactgggtgccacatatataaatcccattattttgtttattttatatatatatatatatataatatatatatatatatatctcaacagcagtgttaagagtactgcgatctattatcatatttattgtctatccacaccatcaccaccaccaccacacccctcctccctcaacatacaatttttctttattttaaaaaaaataagagacggggtttcgccatgtttcccaggctagtctggaacttctggcctcaagcaatcctatctctgtctcccaaagtgctgggattacaagcatgagccactgcatccatccaacacaaaatttttaaaatcggaatattttaaagcaaatcacacaaattatttcacttataatacttcagtaaggcctttaaaaaatccacagtgatattattactcctaacaaaaacaataattacttagtatcatctaatatgtggttcatatttaaatttgttgttttgagatgggtcttacaattggtttattcaattgcattttttctaactcgtgtctcaagtgttttaaaaatctactgaacttataatgacttatataatgtatttctcattttacctttcttccaaaagaggaaataatggcaaaccatataatattgtacattcactgtcaaaaagcaaacccttgttttgataacttgttgattgataaaagttttccaaattga

SEQ ID NO: 1149 - DNA, 4189 bp, Homo sapiens
attgctttccgggtggcgggggggatttggcagcagcggaagaaggagaccggagggtgtgtgttgggcaaagccggaggcagaggaggacgattgttttacggatcccgtgatcggcccgtccttctcccctttccccccctccctaccgcccctgtcccgccggggagcggcggcggccttggactttgctgtctttcctcgcggagacagatttcaacactacacttgcacaatgtctttgaaaccaagagtagtagattttgatgaaacatggaacaaacttttgacgacaataaaagccgtggtcatgttggaatacgtcgaaagagcaacatggaatgaccgtttctcagatatctatgctttatgtgtggcctatcctgaaccccttggagaaagactttatacagaaactaagatttttttggaaaatcatgttcggcatttgcataaggtactgggaagaatacagcaagggtgcagactatatggactgcttatataggtatctcaacacccagtttattaaaaagaataaattaacagaagcggaccttcagtatggctatggtggtgtagatatgaatgaaccacttatggaaataggagagctagcattggatatgtggaggaaattgatggttgaaccacttcaggccatccttatccgaatgctgctccgagaaatcaaaaatgatcgtggtggagaagacccaaaccagaaagtaatccatggggttattaactcctttgttcatgttgaacagtataagaaaaaattccccttaaagttttatcaggaaatttttgagtctccctttctgactgaaacaggagagtattacaaacaagaagcttcaaatttattacaagaatcaaactgctcacagtatatggaaaaggttctaggtagattaaaagatgaagaaattcgatgtcgaaaatacctacatccaagttcatatactaaggtgattcatgaatgtcaacaacgaatggtagcagaccacttacagtttttacatgcagaatgtcataatataattcgacaagagaaaaaaaatgacatggcaaatatgtacgtcttactccgtgctgtgtccactggtttacctcatatgattcaggagctgcaaaaccacatccatgatgagggccttcgagcaaccagcaaccttactcaggaaaacatgccaacactatttgtggagtcagttttggaagtgcatggtaaatttgttcagcttatcaacactgttttgaatggtgatcagcattttatgagtgcgttggataaggcccttacgtcagttgtaaattacagagaacctaagtctgtttgcaaagcacctgaactgcttgctaagtactgtgacaacttactgaagaagtcagcgaaagggatgacagagaatgaagtggaagacaggctcacgagcttcatcacagtgttcaaatacattgatgacaaggacgtctttcaaaagttctacgcaagaatgctggcaaaacgtttaattcatgggttatccatgtctatggactctgaagaagccatgatcaacaaattaaagcaagcctgtggttatgagtttaccagcaagctacatcggatgtatacagatatgagtgtcagcgctgatctcaacaataagttcaacaattttatcaaaaaccaagacacagtaatagatttgggaattagttttcaaatatatgttctacaggctggtgcgtggcctcttactcaggctccttcatctacgtttgcaattccccaggaattagaaaaaagtgtacagatgtttgaattattttatagccaacatttcagtggaaggaaacttacatggttacattatctgtgtacaggtgaagttaaaatgaactatttgggcaaaccatatgtagccatggttacaacataccaaatggcagttcttcttgcctttaacaacagtgaaactgtcagttataaagagcttcaggacagcactcagatgaatgaaaaggaactgacaaaaacaatcaaatcattacttgatgtgaaaatgattaaccatgattcagaaaaggaagatattgatgcagaatcttcgttttcattaaatatgaactttagcagtaaaagaacaaaatttaaaattactacatcaatgcagaaagacacaccacaagaaatggagcagactagaagtgcagttgatgaggaccggaaaatgtatctccaagctgctatagttcgtatcatgaaagcacgaaaagtgcttcggcacaatgcccttattcaagaggtgattagccagtcaagagctaggtttaatcccagtatcagcatgattaagaagtgtattgaagttctgatagacaaacaatacatagaacgcagccaggcgtcggcagatgaatacagctacgtcgcgtgatgtcgctctcctccagcgtggtgtgagaagatcattgccatcaccatttggtgtgttcctgtgggaaaaagcaggactgtgcctccataatttggtcatttggcagcccctgttttctgctgtttacaacatcaccagtgccacgtcatgagcgtcaaagaaaatgcctagagatatttcaagctcatgtcattatgacatttcttaaaactttattaaaagaatgagtgaagtattgctgaaaagtggaaattcggttgggtaccatgctttttctccccttcacgtttgcagttgatgtgtctttttttttttttttaatgtatcttaaaggacataaaatttaaaaacttaaatattgtaatatgacagataacctaataattgtatctacattaaaatgacaaacatgatactgctgcttgtcaaataaaaaaaaaataaagaaatagaatgccttttttatgtggatggagtatcaggttgaccacaaaatatattgactcaaagcagctaatgcatctttagttgcgtttttatctgaatggtttaattcacttgtactcctatttaaatcctacatgaaaaatgtctagattattgttcttgactgcataggactgcattcagcataaagaatgctttatttttatggattagatatattggatctaaacattttgaatcttgaagatgtaattccatcagcagtttctggtggtgtgctactccacagacatcgcagagtgtgagcaggatgcttggtgacctcaagtctggcacagagagagcttttcattcaaaagttgtctttcttcggttgcataatccattaattctagcatagactagtaccctagctctgtggccttccctgagtcttaggaaatctatgataccaacatattccttctatatgcctcccctacctgttacccttacaaccctcctccaacagtttagatactagagtcactctcatcaatcacagatgtgcttagcaatgcataacctaaatacttttttaaaaaagaaaattgtacattgtactgggtgccacatatataaatcccattattttgtttattttatatatatatatatatataatatatatatatatatatctcaacagcagtgttaagagtactgcgatctattatcatatttattgtctatccacaccatcaccaccaccaccacacccctcctccctcaacatacaatttttctttattttaaaaaaaataagagacggggtttcgccatgtttcccaggctagtctggaacttctggcctcaagcaatcctatctctgtctcccaaagtgctgggattacaagcatgagccactgcatccatccaacacaaaatttttaaaatcggaatattttaaagcaaatcacacaaattatttcacttataatacttcagtaaggcctttaaaaaatccacagtgatattattactcctaacaaaaacaataattacttagtatcatctaatatgtggttcatatttaaatttgttgttttgagatgggtcttacaattggtttattcaattgcattttttctaactcgtgtctcaagtgttttaaaaatctactgaacttataatgacttatataatgtatttctcattttacctttcttccaaaagaggaaataatggcaaaccatataatattgtacattcactgtcaaaaagcaaacccttgttttgataacttgttgattgataaaagttttccaaattga

SEQ ID NO: 1150 - DNA, 767 bp, Homo sapiens
gttgcagttgagcccaaactgaatgctgtctgtagaaggaaacaacaaactttgtactttatgtacagagtaacatggtcaactttttggcttagatttcaacactacacttgcacaatgtctttgaaaccaagagtagtagattttgatgaaacatggaacaaacttttgacgacaataaaagccgtggtcatgttggaatacgtcgaaagagcaacatggaatgaccgtttctcagatatctatgctttatgtgtggcctatcctgaaccccttggagaaagactttatacagaaactaagatttttttggaaaatcatgttcggcatttgcataagagagttttggagtcagaagaacaagtacttgttatgtatcataggtactgggaagaatacagcaagggtgcagactatatggactgcttatataggtatctcaacacccagtttattaaaaagaataaattaacagaagcggaccttcagtatggctatggtggtgtagatatgaatgaaccacttatggaaataggagagctagcattggatatgtggaggaaattgatggttgaaccacttcaggccatccttatccgaatgctgctccgagaaatcaaaaatgatcgtggtggagaagacccaaaccagaaagtaatccatggggttattaactcctttgttcatgttgaacagtataagaaaaaattccccttaaagttttatcaggaaatttttgagtctccctttctgactgaaacaggaga

SEQ ID NO: 1151 - DNA, 2376 bp, Homo sapiens
atgttgcagttgagcccaaactgaatgctgtctgtagaaggaaacaacaaactttgtactttatgtacagagtaacatggtcaactttttggcttagatttcaacactacacttgcacaatgtctttgaaaccaagagtagtagattttgatgaaacatggaacaaacttttgacgacaataaaagccgtggtcatgttggaatacgtcgaaagagcaacatggaatgaccgtttctcagatatctatgctttatgtgtggcctatcctgaaccccttggagaaagactttatacagaaactaagatttttttggaaaatcatgttcggcatttgcataagagagttttggagtcagaagaacaagtacttgttatgtatcataggtactgggaagaatacagcaagggtgcagactatatggactgcttatataggtatctcaacacccagtttattaaaaagaataaattaacagaagcggaccttcagtatggctatggtggtgtagatatgaatgaaccacttatggaaataggagagctagcattggatatgtggaggaaattgatggttgaaccacttcaggccatccttatccgaatgctgctccgagaaatcaaaaatgatcgtggtggagaagacccaaaccagaaagtaatccatggggttattaactcctttgttcatgttgaacagtataagaaaaaattccccttaaagttttatcaggaaatttttgagtctccctttctgactgaaacaggagagtattacaaacaagaagcttcaaatttattacaagaatcaaactgctcacagtatatggaaaaggttctaggtagattaaaagatgaagaaattcgatgtcgaaaatacctacatccaagttcatatactaaggtgattcatgaatgtcaacaacgaatggtagcagaccacttacagtttttacatgcagaatgtcataatataattcgacaagagaaaaaaaatgacatggcaaatatgtacgtcttactccgtgctgtgtccactggtttacctcatatgattcaggagctgcaaaaccacatccatgatgagggccttcgagcaaccagcaaccttactcaggaaaacatgccaacactatttgtggagtcagttttggaagtgcatggtaaatttgttcagcttatcaacactgttttgaatggtgatcagcattttatgagtgcgttggataaggcccttacgtcagttgtaaattacagagaacctaagtctgtttgcaaagcacctgaactgcttgctaagtactgtgacaacttactgaagaagtcagcgaaagggatgacagagaatgaagtggaagacaggctcacgagcttcatcacagtgttcaaatacattgatgacaaggacgtctttcaaaagttctacgcaagaatgctggcaaaacgtttaattcatgggttatccatgtctatggactctgaagaagccatgatcaacaaattaaagcaagcctgtggttatgagtttaccagcaagctacatcggatgtatacagatatgagtgtcagcgctgatctcaacaataagttcaacaattttatcaaaaaccaagacacagtaatagatttgggaattagttttcaaatatatgttctacaggctggtgcgtggcctcttactcaggctccttcatctacgtttgcaattccccaggaattagaaaaaagtgtacagatgtttgaattattttatagccaacatttcagtggaaggaaacttacatggttacattatctgtgtacaggtgaagttaaaatgaactatttgggcaaaccatatgtagccatggttacaacataccaaatggcagttcttcttgcctttaacaacagtgaaactgtcagttataaagagcttcaggacagcactcagatgaatgaaaaggaactgacaaaaacaatcaaatcattacttgatgtgaaaatgattaaccatgattcagaaaaggaagatattgatgcagaatcttcgttttcattaaatatgaactttagcagtaaaagaacaaaatttaaaattactacatcaatgcagaaagacacaccacaagaaatggagcagactagaagtgcagttgatgaggaccggaaaatgtatctccaagctgctatagttcgtatcatgaaagcacgaaaagtgcttcggcacaatgcccttattcaagaggtgattagccagtcaagagctaggtttaatcccagtatcagcatgattaagaagtgtattgaagttctgatagacaaacaatacatagaacgcagccaggcgtcggcagatgaatacagctacgtcgcgtgatgtcgctctcctccagcgt

SEQ ID NO: 1152 - DNA, 6741 bp, Homo sapiens
cctgcgcagtgagatgtttgtccgtcgccgccgccgccgccatcgcggaggagcgcgataaagggagccgagccggacgtgagggggaccccgcggagccgccgcgccagcgcagccccccagccgcatcggagtcgccagagtccgagccgccgccgccgccgccgccgcccccgccgccgccgcggctgcccaggggccggccagctccccagccctgcccgggggtcgcgccgccgccgcccccagcgtcgcccctagcctgcctgcccgccttaaatgtgacaccggcgtcgcggagcgcgacctgaagccgccgccggggaggggacgagcaccatgtcgaatctgagcaaaggcacgggcagccggaaggacaccaagatgcggatccgggcctttccgatgaccatggatgaaaaatatgtaaacagcatttgggaccttctgaaaaatgcaattcaagaaatccagcgtaagaataacagtggtcttagttttgaggagctctatagaaatgcatatacaatggttttgcataaacatggagaaaagctctacactggactaagagaagttgttaccgaacatctcataaataaggtgcgagaagatgtactaaattcattgaataacaactttcttcaaacgctaaatcaagcttggaatgatcatcaaacagctatggtgatgattagagacatactaatgtacatggaccgtgtgtatgtacaacaaaataatgtggagaacgtctacaatttgggattaattatttttcgagatcaagttgtacgttatgggtgtattagggatcatctacggcaaactctattggatatgattgcaagagagcggaaaggagaagtcgtagacagaggcgcaataagaaatgcttgccagatgttaatgattttaggtctcgaaggaagatcagtctatgaagaagattttgaggctccttttttggaaatgtctgcagaattttttcagatggaaagccagaaatttttagcagaaaatagtgcttcagtatatataaagaaagtagaagctagaattaatgaagaaatagaacgagtgatgcactgccttgacaaatcaacggaagaaccaattgtaaaggtggttgaaagggaactcatttccaagcacatgaagactatagtagaaatggagaattctgggctagtacatatgttgaaaaatggaaagacagaagaccttggttgcatgtacaagttatttagtcgtgtgccaaatggtttgaaaacaatgtgtgagtgtatgagttcctatttgagggagcaaggtaaagctcttgtttctgaagaaggagaaggaaagaatcctgttgactatatccagggcttattggatctgaagagtaggttcgatcgcttcctcctggaatcattcaacaatgaccgtctctttaaacaaactattgcgggtgactttgagtattttctcaacctcaactccaggtctcctgaatacctctcattatttattgatgataagctgaaaaagggagtcaaagggctaacagaacaagaagtagaaacaatattggataaagcaatggtcctttttaggtttatgcaagaaaaagatgtatttgaacgttattataaacaacacttggcaaggagacttctcacaaataaaagtgtttctgatgactctgaaaaaaacatgatatctaagttaaagactgaatgtggatgtcagttcacgtcaaaactggaaggaatgtttagggatatgagcatctcaaacacaacgatggatgaattcaggcaacatctacaggcaactggtgtatctttaggtggtgttgatcttacagtccgggtgctcacgacaggatattggcccactcagtcagccacaccaaagtgcaacatcccaccagcaccaagacatgcttttgagatattcagaaggttctacttagccaaacacagtggtcgacagctcacactccagcatcatatgggttctgcagatctcaatgccacattttatggaccagttaaaaaggaagatggatctgaagttggtgttggaggtgcacaagtaactggctctaatacacggaagcacatattgcaagtttccactttccagatgaccatattaatgctctttaataatagagaaaaatacacatttgaggaaattcagcaagagacagatatccctgaaagagagcttgttagagccctacagtccctcgcctgtggtaaaccaacacagcgggttcttacaaaagaacccaaatcaaaggaaatagaaaatggtcatatatttacagttaatgatcaattcacatccaaactacacagagtcaagattcaaacagttgctgccaaacaaggtgaatccgacccagagaggaaagaaacaaggcagaaagtagacgacgacagaaaacatgagatagaagctgctatagtgcggataatgaaatctagaaagaagatgcagcacaatgttctagtagcggaggtaactcagcagttgaaggcgcgattcttaccaagtccagttgttattaagaaacgtattgaaggacttattgagagagaatatttggcacgaacacctgaggatcgcaaagtatacacatatgtagcataaaatgcgttcagaaatttgatttattcttggactgtactcttcgcatggactgggaagttcttttaaatcattaaatattaagacgaccatctcttctattaaattacagtacatgttctagaccattgagatcaagcctttactccctttgagagtttccaacatcagttgattgagcttcaggctttacaacgtttatccctgtagagatcatctttacagttcctcgggaaaatgtgaatgtgctgcgttttgttttctttactgtatgaaaacaggaaaataaaagagaaatttagaaaatacagctcattacaataaaattgttggatttcatttccccaggtcttcagtgttgatgtaaatgtgttttgtagtgttgcttagcactttgcgcattgtgtaagttgggtaacaaaaatggcaaaagaaatgcagatttcccagttatcttgctctgaagacatttctttagctagtcttatttaattttaaaggtttgataaatatacaaagacccaagcatacaatttgagcatgctgtattctaccacttgcacttactcatcttctagccttatgaccaggaacctttgttttgggctcaagtacacatcctgatttggtttctccctgttgtaatttgagatttcccaaattaagtcttataatgattaggttttgttctgagttatttctagagaaagaaagtattttagtatgtgtaaattgtacaataatttttttgctgttgtactcactgctaatagtggattgtatagggtggtgtttttatttcatttattgtagacaaaaataatgaatttagtatacacatacccactaattcaagtatgtcagagcacaaagttggcagctggttatatttaattcagcccctctgaaaagcacatacagtctatactttgtttataaataccctaggtcctccctgcccctaaatatatattttggtgaagctgtggtgcactattaattttctgtttcaaaatgcaatctaaagatgcaataaatatgatgaccttgatagttttaatgaaatcttcaattcttgcagctgtgttttggaaagtgattaagcaatatttctcaaacctgatgattcttggatatttagctattgtcctccaaagagtcatcgtttcacgttttcaaacatgtgctttgtgctgaagattcttgtcagatatcctgtgcttccagagtatttttatcttcaattttatttaattttgtttcattttgttttcataagacaatgtttcagatatgtaatggggcaaaccactatagatttctgttggatagaaaaatgaaatgttactaataagtttaaattgacccttcgttgactatcagtactgttgatacatttattagaatgtatgtctcagaagatggtttctgtttaaatttatggtcaagttacaacaactgaattctaatatggattaaaaactccacataaatatttttccccatgcgtcttgggttataattttccttttagacttgcaaatatgcttttattgcaattttgtctccatctgtactgtagaattacaagccttgtgctctttatctctacattttccacttctacatgatgcaattaagatgccaatgaaaagtattgtgaacattattctcaggacacttttaccatacttgagtagtactaagtcaggtgtaacatggaaagctaagggtttcaccttctgattttgacataattggaaattttctataatggtaagatgtttataggaaagtaatggtagttcatgtttgagaatttttttattgctttcatttcccagttaaatgatatttaacacctgggaaaacaggacagctcagattgtcgagttagtaaacatgagcgatgtaaaaactttatttgaaatctcctaagtgagacattaaacattttagtgctagtttaagccattaaaagtaaagtttaagtttacgtcattgtctcaagtgtggctgtaaaaatcagatctagagtttagagacatacttgttaactttggagcacaggtttgatatttatgcttctaaatacattaaaacatttctgaattgcagttgaatggttggagattgctggcgatgtgatgctgcactgaaaaaactggtcacacaaaatgtttatatgtttgactgcataagtattattttaggtcataaaggttataacaaaatacatttaacattgctttctttttagcaagaggtcacagatgctattttttctcagtttttaatgctttaatttgaaagaaaaatgcatcctaaccattccatcctgttggtgcagagaaattttggtgatttattagaagacttttaaggagggtggatacatagtttttcaactgcaaaaatcatgtcatctcttcagtaactgttaaagtgtaattctctgccttcattatcaagtccaggacagtgtttattttgaatcgttaacattatttaaagactgaaaattcattgcaattagggaacgcacagcctcacaaaaagtggttgtgattgcaaggattctttatgtcagtgaacttaaaaagggaatgggggaagagatgcatgcctttctaaaggtatgctagagtcacctgtgtagcattgtaattatgtactatcaaacccccaagatgctgatgataggccttctctgtaagaatccttctcatagtgaagcactgttgatgttttgttcaccggatatgttgggtagcagaaaaggcctagaaccagttttaagattatgcctacatctctagaagactagtacactggcatcatcttaggtttctaaatattatttaattccttaatttggaaagcagttttaatgtttacagtttaagatactcattttcagtaactagtgttaaagatttttatctttgcctgtctactgtaacttaagactttcatagaataattttttatagagtatatggtatattgtgtcaatcttggaaggaaagctgttgcatatcaattgtaggtcatgtattttactatatgttgcatagtattttgcattctgtaaatacgaatgttaaaacatttcaggtcagcaaaattagaagtcatttctagtcctcaaagcagaaataattagaaatgttaacatttaagtgcttatcatatgccagatactattctgaatattttatgtatattcattcatttagttgtcatattggctttatgtgacataactgtcattataccagtgttgtccaaggttgctagcaggaaatggcagagccaggagttggacctaggtttaatcctatccatattccatgttacaaattgacatgattttccatattaaaaaattttcatttattttgtacctcattcacatgaatagtaatgtgacaaactaaagttaatacatgaagcattgcaatatggaattttgcacatttttgttagctttacattatttgctgataccaacttttggtaggaaggaaaacagggaaggtgattgctgctattctggaatgtgtccattgaaaagaaaataggcgctttgtctcctacaatcttagagaaagttttacatacttaagtgggtaccacagataggcatgtaccttaaattcaaatctacagttttacaaaatgttttcctttgtgtgcctttcctatgtcaaattagccagaaggaagaagagacgttaagaatggcagataaatttaacaggtaatgatacagagattggccattacgccagctctcaggagaaaaacaactaggatgtcttgaaacccgtgcatttaattttagaaatggcaaatttgtaagcgtgtcatttaagtaatttgatgctcagttttagggtctaagttgacctcgagtgagccatgcaaaaatagctttaaaattatacatgagcagctcaaagtaaacgtgtattttttagtaacaatgaaattgtcaaatttcaagattttaataacaggacagttcaactaataaactttattgcatacaagatttattgcaatgtgggaaaattaaaattctcagtctcagaa

SEQ ID NO: 1153 - DNA, 6586 bp, Homo sapiens
gctcaggcggaggaggagaaggaggaggaggaggacgacgttcggcctgcgcagtgagatgtttgtccgtcgccgccgccgccgccatcgcggaggagcgcgataaagggagccgagccggacgtgagggggaccccgcggagccgccgcgccagcgcagccccccagccgcatcggagtcgccagagtccgagccgccgccgccgccgccgccgcccccgccgccgccgcggctgcccaggggccggccagctccccagccctgcccgggggtcgcgccgccgccgcccccagcgtcgcccctagcctgcctgcccgccttaaatgtgacaccggcgtcgcggagcgcgacctgaagccgccgccggggaggggacgagcaccatgtcgaatctgagcaaaggcacgggcagccggaaggacaccaagatgcggatccgggcctttccggtgcgagaagatgtactaaattcattgaataacaactttcttcaaacgctaaatcaagcttggaatgatcatcaaacagctatggtgatgattagagacatactaatgtacatggaccgtgtgtatgtacaacaaaataatgtggagaacgtctacaatttgggattaattatttttcgagatcaagttgtacgttatgggtgtattagggatcatctacggcaaactctattggatatgattgcaagagagcggaaaggagaagtcgtagacagaggcgcaataagaaatgcttgccagatgttaatgattttaggtctcgaaggaagatcagtctatgaagaagattttgaggctccttttttggaaatgtctgcagaattttttcagatggaaagccagaaatttttagcagaaaatagtgcttcagtatatataaagaaagtagaagctagaattaatgaagaaatagaacgagtgatgcactgccttgacaaatcaacggaagaaccaattgtaaaggtggttgaaagggaactcatttccaagcacatgaagactatagtagaaatggagaattctgggctagtacatatgttgaaaaatggaaagacagaagaccttggttgcatgtacaagttatttagtcgtgtgccaaatggtttgaaaacaatgtgtgagtgtatgagttcctatttgagggagcaaggtaaagctcttgtttctgaagaaggagaaggaaagaatcctgttgactatatccagggcttattggatctgaagagtaggttcgatcgcttcctcctggaatcattcaacaatgaccgtctctttaaacaaactattgcgggtgactttgagtattttctcaacctcaactccaggtctcctgaatacctctcattatttattgatgataagctgaaaaagggagtcaaagggctaacagaacaagaagtagaaacaatattggataaagcaatggtcctttttaggtttatgcaagaaaaagatgtatttgaacgttattataaacaacacttggcaaggagacttctcacaaataaaagtgtttctgatgactctgaaaaaaacatgatatctaagttaaagactgaatgtggatgtcagttcacgtcaaaactggaaggaatgtttagggatatgagcatctcaaacacaacgatggatgaattcaggcaacatctacaggcaactggtgtatctttaggtggtgttgatcttacagtccgggtgctcacgacaggatattggcccactcagtcagccacaccaaagtgcaacatcccaccagcaccaagacatgcttttgagatattcagaaggttctacttagccaaacacagtggtcgacagctcacactccagcatcatatgggttctgcagatctcaatgccacattttatggaccagttaaaaaggaagatggatctgaagttggtgttggaggtgcacaagtaactggctctaatacacggaagcacatattgcaagtttccactttccagatgaccatattaatgctctttaataatagagaaaaatacacatttgaggaaattcagcaagagacagatatccctgaaagagagcttgttagagccctacagtccctcgcctgtggtaaaccaacacagcgggttcttacaaaagaacccaaatcaaaggaaatagaaaatggtcatatatttacagttaatgatcaattcacatccaaactacacagagtcaagattcaaacagttgctgccaaacaaggtgaatccgacccagagaggaaagaaacaaggcagaaagtagacgacgacagaaaacatgagatagaagctgctatagtgcggataatgaaatctagaaagaagatgcagcacaatgttctagtagcggaggtaactcagcagttgaaggcgcgattcttaccaagtccagttgttattaagaaacgtattgaaggacttattgagagagaatatttggcacgaacacctgaggatcgcaaagtatacacatatgtagcataaaatgcgttcagaaatttgatttattcttggactgtactcttcgcatggactgggaagttcttttaaatcattaaatattaagacgaccatctcttctattaaattacagtacatgttctagaccattgagatcaagcctttactccctttgagagtttccaacatcagttgattgagcttcaggctttacaacgtttatccctgtagagatcatctttacagttcctcgggaaaatgtgaatgtgctgcgttttgttttctttactgtatgaaaacaggaaaataaaagagaaatttagaaaatacagctcattacaataaaattgttggatttcatttccccaggtcttcagtgttgatgtaaatgtgttttgtagtgttgcttagcactttgcgcattgtgtaagttgggtaacaaaaatggcaaaagaaatgcagatttcccagttatcttgctctgaagacatttctttagctagtcttatttaattttaaaggtttgataaatatacaaagacccaagcatacaatttgagcatgctgtattctaccacttgcacttactcatcttctagccttatgaccaggaacctttgttttgggctcaagtacacatcctgatttggtttctccctgttgtaatttgagatttcccaaattaagtcttataatgattaggttttgttctgagttatttctagagaaagaaagtattttagtatgtgtaaattgtacaataatttttttgctgttgtactcactgctaatagtggattgtatagggtggtgtttttatttcatttattgtagacaaaaataatgaatttagtatacacatacccactaattcaagtatgtcagagcacaaagttggcagctggttatatttaattcagcccctctgaaaagcacatacagtctatactttgtttataaataccctaggtcctccctgcccctaaatatatattttggtgaagctgtggtgcactattaattttctgtttcaaaatgcaatctaaagatgcaataaatatgatgaccttgatagttttaatgaaatcttcaattcttgcagctgtgttttggaaagtgattaagcaatatttctcaaacctgatgattcttggatatttagctattgtcctccaaagagtcatcgtttcacgttttcaaacatgtgctttgtgctgaagattcttgtcagatatcctgtgcttccagagtatttttatcttcaattttatttaattttgtttcattttgttttcataagacaatgtttcagatatgtaatggggcaaaccactatagatttctgttggatagaaaaatgaaatgttactaataagtttaaattgacccttcgttgactatcagtactgttgatacatttattagaatgtatgtctcagaagatggtttctgtttaaatttatggtcaagttacaacaactgaattctaatatggattaaaaactccacataaatatttttccccatgcgtcttgggttataattttccttttagacttgcaaatatgcttttattgcaattttgtctccatctgtactgtagaattacaagccttgtgctctttatctctacattttccacttctacatgatgcaattaagatgccaatgaaaagtattgtgaacattattctcaggacacttttaccatacttgagtagtactaagtcaggtgtaacatggaaagctaagggtttcaccttctgattttgacataattggaaattttctataatggtaagatgtttataggaaagtaatggtagttcatgtttgagaatttttttattgctttcatttcccagttaaatgatatttaacacctgggaaaacaggacagctcagattgtcgagttagtaaacatgagcgatgtaaaaactttatttgaaatctcctaagtgagacattaaacattttagtgctagtttaagccattaaaagtaaagtttaagtttacgtcattgtctcaagtgtggctgtaaaaatcagatctagagtttagagacatacttgttaactttggagcacaggtttgatatttatgcttctaaatacattaaaacatttctgaattgcagttgaatggttggagattgctggcgatgtgatgctgcactgaaaaaactggtcacacaaaatgtttatatgtttgactgcataagtattattttaggtcataaaggttataacaaaatacatttaacattgctttctttttagcaagaggtcacagatgctattttttctcagtttttaatgctttaatttgaaagaaaaatgcatcctaaccattccatcctgttggtgcagagaaattttggtgatttattagaagacttttaaggagggtggatacatagtttttcaactgcaaaaatcatgtcatctcttcagtaactgttaaagtgtaattctctgccttcattatcaagtccaggacagtgtttattttgaatcgttaacattatttaaagactgaaaattcattgcaattagggaacgcacagcctcacaaaaagtggttgtgattgcaaggattctttatgtcagtgaacttaaaaagggaatgggggaagagatgcatgcctttctaaaggtatgctagagtcacctgtgtagcattgtaattatgtactatcaaacccccaagatgctgatgataggccttctctgtaagaatccttctcatagtgaagcactgttgatgttttgttcaccggatatgttgggtagcagaaaaggcctagaaccagttttaagattatgcctacatctctagaagactagtacactggcatcatcttaggtttctaaatattatttaattccttaatttggaaagcagttttaatgtttacagtttaagatactcattttcagtaactagtgttaaagatttttatctttgcctgtctactgtaacttaagactttcatagaataattttttatagagtatatggtatattgtgtcaatcttggaaggaaagctgttgcatatcaattgtaggtcatgtattttactatatgttgcatagtattttgcattctgtaaatacgaatgttaaaacatttcaggtcagcaaaattagaagtcatttctagtcctcaaagcagaaataattagaaatgttaacatttaagtgcttatcatatgccagatactattctgaatattttatgtatattcattcatttagttgtcatattggctttatgtgacataactgtcattataccagtgttgtccaaggttgctagcaggaaatggcagagccaggagttggacctaggtttaatcctatccatattccatgttacaaattgacatgattttccatattaaaaaattttcatttattttgtacctcattcacatgaatagtaatgtgacaaactaaagttaatacatgaagcattgcaatatggaattttgcacatttttgttagctttacattatttgctgataccaacttttggtaggaaggaaaacagggaaggtgattgctgctattctggaatgtgtccattgaaaagaaaataggcgctttgtctcctacaatcttagagaaagttttacatacttaagtgggtaccacagataggcatgtaccttaaattcaaatctacagttttacaaaatgttttcctttgtgtgcctttcctatgtcaaattagccagaaggaagaagagacgttaagaatggcagataaatttaacaggtaatgatacagagattggccattacgccagctctcaggagaaaaacaactaggatgtcttgaaacccgtgcatttaattttagaaatggcaaatttgtaagcgtgtcatttaagtaatttgatgctcagttttagggtctaagttgacctcgagtgagccatgcaaaaatagctttaaaattatacatgagcagctcaaagtaaacgtgtattttttagtaacaatgaaattgtcaaatttcaagattttaataacaggacagttcaactaataaactttattgcatacaagatttattgcaatgtgggaaaattaaaattctcagtctcag

SEQ ID NO: 1154 - DNA, 2701 bp, Homo sapiens
gtagaaaattattcacagaggactaaagacttcttgtcctttgtatgtagtagatgttaagaattcacttcttttcatttagttttaatttgtctcatgatgtagttctctcagtaatcacagaaccttcaagatgtatgaccatggatgaaaaatatgtaaacagcatttgggaccttctgaaaaatgcaattcaagaaatccagcgtaagaataacagtggtcttagttttgaggagctctatagaaatgcatatacaatggttttgcataaacatggagaaaagctctacactggactaagagaagttgttaccgaacatctcataaataaggtgcgagaagatgtactaaattcattgaataacaactttcttcaaacgctaaatcaagcttggaatgatcatcaaacagctatggtgatgattagagacatactaatgtacatggaccgtgtgtatgtacaacaaaataatgtggagaacgtctacaatttgggattaattatttttcgagatcaagttgtacgttatgggtgtattagggatcatctacggcaaactctattggatatgattgcaagagagcggaaaggagaagtcgtagacagaggcgcaataagaaatgcttgccagatgttaatgattttaggtctcgaaggaagatcagtctatgaagaagattttgaggctccttttttggaaatgtctgcagaattttttcagatggaaagccagaaatttttagcagaaaatagtgcttcagtatatataaagaaagtagaagctagaattaatgaagaaatagaacgagtgatgcactgccttgacaaatcaacggaagaaccaattgtaaaggtggttgaaagggaactcatttccaagcacatgaagactatagtagaaatggagaattctgggctagtacatatgttgaaaaatggaaagacagaagaccttggttgcatgtacaagttatttagtcgtgtgccaaatggtttgaaaacaatgtgtgagtgtatgagttcctatttgagggagcaaggtaaagctcttgtttctgaagaaggagaaggaaagaatcctgttgactatatccagggcttattggatctgaagagtaggttcgatcgcttcctcctggaatcattcaacaatgaccgtctctttaaacaaactattgcgggtgactttgagtattttctcaacctcaactccaggtctcctgaatacctctcattatttattgatgataagctgaaaaagggagtcaaagggctaacagaacaagaagtagaaacaatattggataaagcaatggtcctttttaggtttatgcaagaaaaagatgtatttgaacgttattataaacaacacttggcaaggagacttctcacaaataaaagtgtttctgatgactctgaaaaaaacatgatatctaagttaaagactgaatgtggatgtcagttcacgtcaaaactggaaggaatgtttagggatatgagcatctcaaacacaacgatggatgaattcaggcaacatctacaggcaactggtgtatctttaggtggtgttgatcttacagtccgggtgctcacgacaggatattggcccactcagtcagccacaccaaagtgcaacatcccaccagcaccaagacatgcttttgagatattcagaaggttctacttagccaaacacagtggtcgacagctcacactccagcatcatatgggttctgcagatctcaatgccacattttatggaccagttaaaaaggaagatggatctgaagttggtgttggaggtgcacaagtaactggctctaatacacggaagcacatattgcaagtttccactttccagatgaccatattaatgctctttaataatagagaaaaatacacatttgaggaaattcagcaagagacagatatccctgaaagagagcttgttagagccctacagtccctcgcctgtggtaaaccaacacagcgggttcttacaaaagaacccaaatcaaaggaaatagaaaatggtcatatatttacagttaatgatcaattcacatccaaactacacagagtcaagattcaaacagttgctgccaaacaaggtgaatccgacccagagaggaaagaaacaaggcagaaagtagacgacgacagaaaacatgagatagaagctgctatagtgcggataatgaaatctagaaagaagatgcagcacaatgttctagtagcggaggtaactcagcagttgaaggcgcgattcttaccaagtccagttgttattaagaaacgtattgaaggacttattgagagagaatatttggcacgaacacctgaggatcgcaaagtatacacatatgtagcataaaatgcgttcagaaatttgatttattcttggactgtactcttcgcatggactgggaagttcttttaaatcattaaatattaagacgaccatctcttctattaaattacagtacatgttctagaccattgagatcaagcctttactccctttgagagtttccaacatcagttgattgagcttcaggctttacaacgtttatccctgtagagatcatctttacagttcctcgggaaaatgtgaatgtgctgcgttttgttttctttactgtatgaaaacaggaaaataaaagagaaatttagaaaatacagctcattacaataaaa

SEQ ID NO: 1155 - DNA, 3147 bp, Homo sapiens
aggacagagttctcagggtgaaaatgatttaaatggctctggaaaagtagtatacaagagatgtaggggaataatgttttctaaaagaaagctacgttatactgaggtgcatttatcatagtgttattcttaaggtgcctttgttttagctcatatctgtatatttgctaagcttgaaaaagctatatttctttctgacatttatttgatgactgtcgatgagcgttcaagagattctatcattgggcactttcctttgttgatgcatgagggattatactgtgctctgggctgtgttaaatctactgacgttctcatttaatcttcatgacagccctttgagatagatgctgttattgaacccaggacttaattttctcaaggtcacatggcttgtgagtaacaaagctgtggcacaaacctaaggctgtctgacagcaaaacccatgttctctaccagtatactaactatgtttaccaagataatcagtgactgtgatgttactttaccatattagcacaatggaatgtgacattagtccactgatttggactaggttttgggatatataagttctaatcccagctctatgattttggatgaccatggatgaaaaatatgtaaacagcatttgggaccttctgaaaaatgcaattcaagaaatccagcgtaagaataacagtggtcttagttttgaggagctctatagaaatgcatatacaatggttttgcataaacatggagaaaagctctacactggactaagagaagttgttaccgaacatctcataaataaggtgcgagaagatgtactaaattcattgaataacaactttcttcaaacgctaaatcaagcttggaatgatcatcaaacagctatggtgatgattagagacatactaatgtacatggaccgtgtgtatgtacaacaaaataatgtggagaacgtctacaatttgggattaattatttttcgagatcaagttgtacgttatgggtgtattagggatcatctacggcaaactctattggatatgattgcaagagagcggaaaggagaagtcgtagacagaggcgcaataagaaatgcttgccagatgttaatgattttaggtctcgaaggaagatcagtctatgaagaagattttgaggctccttttttggaaatgtctgcagaattttttcagatggaaagccagaaatttttagcagaaaatagtgcttcagtatatataaagaaagtagaagctagaattaatgaagaaatagaacgagtgatgcactgccttgacaaatcaacggaagaaccaattgtaaaggtggttgaaagggaactcatttccaagcacatgaagactatagtagaaatggagaattctgggctagtacatatgttgaaaaatggaaagacagaagaccttggttgcatgtacaagttatttagtcgtgtgccaaatggtttgaaaacaatgtgtgagtgtatgagttcctatttgagggagcaaggtaaagctcttgtttctgaagaaggagaaggaaagaatcctgttgactatatccagggcttattggatctgaagagtaggttcgatcgcttcctcctggaatcattcaacaatgaccgtctctttaaacaaactattgcgggtgactttgagtattttctcaacctcaactccaggtctcctgaatacctctcattatttattgatgataagctgaaaaagggagtcaaagggctaacagaacaagaagtagaaacaatattggataaagcaatggtcctttttaggtttatgcaagaaaaagatgtatttgaacgttattataaacaacacttggcaaggagacttctcacaaataaaagtgtttctgatgactctgaaaaaaacatgatatctaagttaaagactgaatgtggatgtcagttcacgtcaaaactggaaggaatgtttagggatatgagcatctcaaacacaacgatggatgaattcaggcaacatctacaggcaactggtgtatctttaggtggtgttgatcttacagtccgggtgctcacgacaggatattggcccactcagtcagccacaccaaagtgcaacatcccaccagcaccaagacatgcttttgagatattcagaaggttctacttagccaaacacagtggtcgacagctcacactccagcatcatatgggttctgcagatctcaatgccacattttatggaccagttaaaaaggaagatggatctgaagttggtgttggaggtgcacaagtaactggctctaatacacggaagcacatattgcaagtttccactttccagatgaccatattaatgctctttaataatagagaaaaatacacatttgaggaaattcagcaagagacagatatccctgaaagagagcttgttagagccctacagtccctcgcctgtggtaaaccaacacagcgggttcttacaaaagaacccaaatcaaaggaaatagaaaatggtcatatatttacagttaatgatcaattcacatccaaactacacagagtcaagattcaaacagttgctgccaaacaaggtgaatccgacccagagaggaaagaaacaaggcagaaagtagacgacgacagaaaacatgagatagaagctgctatagtgcggataatgaaatctagaaagaagatgcagcacaatgttctagtagcggaggtaactcagcagttgaaggcgcgattcttaccaagtccagttgttattaagaaacgtattgaaggacttattgagagagaatatttggcacgaacacctgaggatcgcaaagtatacacatatgtagcataaaatgcgttcagaaatttgatttattcttggactgtactcttcgcatggactgggaagttcttttaaatcattaaatattaagacgaccatctcttctattaaattacagtacatgttctagaccattgagatcaagcctttactccctttgagagtttccaacatcagttgattgagcttcaggctttacaacgtttatccctgtagagatcatctttacagttcctcgggaaaatgtgaatgtgctgcgttttgttttctttactgtatgaaaacaggaaaataaaagagaaatttagaaaatac

SEQ ID NO: 1156 - DNA, 1879 bp, Homo sapiens
ccgcccttccgtgccctgcccttccctgcccttccccgccctgccccgcccggcccggcccggccctgcccaaccctgccccgccctgccccgcccagccggccacctcttaaccgcgatcctccagtgcacttgccagttgttccggacacatagaaagataacgacgggaagagcggggcccgctttggggtccaggcaggttttggggcctcctgtctggtgggaggaggccgcagcgcagcaccctgctcgtcacttgggatggagaccggctttcccgcaatcatgtaccctggatcttttattgggggctggggagaagagtatctcagctgggaaggaccggggctcccagatttcgtcttccagcagcagcccgtggagtctgaagcaatgcactgcagcaaccccaagagtggagttgtgctggctacagtggcccgaggtcccgatgcttgtcagatactcaccagagccccgctgggccaggatcccccgcagaggacagtgctagggctgctaactgcaaatgggcagtacaggaggacctgtggccaggggatcacaagaatcaggtgttattctggatcagaaaatgccttccctccagctggaaagaaagcactccctgactgtggggtccaagagccccccaagcaagggtttgacatctacatggatgaactagagcagggggacagagacagctgctcggtcagagaggggatggcatttgaggatgtgtatgaagtagacaccggcacactcaagtcagacctgcacttcctgctggatttcaacacagtttcccctatgctggtagattcatctctcctctcccagtctgaagatatatccagtcttggcacagatgtgataaatgtgactgaatatgctgaagaaatttatcagtaccttagggaagctgaaataaggcacagacccaaagcacactacatgaagaagcagccagacatcacggaaggcatgcgcacgattctggtggactggctggtggaggttggggaagaatataaacttcgagcagagaccctgtatctggctgtcaacttcctggacaggttcctttcatgtatgtctgttctgagagggaaactgcagctcgtaggaacagcagctatgcttttggcttcgaaatatgaagagatatatcctcctgaagtagacgagtttgtctatatcaccgatgatacatacacaaaacgacaactgttaaaaatggaacacttgcttctgaaagttctagcttttgatctgacagtaccaaccaccaaccagtttctccttcagtacttgaggcgacaaggagtgtgcgtcaggactgagaacctggctaagtacgtagcagagctgagtctacttgaagcagatccattcttgaaatatcttccttcactgatagctgcagcagctttttgcctggcaaactatactgtgaacaagcacttttggccagaaacccttgctgcatttacagggtattcattaagtgaaattgtgccttgcctgagtgagcttcataaagcgtaccttgatataccccatcgacctcagcaagcaattagggagaagtacaaggcttcaaagtacctgtgtgtgtccctcatggagccacctgcagttcttcttctacaataagtttctgaatggaagcacttccagaacttcacctccatatcagaagtgccaataatcgtcataggcttctgcacgttggatcaactaatgttgtttacaatatagatgacattttaaaaatgtaaatgaatttagtttcccttagactttagtagtttgtaatatagtccaacattttttaaacaataaactgcttgtcttatgaccatgtgttaga

SEQ ID NO: 1157 - DNA, 1962 bp, Homo sapiens
aacagacgcgggtgggcagctcagccgcatcgctaagcccggccgcctcccaggctggaatccctcgacacttggtccttcccgccccgcccttccgtgccctgcccttccctgcccttccccgccctgccccgcccggcccggcccggccctgcccaaccctgccccgccctgccccgcccagccggccacctcttaaccgcgatcctccagtgcacttgccagttgttccggacacatagaaagataacgacgggaagagcggggcccgctttggggtccaggcaggttttggggcctcctgtctggtgggaggaggccgcagcgcagcaccctgctcgtcacttgggatggagaccggctttcccgcaatcatgtaccctggatcttttattgggggctggggagaagagtatctcagctgggaaggaccggggctcccagatttcgtcttccagcagcccgtggagtctgaagcaatgcactgcagcaaccccaagagtggagttgtgctggctacagtggcccgaggtcccgatgcttgtcagatactcaccagagccccgctgggccaggatcccccgcagaggacagtgctagggctgctaactgcaaatgggcagtacaggaggacctgtggccaggggatcacaagaatcaggtgttattctggatcagaaaatgccttccctccagctggaaagaaagcactccctgactgtggggtccaagagccccccaagcaagggtttgacatctacatggatgaactagagcagggggacagagacagctgctcggtcagagaggggatggcatttgaggatgtgtatgaagtagacaccggcacactcaagtcagacctgcacttcctgctggatttcaacacagtttcccctatgctggtagattcatctctcctctcccagtctgaagatatatccagtcttggcacagatgtgataaatgtgactgaatatgctgaagaaatttatcagtaccttagggaagctgaaataaggcacagacccaaagcacactacatgaagaagcagccagacatcacggaaggcatgcgcacgattctggtggactggctggtggaggttggggaagaatataaacttcgagcagagaccctgtatctggctgtcaacttcctggacaggttcctttcatgtatgtctgttctgagagggaaactgcagctcgtaggaacagcagctatgcttttggcttcgaaatatgaagagatatatcctcctgaagtagacgagtttgtctatatcaccgatgatacatacacaaaacgacaactgttaaaaatggaacacttgcttctgaaagttctagcttttgatctgacagtaccaaccaccaaccagtttctccttcagtacttgaggcgacaaggagtgtgcgtcaggactgagaacctggctaagtacgtagcagagctgagtctacttgaagcagatccattcttgaaatatcttccttcactgatagctgcagcagctttttgcctggcaaactatactgtgaacaagcacttttggccagaaacccttgctgcatttacagggtattcattaagtgaaattgtgccttgcctgagtgagcttcataaagcgtaccttgatataccccatcgacctcagcaagcaattagggagaagtacaaggcttcaaagtacctgtgtgtgtccctcatggagccacctgcagttcttcttctacaataagtttctgaatggaagcacttccagaacttcacctccatatcagaagtgccaataatcgtcataggcttctgcacgttggatcaactaatgttgtttacaatatagatgacattttaaaaatgtaaatgaatttagtttcccttagactttagtagtttgtaatatagtccaacattttttaaacaataaactgcttgtcttatgaccatgtgttaga

SEQ ID NO: 1158 - DNA, 1844 bp, Homo sapiens
gccgcagcctgcgcagccccgaggaccccgcgtcgctctcccgagccagggttctcaggagcgggccgcgcaggagacgttagagggggttgttagcggctgttgggagaacgggtcacggaaacagtcccttccaaagccggggccatcgtggggtgggcgagtccgccctcccaggccgggggcgcggaccagaggggacgtgtgcagacggccgcggtcagccccacctcgcccgggcggagacgcacagctggagctggagggccgtcgcccgttgggccctcaggggcctgaacgcccaggggtcgcggcgagtccacccggagcgagtcagcagcagcccgtggagtctgaagcaatgcactgcagcaaccccaagagtggagttgtgctggctacagtggcccgaggtcccgatgcttgtcagatactcaccagagccccgctgggccaggatcccccgcagaggacagtgctagggctgctaactgcaaatgggcagtacaggaggacctgtggccaggggatcacaagaatcaggtgttattctggatcagaaaatgccttccctccagctggaaagaaagcactccctgactgtggggtccaagagccccccaagcaagggtttgacatctacatggatgaactagagcagggggacagagacagctgctcggtcagagaggggatggcatttgaggatgtgtatgaagtagacaccggcacactcaagtcagacctgcacttcctgctggatttcaacacagtttcccctatgctggtagattcatctctcctctcccagtctgaagatatatccagtcttggcacagatgtgataaatgtgactgaatatgctgaagaaatttatcagtaccttagggaagctgaaataaggcacagacccaaagcacactacatgaagaagcagccagacatcacggaaggcatgcgcacgattctggtggactggctggtggaggttggggaagaatataaacttcgagcagagaccctgtatctggctgtcaacttcctggacaggttcctttcatgtatgtctgttctgagagggaaactgcagctcgtaggaacagcagctatgcttttggcttcgaaatatgaagagatatatcctcctgaagtagacgagtttgtctatatcaccgatgatacatacacaaaacgacaactgttaaaaatggaacacttgcttctgaaagttctagcttttgatctgacagtaccaaccaccaaccagtttctccttcagtacttgaggcgacaaggagtgtgcgtcaggactgagaacctggctaagtacgtagcagagctgagtctacttgaagcagatccattcttgaaatatcttccttcactgatagctgcagcagctttttgcctggcaaactatactgtgaacaagcacttttggccagaaacccttgctgcatttacagggtattcattaagtgaaattgtgccttgcctgagtgagcttcataaagcgtaccttgatataccccatcgacctcagcaagcaattagggagaagtacaaggcttcaaagtacctgtgtgtgtccctcatggagccacctgcagttcttcttctacaataagtttctgaatggaagcacttccagaacttcacctccatatcagaagtgccaataatcgtcataggcttctgcacgttggatcaactaatgttgtttacaatatagatgacattttaaaaatgtaaatgaatttagtttcccttagactttagtagtttgtaatatagtccaacattttttaaacaataaactgcttgtcttatgaccatgtgttaga

SEQ ID NO: 1159 - DNA, 1841 bp, Homo sapiens
gccgcagcctgcgcagccccgaggaccccgcgtcgctctcccgagccagggttctcaggagcgggccgcgcaggagacgttagagggggttgttagcggctgttgggagaacgggtcacggaaacagtcccttccaaagccggggccatcgtggggtgggcgagtccgccctcccaggccgggggcgcggaccagaggggacgtgtgcagacggccgcggtcagccccacctcgcccgggcggagacgcacagctggagctggagggccgtcgcccgttgggccctcaggggcctgaacgcccaggggtcgcggcgagtccacccggagcgagtcagcagcccgtggagtctgaagcaatgcactgcagcaaccccaagagtggagttgtgctggctacagtggcccgaggtcccgatgcttgtcagatactcaccagagccccgctgggccaggatcccccgcagaggacagtgctagggctgctaactgcaaatgggcagtacaggaggacctgtggccaggggatcacaagaatcaggtgttattctggatcagaaaatgccttccctccagctggaaagaaagcactccctgactgtggggtccaagagccccccaagcaagggtttgacatctacatggatgaactagagcagggggacagagacagctgctcggtcagagaggggatggcatttgaggatgtgtatgaagtagacaccggcacactcaagtcagacctgcacttcctgctggatttcaacacagtttcccctatgctggtagattcatctctcctctcccagtctgaagatatatccagtcttggcacagatgtgataaatgtgactgaatatgctgaagaaatttatcagtaccttagggaagctgaaataaggcacagacccaaagcacactacatgaagaagcagccagacatcacggaaggcatgcgcacgattctggtggactggctggtggaggttggggaagaatataaacttcgagcagagaccctgtatctggctgtcaacttcctggacaggttcctttcatgtatgtctgttctgagagggaaactgcagctcgtaggaacagcagctatgcttttggcttcgaaatatgaagagatatatcctcctgaagtagacgagtttgtctatatcaccgatgatacatacacaaaacgacaactgttaaaaatggaacacttgcttctgaaagttctagcttttgatctgacagtaccaaccaccaaccagtttctccttcagtacttgaggcgacaaggagtgtgcgtcaggactgagaacctggctaagtacgtagcagagctgagtctacttgaagcagatccattcttgaaatatcttccttcactgatagctgcagcagctttttgcctggcaaactatactgtgaacaagcacttttggccagaaacccttgctgcatttacagggtattcattaagtgaaattgtgccttgcctgagtgagcttcataaagcgtaccttgatataccccatcgacctcagcaagcaattagggagaagtacaaggcttcaaagtacctgtgtgtgtccctcatggagccacctgcagttcttcttctacaataagtttctgaatggaagcacttccagaacttcacctccatatcagaagtgccaataatcgtcataggcttctgcacgttggatcaactaatgttgtttacaatatagatgacattttaaaaatgtaaatgaatttagtttcccttagactttagtagtttgtaatatagtccaacattttttaaacaataaactgcttgtcttatgaccatgtgttaga

SEQ ID NO: 1160 - DNA, 2797 bp, Homo sapiens
catttcaatagtcgcgggatacttgaactgcaagaacagccgccgctccggcgggctgctcgctgcatctctgggcgtctttggctcgccacgctgggcagtgcctgcctgcgcctttcgcaacctcctcggccctgcgtggtctcgagctgggtgagcgagcgggcgggctggtaggctggcctgggctgcgaccggcggctacgactattctttggccgggtcggtgcgagtggtcggctgggcagagtgcacgctgcttggcgccgcaggctgatcccgccgtccactcccgggagcagtgatgttgggcaactctgcgccggggcctgcgacccgcgaggcgggctcggcgctgctagcattgcagcagacggcgctccaagaggaccaggagaatatcaacccggaaaaggcagcgcccgtccaacaaccgcggacccgggccgcgctggcggtactgaagtccgggaacccgcggggtctagcgcagcagcagaggccgaagacgagacgggttgcaccccttaaggatcttcctgtaaatgatgagcatgtcaccgttcctccttggaaagcaaacagtaaacagcctgcgttcaccattcatgtggatgaagcagaaaaagaagctcagaagaagccagctgaatctcaaaaaatagagcgtgaagatgccctggcttttaattcagccattagtttacctggacccagaaaaccattggtccctcttgattatccaatggatggtagttttgagtcaccacatactatggacatgtcaattatattagaagatgaaaagccagtgagtgttaatgaagtaccagactaccatgaggatattcacacataccttagggaaatggaggttaaatgtaaacctaaagtgggttacatgaagaaacagccagacatcactaacagtatgagagctatcctcgtggactggttagttgaagtaggagaagaatataaactacagaatgagaccctgcatttggctgtgaactacattgataggttcctgtcttccatgtcagtgctgagaggaaaacttcagcttgtgggcactgctgctatgctgttagcctcaaagtttgaagaaatataccccccagaagtagcagagtttgtgtacattacagatgatacctacaccaagaaacaagttctgagaatggagcatctagttttgaaagtccttacttttgacttagctgctccaacagtaaatcagtttcttacccaatactttctgcatcagcagcctgcaaactgcaaagttgaaagtttagcaatgtttttgggagaattaagtttgatagatgctgacccatacctcaagtatttgccatcagttattgctggagctgcctttcatttagcactctacacagtcacgggacaaagctggcctgaatcattaatacgaaagactggatataccctggaaagtcttaagccttgtctcatggaccttcaccagacctacctcaaagcaccacagcatgcacaacagtcaataagagaaaagtacaaaaattcaaagtatcatggtgtttctctcctcaacccaccagagacactaaatctgtaacaatgaaagactgcctttgttttctaagatgtaaatcactcaaagtatatggtgtacagtttttaacttaggttttaattttacaatcatttctgaatacagaagttgtggccaagtacaaattatggtatctattactttttaaatggttttaatttgtatatcttttgtatatgtatctgtcttagatatttggctaattttaagtggttttgttaaagtattaatgatgccagctgtcaggataataaattgatttggaaaactttgcaagtcaaatttaacttcttcaggattttgcttagtaaagaagtttacttggtttactatataatgggaagtgaaaagccttcctctaaaattaaagtaggtttaggaaaacagaccctcaaattctgacattcattttcctaagcaactggatcaatttgctgacttgggcataatctaatctaagcatatctgaatacagtattcagagatagatacagtagagattccccagactttttcgctctttgtaaaacctgtttgtttaggttttgcgaggtaaactcaacagaggttgggagtggaagagggtgggaagcttatatgcaaattaacagacgagaaatgctccagaaggtttattattttaaagcacattaaaaacaaaaaactatttttaaaatcctgctagattttataatggatttgtgaataaaaaatacccagggttctcagaatggaataaatatcccttttaatagttatatatacagatatacaactgttagctttaattggcagctctcttcttttttcttcttttcactggctttttacttggtgctttttcttgttttgcactggtggtctgtgttctgtgaataaagcaaagtaagaatttactaagagtatgttaagttttggattattgaaataagaggcatttcttagttttccagtaggatctaaaatgtgtcagctatgagtaagactggcatccaagaagtttatattatagatttaggtcctaatttttataaatcacaaggtaaaaaaatcacagaacagatggatctctaatgaaaaagggatgtctttttgtttatagtcatgtggcaagatgagagtaaaaccagagagcaaacctctataagtgttgagtatatgtatacatttgaaataaaccagaaatttgttacctta

SEQ ID NO: 1161 - DNA, 2169 bp, Homo sapiens
cgaacgccttcgcgcgatcgccctggaaacgcattctctgcgaccggcagccgccaatgggaagggagtgagtgccacgaacaggccaataaggagggagcagtgcggggtttaaatctgaggctaggctggctcttctcggcgtgctgcggcggaacggctgttggtttctgctgggtgtaggtccttggctggtcgggcctccggtgttctgcttctccccgctgagctgctgcctggtgaagaggaagccatggcgctccgagtcaccaggaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgaggaagagcaagcagtcagaccaaaatacctactgggtcgggaagtcactggaaacatgagagccatcctaattgactggctagtacaggttcaaatgaaattcaggttgttgcaggagaccatgtacatgactgtctccattattgatcggttcatgcagaataattgtgtgcccaagaagatgctgcagctggttggtgtcactgccatgtttattgcaagcaaatatgaagaaatgtaccctccagaaattggtgactttgcttttgtgactgacaacacttatactaagcaccaaatcagacagatggaaatgaagattctaagagctttaaactttggtctgggtcggcctctacctttgcacttccttcggagagcatctaagattggagaggttgatgtcgagcaacatactttggccaaatacctgatggaactaactatgttggactatgacatggtgcactttcctccttctcaaattgcagcaggagctttttgcttagcactgaaaattctggataatggtgaatggacaccaactctacaacattacctgtcatatactgaagaatctcttcttccagttatgcagcacctggctaagaatgtagtcatggtaaatcaaggacttacaaagcacatgactgtcaagaacaagtatgccacatcgaagcatgctaagatcagcactctaccacagctgaattctgcactagttcaagatttagccaaggctgtggcaaaggtgtaacttgtaaacttgagttggagtactatatttacaaataaaattggcaccatgtgccatctgtacatattactgttgcatttacttttaataaagcttgtggccccttttacttttttatagcttaactaatttgaatgtggttacttcctactgtagggtagcggaaaagttgtcttaaaaggtatggtggggatatttttaaaaactccttttggtttacctggggatccaattgatgtatatgtttatatactgggttcttgttttatatacctggcttttactttattaatatgagttactgaaggtgatggaggtatttgaaaattttacttccataggacatactgcatgtaagccaagtcatggagaatctgctgcatagctctattttaaagtaaaagtctaccaccgaatccctagtccccctgttttctgtttcttcttgtgattgctgccataattctaagttatttacttttaccactatttaagttatcaactttagctagtatcttcaaactttcactttgaaaaatgagaattttatattctaagccagttttcattttggttttgtgttttggttaataaaacaatactcaaatacaaaa

SEQ ID NO: 1162 - DNA, 1190 bp, Homo sapiens
atggcgctccgagtcaccaggaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgaggaagagcaagcagtcagaccaaaatacctactgggtcgggaagtcactggaaacatgagagccatcctaattgactggctagtacaggttcaaatgaaattcaggttgttgcaggagaccatgtacatgactgtctccattattgatcggttcatgcagaataattgtgtgcccaagaagatgctgcagctggttggtgtcactgccatgtttattgcaagcaaatatgaagaaatgtaccctccagaaattggtgactttgcttttgtgactgacaacacttatactaagcaccaaatcagacagatggaaatgaagattctaagagctttaaactttggtctgggtcggcctctacctttgcacttccttcggagagcatctaagattggagaggttgatgtcgagcaacatactttggccaaatacctgatggaactaactatgttggactatgacatggtgcactttcctccttctcaaattgcagcaggagctttttgcttagcactgaaaattctggataatggtgaatggactgtcaagaacaagtatgccacatcgaagcatgctaagatcagcactctaccacagctgaattctgcactagttcaagatttagccaaggctgtggcaaaggtgta

SEQ ID NO: 1163 - DNA, 1331 bp, Homo sapiens
aggctggctcttctcggcgtgctgcggcggaacggctgttggtttctgctgggtgtaggtccttggctggtcgggcctccggtgttctgcttctccccgctgagctgctgcctggtgaagaggaagccatggcgctccgagtcaccaggaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgaggaagagcaagcagtcagaccaaaatacctactgggtcgggaagtcactggaaacatgagagccatcctaattgactggctagtacaggttcaaatgaaattcaggttgttgcaggagaccatgtacatgactgtctccattattgatcggttcatgcagaataattgtgtgcccaagaagatgctgcagctggttggtgtcactgccatgtttattgcaagcaaatatgaagaaatgtaccctccagaaattggtgactttgcttttgtgactgacaacacttatactaagcaccaaatcagacagatggaaatgaagattctaagagctttaaactttggtctgggtcggcctctacctttgcacttccttcggagagcatctaagattggagaggttgatgtcgagcaacatactttggccaaatacctgatggaactaactatgttggactatgacatggtgcactttcctccttctcaaattgcagcaggagctttttgcttagcactgaaaattctggataatggtgaatggacaccaactctacaacattacctgtcatatactgaagaatctcttcttccagttatgcagcacctggctaagaatgtagtcatggtaaatcaaggacttacaaagcacatggtgagtcaa

SEQ ID NO: 1164 - DNA, 1556 bp, Homo sapiens
gtgcgcagggccgcccaatggggcgcaagcgacgcggtatttgaatcctggaacaaggctacagcgtcgaagatccccagcgctgcgggctcggagagcagtcctaacggcgcctcgtacgctagtgtcctcccttttcagtccgcgtccctccctgggccgggctggcactcttgccttccccgtccctcatggcgctgctccgacgcccgacggtgtccagtgatttggagaatattgacacaggagttaattctaaagttaagagtcatgtgactattaggcgaactgttttagaagaaattggaaatagagttacaaccagagcagcacaagtagctaagaaagctcagaacaccaaagttccagttcaacccaccaaaacaacaaatgtcaacaaacaactgaaacctactgcttctgtcaaaccagtacagatggaaaagttggctccaaagggtccttctcccacacctgaggatgtctccatgaaggaagagaatctctgccaagctttttctgatgccttgctctgcaaaatcgaggacattgataacgaagattgggagaaccctcagctctgcagtgactacgttaaggatatctatcagtatctcaggcagctggaggttttgcagtccataaacccacatttcttagatggaagagatataaatggacgcatgcgtgccatcctagtggattggctggtacaagtccactccaagtttaggcttctgcaggagactctgtacatgtgcgttggcattatggatcgatttttacaggttcagccagtttcccggaagaagcttcaattagttgggattactgctctgctcttggcttccaagtatgaggagatgttttctccaaatattgaagactttgtttacatcacagacaatgcttataccagttcccaaatccgagaaatggaaactctaattttgaaagaattgaaatttgagttgggtcgacccttgccactacacttcttaaggcgagcatcaaaagccggggaggttgatgttgaacagcacactttagccaagtatttgatggagctgactctcatcgactatgatatggtgcattatcatccttctaaggtagcagcagctgcttcctgcttgtctcagaaggttctaggacaaggaaaatggaacttaaagcagcagtattacacaggatacacagagaatgaagtattggaagtcatgcagcacatggccaagaatgtggtgaaagtaaatgaaaacttaactaaattcatcgccatcaagaataagtatgcaagcagcaaactcctgaagatcagcatgatccctcagctgaactcaaaagccgtcaaagaccttgcctccccactgataggaaggtcctaggctgccgtggcccctggggatgtgtgcttcattgtgccctttttcttattggtttagaactcttgattttgtacatagtcctctggtctatctcatgaaacctcttctcagaccagttttctaaacatatattgaggaaaaataaagcgattggtttttcttaaggta

SEQ ID NO: 1165 - DNA, 1704 bp, Homo sapiens
gatttgatcgaggagcgcggttaccggacgggctgggtctatggtcgctccgcgggccgctccgccggctggtgcttttttatcagggcaagctgtgttccatggcagggaacttttggcagagctcccactatttgcaatggattttggataaacaagatctgttgaaggagcgccaaaaggatttaaagtttctctcagaggaagaatattggaagttacaaatattttttacaaatgttatccaagcattaggtgaacatcttaaattaagacaacaagttattgccactgctacggtatatttcaagagattctatgccaggtattctctgaaaagtatagatcctgtattaatggctcctacatgtgtgtttttggcatccaaagtagaggaatttggagtagtttcaaatacaagattgattgctgctgctacttctgtatgtaagtgcaaaaagtatatctgctttaaggatgtaattctaaagaaagctccagagtacatagatttttttttttttagtttatgagacatatgagattggttggctttattaaatttcctgaggataactttatatctagtgtatctggcaaaaaaatcaagctaaaaggtttttttttaaaaagatataaagatattacttttaatgttaaaatggatagtaattatcaatccaaaaacatcaactcagtggcttttaatcttgtaagagtaaagaaaaaattctgtttccgaattttattgtattttattgttttctaatgactattatgtcattcttatgggtagatattaatatctatgtgcaaacccgttcctgtgttgttgggttgttatgaggaccaaatgagttaatataagcttttagaacagtgccttgcttagtatgttactttgctgaggctgccataacaaaatgccacagaacaggtggcttaaacaacagaagcgtattttctcacagttttagagcatggaaatccaagatcaaggtgtctggctattcttacatggacctttctgtgagcacacacactcctggtttgctgtcttcttcatgtgaggacaatagtcttacagaattaggccccactcttatgtcctcatttaatcttttttttttctttcttttttttttttttttttttgagacagagtctcgctctgtcgcccaggctggagtgctcacttcaacttccgcctcctgggttcaagtgattctcctgcctcagcctcctgagtacctgggactacaggcatgtgccaccatgcccagctcatttttgtattttttagtagagacggggtttcaccatgttggccagactagtctcaaactcctgatctcgtgatccgctagcctcggcctcccaacgtgctgggattataggtgtgagccaccatgtctggcctgtcctcatttaatcttatccctttaaagaccctctctccaaatacagtcacattctgaggtactaggagttagggcttcaacatacgaattttggagggggacatatattggtccacaatacttggtaaactttaggggctatcatcatcatcatcatcttcaatgacaacaacatcattatcactggaaaacactgtgccaatgcagtggcattggtaccaaggtaaaatacaaggaatttaaggacaaaaaaagaagacagaaacataaaaatattaataca

SEQ ID NO: 1166 - DNA, 2473 bp, Homo sapiens
aacagaaccccgtatctgagccacttcgcctaggttagacccactcagcaactcccgtgctgaagacaggagaccgagcggcttgggcccccggccagaattctcaagacgctctcgcgagagccttccaaccgccgcgagctctcgtgaacactagttctcttcaatctcagcacctccaagggtcagcacctcccctccggctccctccgctaccgcgggccggaacttttgtcgataggaacgggtttgcacagttgagtgttgtcggccggcgtgaaggagactagggggccatcctcttcctttcgccgtcgccgccgcggagcggagtcgagccgagctgatttgatcgaggagcgcggttaccggacgggctgggtctatggtcgctccgcgggccgctccgccggctggtgcttttttatcagggcaagctgtgttccatggcagggaacttttggcagagctcccactatttgcaatggattttggataaacaagatctgttgaaggagcgccaaaaggatttaaagtttctctcagaggaagaatattggaagttacaaatattttttacaaatgttatccaagcattaggtgaacatcttaaattaagacaacaagttattgccactgctacggtatatttcaagagattctatgccaggtattctctgaaaagtatagatcctgtattaatggctcctacatgtgtgtttttggcatccaaagtagaggaatttggagtagtttcaaatacaagattgattgctgctgctacttctgtattaaaaactagattttcatatgcctttccaaaggaatttccttataggatgaatcatatattagaatgtgaattctatctgttagaactaatggattgttgcttgatagtgtatcatccttatagacctttgctccagtatgtgcaggacatgggccaagaagacatgttgcttccccttgcatggaggatagtgaatgatacctacagaacggatctttgcctactgtatcctcctttcatgatagctttagcttgcctacatgtagcctgtgttgtacagcagaaagatgccaggcaatggtttgctgagctttctgtggatatggaaaagattttggaaataatcagggttattttaaaactatatgagcagtggaagaatttcgatgagagaaaagagatggcaaccattcttagtaagatgccaaaaccaaaaccacctccaaacagtgaaggagagcagggtccaaatggaagtcagaactctagctacagccaatcttaaaacattccgaagaattccatagtggaccacttggaaataaaccattggacagatttcagtaatgtcttcagtggaacacaaatgaaaatgaatagcttgtttctgtcaagcatattggaaagtgattttatttttgcaaaataagtttttctttaatatgattctagtacataattgattaaaatctcttgattataaatgtttggaaaggttctaaggggacctacagacagacatacatagacatttcaaaattaatagcttttgattagtataatatttcttaatttggataataaaaattgtagctttttattaagccaggaaacatgaagcataatttgtttaaaattctctttggtcattgagggaccaaaaaaggacgtaaaatttacagtcaatctatgagggtttttttccctccataagtttaactttaaaactgtatttaaggaatcaaatcttacaaaatcctggaagattttggtaatgatgttgataatttcagggaaattaatcaagtacctatattgatttaaaagtgtattttattcagtagtttgaggatcttgccatggaagatactagcccagcctagcagaaaagtgcaatatgtatagcatactttgacattttaaacatgatagtccataaccattttgaaatgctgggcaaactacatgaagttatttataattaattcacagctaatcaggcattttgaaagcttaattggattcaaaaaccataatgttggaatttggtaaaattttaatgttgatttttactgtgaaaaggtttttataagatatacacaccctagtttaatgttgtgtcttggtgtggatttacagatttactacaggtattctgaaccaggaacacaatcaggtttcaggccagtttgatactggctgtccttaattctaatatgagagtaggacatcatactaaatgttatgtcagtgggactgtactgtctgtggaacttagcaaattaatcattttcttcagacttgaaggagagtgataaataaaatttggagtcataggatattgatgcacaatttaaggattaaacatttttaatcaattgtggatgatggcttattaaatgttgacttcctagtataaaactgcaagaataaaagtaacttctccagctgtatcgacta

SEQ ID NO: 1167 - DNA, 1035 bp, Homo sapiens
gaacactagttctcttcaatctcagcacctccaagggtcagcacctcccctccggctccctccgctaccgcgggccggaacttttgtcgataggaacgggtttgcacatttgcaatggattttggataaacaagatctgttgaaggagcgccaaaaggatttaaagtttctctcagaggaagaatattggaagttacaaatattttttacaaatgttatccaagcattaggtgaacatcttaaattaagacaacaagttattgccactgctacggtatatttcaagagattctatgccaggtattctctgaaaagtatagatcctgtattaatggctcctacatgtgtgtttttggcatccaaagtagaggaatttggagtagtttcaaatacaagattgattgctgctgctacttctgtattaaaaactagattttcatatgcctttccaaaggaatttccttataggatgaatcatatattagaatgtgaattctatctgttagaactaatggattgttgcttgatagtgtatcatccttatagacctttgctccagtatgtgcaggacatgggccaagaagacatgttgcttccccttgcatggaggatagtgaatgatacctacagaacggatctttgcctactgtatcctcctttcatgatagctttagcttgcctacatgtagcctgtgttgtacagcagaaagatgccaggcaatggtttgctgagctttctgtggatatggaaaagattttggaaataatcagggttattttaaaactatatgagcagtggaagaatttcgatgagagaaaagagatggcaaccattcttagtaagatgccaaaaccaaaaccacctccaaacagtgaaggagagcagggtccaaatggaagtcagaactctagctacagccaatcttaaaacattccgaagaattccatagtggaccacttggaaataaaccattggacagatttcagtaatgtcttcagtggaacacaaatgaaaatgaatagcttgtttctgtc

SEQ ID NO: 1168 - DNA, 958 bp, Homo sapiens
gtcgccgccgcggagcggagtcgagccgagctgatttgatcgaggagcgcggttaccggacgggctgggtctatggtcgctccgcgggccgctccgccggctggtgcttttttatcagggcaagctgtgttccatggcagggaacttttggcagagctcccactattatccaagcattaggtgaacatcttaaattaagacaacaagttattgccactgctacggtatatttcaagagattctatgccaggtattctctgaaaagtatagatcctgtattaatggctcctacatgtgtgtttttggcatccaaagtagaggaatttggagtagtttcaaatacaagattgattgctgctgctacttctgtattaaaaactagattttcatatgcctttccaaaggaatttccttataggatgaatcatatattagaatgtgaattctatctgttagaactaatggattgttgcttgatagtgtatcatccttatagacctttgctccagtatgtgcaggacatgggccaagaagacatgttgcttccccttgcatggaggatagtgaatgatacctacagaacggatctttgcctactgtatcctcctttcatgatagctttagcttgcctacatgtagcctgtgttgtacagcagaaagatgccaggcaatggtttgctgagctttctgtggatatggaaaagattttggaaataatcagggttattttaaaactatatgagcagtggaagaatttcgatgagagaaaagagatggcaaccattcttagtaagatgccaaaaccaaaaccacctccaaacagtgaaggagagcagggtccaaatggaagtcagaactctagctacagccaatcttaaaacattccgaagaattccatagtggaccacttggaaataaaccattggacagatttcagtaatgtcttcagtggaacaca

SEQ ID NO: 1169 - DNA, 759 bp, Homo sapiens
cggattcttggtttagctaggccgcggggggtcggatagagtgggcacagtttgcaatggattttggataaacaagatctgttgaaggagcgccaaaaggatttaaagtttctctcagaggaagaatattggaagttacaaatattttttacaaatgttatccaagcattaggtgaacatcttaaattaagacaacaagttattgccactgctacggtatatttcaagagattctatgccaggtattctctgaaaagtatagatcctgtattaatggctcctacatgtgtgtttttggcatccaaagtagaggaatttggagtagtttcaaatacaagattgattgctgctgctacttctgtattaaaaactagattttcatatgcctttccaaaggaatttccttataggatgaatcatatattagaatgtgaattctatctgttagaactaatggattgttgcttgatagtgtatcatccttatagacctttgctccagtatgtgcaggacatgggccaagaagacatgttgcttccccttgcatggaggatagtgaatgatacctacagaacggatctttgcctactgtatcctcctttcatgatagctttagcttgcctacatgtagcctgtgttgtacagcagaaagatgccaggcaatggtttgctgagctttctgtggatatggaaaagattttggaaataatcagggttattttaaaactatatgagcagtggaagaatttcgatgagaga

SEQ ID NO: 1170 - DNA, 3794 bp, Homo sapiens
agcgggacagacgagcgggaggggcagcgtgcggggagctgggggcggggcgcggccgcagctccgtttccggtggctcgtcgcgctcgctcactccagctgcagccactctcgcccgtggctgcttcctccatcctggtattttttggagcttccatcctggttcttccaaagtgcccggacccaaaacaggaaagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctccacataaaaggctttgtttgtcctctgaggatgatcagagtattgatgattctactccttgcatatcagttgttgcacttccactttcagaaaatgatcagagctttgaagtgaccatgactgcaaccacagaagtagcagatgatgaggttactgaggggactgtgacacagatacagattttgcagaatgagcaactagatgaaatatctcccttgggtaacgaggaagtttcagcagttagccaagcatggtttacaactaaagaagataaggattctctgactaataaaggacataaatggaagcaggggatgtggtccaaggaagaaattgatattttgatgaacaatattgaacgctatcttaaggcacgcggaataaaagatgctacagaaatcatctttgagatgtcaaaagacgaaagaaaagatttctacaggactatagcatggggtctgaaccggcctttgtttgcagtttatagaagagtgcttcgcatgtatgatgacagaaaccatgtgggaaaatatacacctgaagaaattgagaagctcaaggagctccggataaagcatggcaatgactgggcaacaataggggcggcgctaggaagaagtgcatcttctgtcaaagatcggtgccgactgatgaaggatacttgcaacacagggaagtggacagaagaagaagaaaagagacttgcagaagtggttcatgagttgacaagcactgagccaggtgacatagtcacacagggtgtgtcttgggcagctgtggctgaacgagtcggtacccgctcagaaaagcaatgtcgttctaaatggctcaactacctgaattggaaacagagtgggggtactgaatggaccaaggaagatgaaatcaatctcatcctcaggatagcagaacttgatgtagctgatgaaaatgacattaactgggatctgttagctgagggatggagtagtgtccgttcaccacaatggctacgaagtaaatggtggaccatcaaaaggcaaattgcaaaccataaggatgtttcgttccctgtcttaataaaaggtcttaaacagttacatgagaaccaaaaaaacaacccaacgcttttggagaataaatcaggatctggagttccaaacagtaataccaattccagtgtgcagcatgttcagataagagttgcccgcttggaagataatacagccatctcttctagccccatggcagcattgcagattccagtccagatcacccatgtttcttcagcagactctcctgctaccgttgactcagaaacaataacactaaacagtggaacactacagacatttgagattcttccctctttccatctacagcccactggcactccaggcacctacctacttcaaacaagctcaagccaaggccttcccctaactctgactgctagtcccacagtaaccctgacagctgctgctcctgcttctcctgaacagattattgttcatgctttatccccagaacatttgttgaacacaagtgataatgttacagtgcagtgtcacacaccaagagtcatcattcagactgttgccacagaggacatcacttcttccatatcccaagcagaactgacagtcgatagtgatattcagtcatctgattttcctgagcctccagacgccctagaagcagacactttcccagatgaaattcatcaccctaagatgactgtggagccatcatttaatgatgctcatgtatccaaattcagtgaccaaaatagcacagaactgatgaatagtgttatggtcagaacagaagaagaaatctctgacaccgaccttaaacaagaggaatcaccctctgatttagccagtgcttatgttactgagggtttagagtctcccactatagaagaacaagttgatcaaacaattgatgatgaaacaatacttatcgttccttcaccacatggctttatccaggcatctgatgttatagatactgaatctgtcttgcctttgacaacactaacagatcccatactccaacatcatcaggaagaatcaaatatcattggatcatccttgggcagtcctgtttcagaagattcaaaggatgtcgaagatttggtaaactgtcattagaataattcttagaaataggcagttcaagcaaagaaggcacactgttaattacaacctcttcaaagaaataggagcaacccccaagaggcttaatttaccaatttaaatagccacagtccttaagccacacacattgttgctgctatgactttttacctcctttaaacacatcatctgaggttgagttttatgacagtatgtagttgagtggaggctgggagttttaagcataaatccctgtttagtgttacatgggaataaggaatttcattcacttcagccactaagaaaagtttagaatcacgaaagcttaactgctgtggtttaaagtacagtttctctaaagatcagacatggcactgtctcctctcaagcctggttgtagttcagatgagtcttttcaacatggtcttcaacatggtctagagcttaccagtgatcttctgatcttcaagaagactaagtttgagacttgaccagcatacaagtatagagacctaggaggtggtcttgtggtggtacatttggttaacccattgctggcagtgggagctgatttaggcagggtaaacaggaaagcattaaaagttaaaattcactacaggttttttgttacttttaaagggaatatggataagcatagtaacaaaacccaccagaatctaagcagttttcaccccctcagaaaccactgtcattagtttacaaagttagcactttgaagtaaaactaaatgaggaaggaagtaatgttacctatccttgataccatgaccatttattagatgttttgctatataaattaccgagagaatagtttgtcatccacttagtgtgttagctggtggggtacaatataacctctcatctcaggctattttaaaaaaacaatatttgcttctataacaaaaggaaacaaatctaagaatcattcctgtactacagaagggttaaggcaaaggtagccttttgggctttttaatgaatatgacccctatagaaaagtcaagaaaaaaaaacccttgtataaattattttatttattattgtaattagatcttcacaaagttgtcttttcactgtgttttgtcaacgtgaaattaaattgtagttataagcaaaagttggttgcctagggaacaattgtatattcagtttaacagaaataaaagaatatttgtcttaa

SEQ ID NO: 1171 - DNA, 1184 bp, Homo sapiens
agcgggacagacgagcgggaggggcagcgtgcggggagctgggggcggggcgcggccgcagctccgtttccggtggctcgtcgcgctcgctcactccagctgcagccactctcgcccgtggctgcttcctccatcctggtattttttggagcttccatcctggttcttccaaagtgcccggacccaaaacaggaaagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctccacataaaaggctttgtttgtcctctgaggatgatcagagtattgatgattctactccttgcatatcagttgttgcacttccactttcagaaaatgatcagagctttgaagtgaccatgactgcaaccacagaagtagcagatgatgaggttactgaggggactgtgacacagatacagattttgcagaatgagcaactagatgaaatatctcccttgggtaacgaggaagtttcagcagttagccaagcatggtttacaactaaagaagataaggattctctgactaataaaggacataaatggaagcaggggatgtggtccaaggaagaaattgatattttgatgaacaatattgaacgctatcttaaggcacgcggaataaaagatgctacagaaatcatctttgagatgtcaaaagacgaaagaaaagatttctacaggactatagcatggggtctgaaccggcctttgtttgcagtttatagaagagtgcttcgcatgtatgatgacagaaaccatgtgggaaaatatacacctgaagaaattgagaagctcaaggagaaaaaggcaattgctgcctgtttttttttcacccacagacaactgtggaccccaaaaaaaggccacactttcaaactttggctctcaaagtattgctgcccacaacttccaaaccagtcaaatgggaagaagaagaatgaagaataa

SEQ ID NO: 1172 - DNA, 4036 bp, Homo sapiens
aagtaagtgcgatggaaccttcaggttccaaccgccgccagggccgctccgcccagtggagcctgtccggcccccttgctgcccgctagctcccgccggctggcgcaagctgtcggcgccggggcactgcgggcggggtcggagcctggccttcctgacgttgcagctgccgtccccgcacgttccggccagggcctccctcttagggccgggcggtgcccgtggctcaggctgcagagtagaaagcacaaaaaccagcctgattgtatctggaaaaaaccattatgttacagttgataggctcaccccaaaatatgcttttggggactgatttagcacctgcatattctgcgtgaatctctttaattggttgcagttgagctaatggtggagccaaaatgctattgccctgtcttcatcaacatttaatcaagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctccacataaaaggctttgtttgtcctctgaggatgatcagagtattgatgattctactccttgcatatcagttgttgcacttccactttcagaaaatgatcagagctttgaagtgaccatgactgcaaccacagaagtagcagatgatgaggttactgaggggactgtgacacagatacagattttgcagaatgagcaactagatgaaatatctcccttgggtaacgaggaagtttcagcagttagccaagcatggtttacaactaaagaagataaggattctctgactaataaaggacataaatggaagcaggggatgtggtccaaggaagaaattgatattttgatgaacaatattgaacgctatcttaaggcacgcggaataaaagatgctacagaaatcatctttgagatgtcaaaagacgaaagaaaagatttctacaggactatagcatggggtctgaaccggcctttgtttgcagtttatagaagagtgcttcgcatgtatgatgacagaaaccatgtgggaaaatatacacctgaagaaattgagaagctcaaggagctccggataaagcatggcaatgactgggcaacaataggggcggcgctaggaagaagtgcatcttctgtcaaagatcggtgccgactgatgaaggatacttgcaacacagggaagtggacagaagaagaagaaaagagacttgcagaagtggttcatgagttgacaagcactgagccaggtgacatagtcacacagggtgtgtcttgggcagctgtggctgaacgagtcggtacccgctcagaaaagcaatgtcgttctaaatggctcaactacctgaattggaaacagagtgggggtactgaatggaccaaggaagatgaaatcaatctcatcctcaggatagcagaacttgatgtagctgatgaaaatgacattaactgggatctgttagctgagggatggagtagtgtccgttcaccacaatggctacgaagtaaatggtggaccatcaaaaggcaaattgcaaaccataaggatgtttcgttccctgtcttaataaaaggtcttaaacagttacatgagaaccaaaaaaacaacccaacgcttttggagaataaatcaggatctggagttccaaacagtaataccaattccagtgtgcagcatgttcagataagagttgcccgcttggaagataatacagccatctcttctagccccatggcagcattgcagattccagtccagatcacccatgtttcttcagcagactctcctgctaccgttgactcagaaacaataacactaaacagtggaacactacagacatttgagattcttccctctttccatctacagcccactggcactccaggcacctacctacttcaaacaagctcaagccaaggccttcccctaactctgactgctagtcccacagtaaccctgacagctgctgctcctgcttctcctgaacagattattgttcatgctttatccccagaacatttgttgaacacaagtgataatgttacagtgcagtgtcacacaccaagagtcatcattcagactgttgccacagaggacatcacttcttccatatcccaagcagaactgacagtcgatagtgatattcagtcatctgattttcctgagcctccagacgccctagaagcagacactttcccagatgaaattcatcaccctaagatgactgtggagccatcatttaatgatgctcatgtatccaaattcagtgaccaaaatagcacagaactgatgaatagtgttatggtcagaacagaagaagaaatctctgacaccgaccttaaacaagaggaatcaccctctgatttagccagtgcttatgttactgagggtttagagtctcccactatagaagaacaagttgatcaaacaattgatgatgaaacaatacttatcgttccttcaccacatggctttatccaggcatctgatgttatagatactgaatctgtcttgcctttgacaacactaacagatcccatactccaacatcatcaggaagaatcaaatatcattggatcatccttgggcagtcctgtttcagaagattcaaaggatgtcgaagatttggtaaactgtcattagaataattcttagaaataggcagttcaagcaaagaaggcacactgttaattacaacctcttcaaagaaataggagcaacccccaagaggcttaatttaccaatttaaatagccacagtccttaagccacacacattgttgctgctatgactttttacctcctttaaacacatcatctgaggttgagttttatgacagtatgtagttgagtggaggctgggagttttaagcataaatccctgtttagtgttacatgggaataaggaatttcattcacttcagccactaagaaaagtttagaatcacgaaagcttaactgctgtggtttaaagtacagtttctctaaagatcagacatggcactgtctcctctcaagcctggttgtagttcagatgagtcttttcaacatggtcttcaacatggtctagagcttaccagtgatcttctgatcttcaagaagactaagtttgagacttgaccagcatacaagtatagagacctaggaggtggtcttgtggtggtacatttggttaacccattgctggcagtgggagctgatttaggcagggtaaacaggaaagcattaaaagttaaaattcactacaggttttttgttacttttaaagggaatatggataagcatagtaacaaaacccaccagaatctaagcagttttcaccccctcagaaaccactgtcattagtttacaaagttagcactttgaagtaaaactaaatgaggaaggaagtaatgttacctatccttgataccatgaccatttattagatgttttgctatataaattaccgagagaatagtttgtcatccacttagtgtgttagctggtggggtacaatataacctctcatctcaggctattttaaaaaaacaatatttgcttctataacaaaaggaaacaaatctaagaatcattcctgtactacagaagggttaaggcaaaggtagccttttgggctttttaatgaatatgacccctatagaaaagtcaagaaaaaaaaacccttgtataaattattttatttattattgtaattagatcttcacaaagttgtcttttcactgtgttttgtcaacgtgaaattaaattgtagttataagcaaaagttggttgcctagggaacaattgtatattcagtttaacagaaataaaagaatatttgtcttaagatgc

SEQ ID NO: 1173 - DNA, 1254 bp, Homo sapiens
gtttccggtggctcgtcgcgctcgctcactccagctgcagccactctcgcccgtggctgcttcctccatcctggtattttttggagcttccatcctggttcttccaaagtgcccggacccaaaacaggaaagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatgtttcagaaaatgatcagagctttgaagtgaccatgactgcaaccacagaagtagcagatgatgaggttactgaggggactgtgacacagatacagattttgcagaatgagcaactagatgaaatatctcccttgggtaacgaggaagtttcagcagttagccaagcatggtttacaactaaagaagataaggattctctgactaataaaggacataaatggaagcaggggatgtggtccaaggaagaaattgatattttgatgaacaatattgaacgctatcttaaggcacgcggaataaaagatgctacagaaatcatctttgagatgtcaaaagacgaaagaaaagatttctacaggactatagcatggggtctgaaccggcctttgtttgcagtttatagaagagtgcttcgcatgtatgatgacagaaaccatgtgggaaaatatacacctgaagaaattgagaagctcaaggagaaaaaggcaattgctgcctgtttttttttcacccacagacaactgtggaccccaaaaaaaggccacactttcaaactttggctctcaaagtattgctgcccacaacttccaaaccagtcaaatgggaagaagaagaatgaagaataaatgatgaaattaaaagggagaaaacaattgaaccaaatgctgattggcagactcttgttttaggctccggataaagcatggcaatgactgggcaacaataggggcggcgctaggaagaagtgcatcttctgtcaaagatcggtgccgactgatgaaggatacttgcaacacagggaagtggacagaagaagaagaaaagagacttgcagaagtggttcatgagttgacaagcactgagccaggtgacatagtcacaca

SEQ ID NO: 1174 - DNA, 4461 bp, Homo sapiens
cctttaaaaaccatttcatatttcataaagtttcacattgctttcaagagcttgtaatttgtcttttctggcctaattgtttaaggttttgtttttgttttttccacagattcctagatagggttgttcatctgtcatcttaaaagggttttctggatgaatagggtactatataatttttaatgctttaagataaaacataaagaggtgttaataattataaaggaaaactatagttactaataatatttatggtgctgtattgattgatatacacatcatgttacataatggtaccacagtctacagttcatagaatcactagcatagctgagcctgttttttttttttttttcagagaacgtttgtctgcctgatgagagccacttgggttaagaaactacctgtgaatagtcatcatttctgtccttcattggggaatacttttagaggccagtttccaaaaattctgcttaaaaaagaattctggttttgtcttactcttccagatgagatatcacagaggcttgggcctagattgtcatcagcatactgctatactattcgtttgttcttattaagccttattgtgtgtaatgctgttactttttcagagtgttgcggagataggaacatgggagagaaacaatctgggtaacatgaaagtgatgctggttgctaagggaaggcaacttgattctgtgggaagggctgtagctgatccatccgttgtctagccatgagatgctatattctgagactagttattccatctgtctgaacaagaggaaaataatatttgtgtaaaatagcagatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctccacataaaaggctttgtttgtcctctgaggatgatcagagtattgatgattctactccttgcatatcagttgttgcacttccactttcagaaaatgatcagagctttgaagtgaccatgactgcaaccacagaagtagcagatgatgaggttactgaggggactgtgacacagatacagattttgcagaatgagcaactagatgaaatatctcccttgggtaacgaggaagtttcagcagttagccaagcatggtttacaactaaagaagataaggattctctgactaataaaggacataaatggaagcaggggatgtggtccaaggaagaaattgatattttgatgaacaatattgaacgctatcttaaggcacgcggaataaaagatgctacagaaatcatctttgagatgtcaaaagacgaaagaaaagatttctacaggactatagcatggggtctgaaccggcctttgtttgcagtttatagaagagtgcttcgcatgtatgatgacagaaaccatgtgggaaaatatacacctgaagaaattgagaagctcaaggaacaactgtggaccccaaaaaaaggccacactttcaaactttggctctcaaagtattgctgcccacaacttccaaaccagtcaaatgggaagaagaagaatgaagaataaatgatgaaattaaaagggagaaaacaattgaaccaaatgctgattggcagactcttgttttaggctccggataaagcatggcaatgactgggcaacaataggggcggcgctaggaagaagtgcatcttctgtcaaagatcggtgccgactgatgaaggatacttgcaacacagggaagtggacagaagaagaagaaaagagacttgcagaagtggttcatgagttgacaagcactgagccaggtgacatagtcacacagggtgtgtcttgggcagctgtggctgaacgagtcggtacccgctcagaaaagcaatgtcgttctaaatggctcaactacctgaattggaaacagagtgggggtactgaatggaccaaggaagatgaaatcaatctcatcctcaggatagcagaacttgatgtagctgatgaaaatgacattaactgggatctgttagctgagggatggagtagtgtccgttcaccacaatggctacgaagtaaatggtggaccatcaaaaggcaaattgcaaaccataaggatgtttcgttccctgtcttaataaaaggtcttaaacagttacatgagaaccaaaaaaacaacccaacgcttttggagaataaatcaggatctggagttccaaacagtaataccaattccagtgtgcagcatgttcagataagagttgcccgcttggaagataatacagccatctcttctagccccatggcagcattgcagattccagtccagatcacccatgtttcttcagcagactctcctgctaccgttgactcagaaacaataacactaaacagtggaacactacagacatttgagattcttccctctttccatctacagcccactggcactccaggcacctacctacttcaaacaagctcaagccaaggccttcccctaactctgactgctagtcccacagtaaccctgacagctgctgctcctgcttctcctgaacagattattgttcatgctttatccccagaacatttgttgaacacaagtgataatgttacagtgcagtgtcacacaccaagagtcatcattcagactgttgccacagaggacatcacttcttccatatcccaagcagaactgacagtcgatagtgatattcagtcatctgattttcctgagcctccagacgccctagaagcagacactttcccagatgaaattcatcaccctaagatgactgtggagccatcatttaatgatgctcatgtatccaaattcagtgaccaaaatagcacagaactgatgaatagtgttatggtcagaacagaagaagaaatctctgacaccgaccttaaacaagaggaatcaccctctgatttagccagtgcttatgttactgagggtttagagtctcccactatagaagaacaagttgatcaaacaattgatgatgaaacaatacttatcgttccttcaccacatggctttatccaggcatctgatgttatagatactgaatctgtcttgcctttgacaacactaacagatcccatactccaacatcatcaggaagaatcaaatatcattggatcatccttgggcagtcctgtttcagaagattcaaaggatgtcgaagatttggtaaactgtcattagaataattcttagaaataggcagttcaagcaaagaaggcacactgttaattacaacctcttcaaagaaataggagcaacccccaagaggcttaatttaccaatttaaatagccacagtccttaagccacacacattgttgctgctatgactttttacctcctttaaacacatcatctgaggttgagttttatgacagtatgtagttgagtggaggctgggagttttaagcataaatccctgtttagtgttacatgggaataaggaatttcattcacttcagccactaagaaaagtttagaatcacgaaagcttaactgctgtggtttaaagtacagtttctctaaagatcagacatggcactgtctcctctcaagcctggttgtagttcagatgagtcttttcaacatggtcttcaacatggtctagagcttaccagtgatcttctgatcttcaagaagactaagtttgagacttgaccagcatacaagtatagagacctaggaggtggtcttgtggtggtacatttggttaacccattgctggcagtgggagctgatttaggcagggtaaacaggaaagcattaaaagttaaaattcactacaggttttttgttacttttaaagggaatatggataagcatagtaacaaaacccaccagaatctaagcagttttcaccccctcagaaaccactgtcattagtttacaaagttagcactttgaagtaaaactaaatgaggaaggaagtaatgttacctatccttgataccatgaccatttattagatgttttgctatataaattaccgagagaatagtttgtcatccacttagtgtgttagctggtggggtacaatataacctctcatctcaggctattttaaaaaaacaatatttgcttctataacaaaaggaaacaaatctaagaatcattcctgtactacagaagggttaaggcaaaggtagccttttgggctttttaatgaatatgacccctatagaaaagtcaagaaaaaaaaacccttgtataaattattttatttattattgtaattagatcttcacaaagttgtcttttcactgtgttttgtcaacgtgaaattaaattgtagttataagcaaaagttggttgcctagggaacaattgtatattcagtttaacagaaataaaagaatatttgtctt

SEQ ID NO: 1175 - DNA, 3369 bp, Homo sapiens
ggcgcggccgcagctccgtttccggtggctcgtcgcgctcgctcactccagctgcagccactctcgcccgtggctgcttcctccatcctggtattttttggagcttccatcctggttcttccaaagtgcccggacccaaaacaggaaagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctccacataaaaggctttgtttgtcctctgaggatgatcagagtattgatgattctactccttgcatatcagttgttgcacttccactttcagaaaatgatcagagctttgaagtgaccatgactgcaaccacagaagtagcagatgatgaggttactgaggggactgtgacacagatacagattttgcagaatgagcaactagatgaaatatctcccttgggtaacgaggaagtttcagcagttagccaagcatggtttacaactaaagaagataaggattctctgactaataaaggacataaatggaagcaggggatgtggtccaaggaagaaattgatattttgatgaacaatattgaacgctatcttaaggcacgcggaataaaagatgctacagaaatcatctttgagatgtcaaaagacgaaagaaaagatttctacaggactatagcatggggtctgaaccggcctttgtttgcagtttatagaagagtgcttcgcatgtatgatgacagaaaccatgtgggaaaatatacacctgaagaaattgagaagctcaaggagctccggataaagcatggcaatgactgggcaacaataggggcggcgctaggaagaagtgcatcttctgtcaaagatcggtgccgactgatgaaggatacttgcaacacagggaagtggacagaagaagaagaaaagagacttgcagaagtggttcatgagttgacaagcactgagccaggtgacatagtcacacagggtgtgtcttgggcagctgtggctgaacgagtcggtacccgctcagaaaagcaatgtcgttctaaatggctcaactacctgaattggaaacagagtgggggtactgaatggaccaaggaagatgaaatcaatctcatcctcaggatagcagaacttgatgtagctgatgaaaatgacattaactgggatctgttagctgagggatggagtagtgtccgttcaccacaatggctacgaagtaaatggtggaccatcaaaaggcaaattgcaaaccataaggatgtttcgttccctgcttcagcagactctcctgctaccgttgactcagaaacaataacactaaacagtggaacactacagacatttgagattcttccctctttccatctacagcccactggcactccaggcacctacctacttcaaacaagctcaagccaaggccttcccctaactctgactgctagtcccacagtaaccctgacagctgctgctcctgcttctcctgaacagattattgttcatgctttatccccagaacatttgttgaacacaagtgataatgttacagtgcagtgtcacacaccaagagtcatcattcagactgttgccacagaggacatcacttcttccatatcccaagcagaactgacagtcgatagtgatattcagtcatctgattttcctgagcctccagacgccctagaagcagacactttcccagatgaaattcatcaccctaagatgactgtggagccatcatttaatgatgctcatgtatccaaattcagtgaccaaaatagcacagaactgatgaatagtgttatggtcagaacagaagaagaaatctctgacaccgaccttaaacaagaggaatcaccctctgatttagccagtgcttatgttactgagggtttagagtctcccactatagaagaacaagttgatcaaacaattgatgatgaaacaatacttatcgttccttcaccacatggctttatccaggcatctgatgttatagatactgaatctgtcttgcctttgacaacactaacagatcccatactccaacatcatcaggaagaatcaaatatcattggatcatccttgggcagtcctgtttcagaagattcaaaggatgtcgaagatttggtaaactgtcattagaataattcttagaaataggcagttcaagcaaagaaggcacactgttaattacaacctcttcaaagaaataggagcaacccccaagaggcttaatttaccaatttaaatagccacagtccttaagccacacacattgttgctgctatgactttttacctcctttaaacacatcatctgaggttgagttttatgacagtatgtagttgagtggaggctgggagttttaagcataaatccctgtttagtgttacatgggaataaggaatttcattcacttcagccactaagaaaagtttagaatcacgaaagcttaactgctgtggtttaaagtacagtttctctaaagatcagacatggcactgtctcctctcaagcctggttgtagttcagatgagtcttttcaacatggtcttcaacatggtctagagcttaccagtgatcttctgatcttcaagaagactaagtttgagacttgaccagcatacaagtatagagacctaggaggtggtcttgtggtggtacatttggttaacccattgctggcagtgggagctgatttaggcagggtaaacaggaaagcattaaaagttaaaattcactacaggttttttgttacttttaaagggaatatggataagcatagtaacaaaacccaccagaatctaagcagttttcaccccctcagaaaccactgtcattagtttacaaagttagcactttgaagtaaaactaaatgaggaaggaagtaatgttacctatccttgataccatgaccatttattagatgttttgctatataaattaccgagagaatagtttgtcatccacttagtgtgttagctggtggggtacaatataacctctcatctcaggctattttaaaaaaacaatatttgcttctataacaaaaggaaacaaatctaagaatcattcctgtactacagaagggttaaggcaaaggtagccttttgggctttttaatgaatatgacccctatagaaaagtcaagaaaaaaaaa

SEQ ID NO: 1176 - DNA, 4460 bp, Homo sapiens
ctttaaaaaccatttcatatttcataaagtttcacattgctttcaagagcttgtaatttgtcttttctggcctaattgtttaaggttttgtttttgttttttccacagattcctagatagggttgttcatctgtcatcttaaaagggttttctggatgaatagggtactatataatttttaatgctttaagataaaacataaagaggtgttaataattataaaggaaaactatagttactaataatatttatggtgctgtattgattgatatacacatcatgttacataatggtaccacagtctacagttcatagaatcactagcatagctgagcctgttttttttttttttttcagagaacgtttgtctgcctgatgagagccacttgggttaagaaactacctgtgaatagtcatcatttctgtccttcattggggaatacttttagaggccagtttccaaaaattctgcttaaaaaagaattctggttttgtcttactcttccagatgagatatcacagaggcttgggcctagattgtcatcagcatactgctatactattcgtttgttcttattaagccttattgtgtgtaatgctgttactttttcagagtgttgcggagataggaacatgggagagaaacaatctgggtaacatgaaagtgatgctggttgctaagggaaggcaacttgattctgtgggaagggctgtagctgatccatccgttgtctagccatgagatgctatattctgagactagttattccatctgtctgaacaagaggaaaataatatttgtgtaaaatagcagatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctccacataaaaggctttgtttgtcctctgaggatgatcagagtattgatgattctactccttgcatatcagttgttgcacttccactttcagaaaatgatcagagctttgaagtgaccatgactgcaaccacagaagtagcagatgatgaggttactgaggggactgtgacacagatacagattttgcagaatgagcaactagatgaaatatctcccttgggtaacgaggaagtttcagcagttagccaagcatggtttacaactaaagaagataaggattctctgactaataaaggacataaatggaagcaggggatgtggtccaaggaagaaattgatattttgatgaacaatattgaacgctatcttaaggcacgcggaataaaagatgctacagaaatcatctttgagatgtcaaaagacgaaagaaaagatttctacaggactatagcatggggtctgaaccggcctttgtttgcagtttatagaagagtgcttcgcatgtatgatgacagaaaccatgtgggaaaatatacacctgaagaaattgagaagctcaaggaacaactgtggaccccaaaaaaaggccacactttcaaactttggctctcaaagtattgctgcccacaacttccaaaccagtcaaatgggaagaagaagaatgaagaataaatgatgaaattaaaagggagaaaacaattgaaccaaatgctgattggcagactcttgttttaggctccggataaagcatggcaatgactgggcaacaataggggcggcgctaggaagaagtgcatcttctgtcaaagatcggtgccgactgatgaaggatacttgcaacacagggaagtggacagaagaagaagaaaagagacttgcagaagtggttcatgagttgacaagcactgagccaggtgacatagtcacacagggtgtgtcttgggcagctgtggctgaacgagtcggtacccgctcagaaaagcaatgtcgttctaaatggctcaactacctgaattggaaacagagtgggggtactgaatggaccaaggaagatgaaatcaatctcatcctcaggatagcagaacttgatgtagctgatgaaaatgacattaactgggatctgttagctgagggatggagtagtgtccgttcaccacaatggctacgaagtaaatggtggaccatcaaaaggcaaattgcaaaccataaggatgtttcgttccctgtcttaataaaaggtcttaaacagttacatgagaaccaaaaaaacaacccaacgcttttggagaataaatcaggatctggagttccaaacagtaataccaattccagtgtgcagcatgttcagataagagttgcccgcttggaagataatacagccatctcttctagccccatggcagcattgcagattccagtccagatcacccatgtttcttcagcagactctcctgctaccgttgactcagaaacaataacactaaacagtggaacactacagacatttgagattcttccctctttccatctacagcccactggcactccaggcacctacctacttcaaacaagctcaagccaaggccttcccctaactctgactgctagtcccacagtaaccctgacagctgctgctcctgcttctcctgaacagattattgttcatgctttatccccagaacatttgttgaacacaagtgataatgttacagtgcagtgtcacacaccaagagtcatcattcagactgttgccacagaggacatcacttcttccatatcccaagcagaactgacagtcgatagtgatattcagtcatctgattttcctgagcctccagacgccctagaagcagacactttcccagatgaaattcatcaccctaagatgactgtggagccatcatttaatgatgctcatgtatccaaattcagtgaccaaaatagcacagaactgatgaatagtgttatggtcagaacagaagaagaaatctctgacaccgaccttaaacaagaggaatcaccctctgatttagccagtgcttatgttactgagggtttagagtctcccactatagaagaacaagttgatcaaacaattgatgatgaaacaatacttatcgttccttcaccacatggctttatccaggcatctgatgttatagatactgaatctgtcttgcctttgacaacactaacagatcccatactccaacatcatcaggaagaatcaaatatcattggatcatccttgggcagtcctgtttcagaagattcaaaggatgtcgaagatttggtaaactgtcattagaataattcttagaaataggcagttcaagcaaagaaggcacactgttaattacaacctcttcaaagaaataggagcaacccccaagaggcttaatttaccaatttaaatagccacagtccttaagccacacacattgttgctgctatgactttttacctcctttaaacacatcatctgaggttgagttttatgacagtatgtagttgagtggaggctgggagttttaagcataaatccctgtttagtgttacatgggaataaggaatttcattcacttcagccactaagaaaagtttagaatcacgaaagcttaactgctgtggtttaaagtacagtttctctaaagatcagacatggcactgtctcctctcaagcctggttgtagttcagatgagtcttttcaacatggtcttcaacatggtctagagcttaccagtgatcttctgatcttcaagaagactaagtttgagacttgaccagcatacaagtatagagacctaggaggtggtcttgtggtggtacatttggttaacccattgctggcagtgggagctgatttaggcagggtaaacaggaaagcattaaaagttaaaattcactacaggttttttgttacttttaaagggaatatggataagcatagtaacaaaacccaccagaatctaagcagttttcaccccctcagaaaccactgtcattagtttacaaagttagcactttgaagtaaaactaaatgaggaaggaagtaatgttacctatccttgataccatgaccatttattagatgttttgctatataaattaccgagagaatagtttgtcatccacttagtgtgttagctggtggggtacaatataacctctcatctcaggctattttaaaaaaacaatatttgcttctataacaaaaggaaacaaatctaagaatcattcctgtactacagaagggttaaggcaaaggtagccttttgggctttttaatgaatatgacccctatagaaaagtcaagaaaaaaaaacccttgtataaattattttatttattattgtaattagatcttcacaaagttgtcttttcactgtgttttgtcaacgtgaaattaaattgtagttataagcaaaagttggttgcctagggaacaattgtatattcagtttaacagaaataaaagaatatttgtctt

SEQ ID NO: 1177 - DNA, 584 bp, Homo sapiens
cgctcgctcactccagctgcagccactctcgcccgtggctgcttcctccatcctggtattttttggagcttccatcctggttcttccaaagtgcccggacccaaaacaggaattgataggctcaccccaaaatatgcttttggggactgatttagcacctgcatattctgcgtgaatctctttaattggttgcagttgagctaatggtggagccaaaatgctattgccctgtcttcatcaacatttaatcaagaacgtttgtctgcctgatgagagccacttgggttaagaaactacctgtgaatagtcatcatttctgtccttcattggggaatacttttagagagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaat

SEQ ID NO: 1178 - DNA, 568 bp, Homo sapiens
gctcgtcgcgctcgctcactccagctgcagccactctcgcccgtggctgcttcctccatcctggtattttttggagcttccatcctggttcttccaaagtgcccggacccaaaacaggaattgataggctcaccccaaaatatgcttttggggactgatttagcacctgcatattctgcgtgaatctctttaattggttgcagttgagctaatggtggagccaaaatgctattgccctgtcttcatcaacatttaatcaagtgttgcggagataggaacatgggagagaaacaatctgggtaacatgaaagtgatgctggttgctaagggaaggcaacttgattctgtgggaagggctgtagctgatccatccgttgtctagaagcggatgaaatagactcagaagatagtattgaacctccacataaaaggctttgtttgtcctctgaggatgatcagagtattgatgattctactccttgcatatcagttgttgcacttccactttcagaaaatgatcagagctttgaagtgaccatgactgcaaccacagaagtagcagatgatg

SEQ ID NO: 1179 - DNA, 524 bp, Homo sapiens
aaagcacaaaaaccagcctgattgtatctggaaaaaaccattatgttacagttgataggctcaccccaaaatatgcttttggggactgatttagcacctgcatattctgcgtgaatctctttaattggttgcagttgagctaatggtggagccaaaatgctattgccctgtcttcatcaacatttaatcaagaacgtttgtctgcctgatgagagccacttgggttaagaaactacctgtgaatagtcatcatttctgtccttcattggggaatacttttagagagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatg

SEQ ID NO: 1180 - DNA, 3868 bp, Homo sapiens
gtttccggtggctcgtcgcgctcgctcactccagctgcagccactctcgcccgtggctgcttcctccatcctggtattttttggagcttccatcctggttcttccaaagtgcccggacccaaaacaggaaagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatgtttcagaaaatgatcagagctttgaagtgaccatgactgcaaccacagaagtagcagatgatgaggttactgaggggactgtgacacagatacagattttgcagaatgagcaactagatgaaatatctcccttgggtaacgaggaagtttcagcagttagccaagcatggtttacaactaaagaagataaggattctctgactaataaaggacataaatggaagcaggggatgtggtccaaggaagaaattgatattttgatgaacaatattgaacgctatcttaaggcacgcggaataaaagatgctacagaaatcatctttgagatgtcaaaagacgaaagaaaagatttctacaggactatagcatggggtctgaaccggcctttgtttgcagtttatagaagagtgcttcgcatgtatgatgacagaaaccatgtgggaaaatatacacctgaagaaattgagaagctcaaggagaaaaaggcaattgctgcctgtttttttttcacccacagacaactgtggaccccaaaaaaaggccacactttcaaactttggctctcaaagtattgctgcccacaacttccaaaccagtcaaatgggaagaagaagaatgaagaataaatgatgaaattaaaagggagaaaacaattgaaccaaatgctgattggcagactcttgttttaggctccggataaagcatggcaatgactgggcaacaataggggcggcgctaggaagaagtgcatcttctgtcaaagatcggtgccgactgatgaaggatacttgcaacacagggaagtggacagaagaagaagaaaagagacttgcagaagtggttcatgagttgacaagcactgagccaggtgacatagtcacacagggtgtgtcttgggcagctgtggctgaacgagtcggtacccgctcagaaaagcaatgtcgttctaaatggctcaactacctgaattggaaacagagtgggggtactgaatggaccaaggaagatgaaatcaatctcatcctcaggatagcagaacttgatgtagctgatgaaaatgacattaactgggatctgttagctgagggatggagtagtgtccgttcaccacaatggctacgaagtaaatggtggaccatcaaaaggcaaattgcaaaccataaggatgtttcgttccctgatggtggtctgtcggagaatcaatgttctttttgtctacccatctcccttcagtcttaataaaaggtcttaaacagttacatgagaaccaaaaaaacaacccaacgcttttggagaataaatcaggatctggagttccaaacagtaataccaattccagtgtgcagcatgttcagataagagttgcccgcttggaagataatacagccatctcttctagccccatggcagcattgcagattccagtccagatcacccatgtttcttcagcagactctcctgctaccgttgactcagaaacaataacactaaacagtggaacactacagacatttgagattcttccctctttccatctacagcccactggcactccaggcacctacctacttcaaacaagctcaagccaaggccttcccctaactctgactgctagtcccacagtaaccctgacagctgctgctcctgcttctcctgaacagattattgttcatgctttatccccagaacatttgttgaacacaagtgataatgttacagtgcagtgtcacacaccaagagtcatcattcagactgttgccacagaggacatcacttcttccatatcccaagcagaactgacagtcgatagtgatattcagtcatctgattttcctgagcctccagacgccctagaagcagacactttcccagatgaaattcatcaccctaagatgactgtggagccatcatttaatgatgctcatgtatccaaattcagtgaccaaaatagcacagaactgatgaatagtgttatggtcagaacagaagaagaaatctctgacaccgaccttaaacaagaggaatcaccctctgatttagccagtgcttatgttactgagggtttagagtctcccactatagaagaacaagttgatcaaacaattgatgatgaaacaatacttatcgttccttcaccacatggctttatccaggcatctgatgttatagatactgaatctgtcttgcctttgacaacactaacagatcccatactccaacatcatcaggaagaatcaaatatcattggatcatccttgggcagtcctgtttcagaagattcaaaggatgtcgaagatttggtaaactgtcattagaataattcttagaaataggcagttcaagcaaagaaggcacactgttaattacaacctcttcaaagaaataggagcaacccccaagaggcttaatttaccaatttaaatagccacagtccttaagccacacacattgttgctgctatgactttttacctcctttaaacacatcatctgaggttgagttttatgacagtatgtagttgagtggaggctgggagttttaagcataaatccctgtttagtgttacatgggaataaggaatttcattcacttcagccactaagaaaagtttagaatcacgaaagcttaactgctgtggtttaaagtacagtttctctaaagatcagacatggcactgtctcctctcaagcctggttgtagttcagatgagtcttttcaacatggtcttcaacatggtctagagcttaccagtgatcttctgatcttcaagaagactaagtttgagacttgaccagcatacaagtatagagacctaggaggtggtcttgtggtggtacatttggttaacccattgctggcagtgggagctgatttaggcagggtaaacaggaaagcattaaaagttaaaattcactacaggttttttgttacttttaaagggaatatggataagcatagtaacaaaacccaccagaatctaagcagttttcaccccctcagaaaccactgtcattagtttacaaagttagcactttgaagtaaaactaaatgaggaaggaagtaatgttacctatccttgataccatgaccatttattagatgttttgctatataaattaccgagagaatagtttgtcatccacttagtgtgttagctggtggggtacaatataacctctcatctcaggctattttaaaaaaacaatatttgcttctataacaaaaggaaacaaatctaagaatcattcctgtactacagaagggttaaggcaaaggtagccttttgggctttttaatgaatatgacccctatagaaaagtcaagaaaaaaaaacccttgtataaattattttatttattattgtaattagatcttcacaaagttgtcttttcactgtgttttgtcaacgtgaaattaaattgtagttataagcaaaagttggttgcctagggaacaattgtatattcagtttaacagaaataaaagaatatttgtctt

SEQ ID NO: 1181 - DNA, 845 bp, Homo sapiens
aagaattctggttttgtcttactcttccagatgagatatcacagaggcttgggcctagattgtcatcagcatactgctatactattcgtttgttcttattaagccttattgtgtgtaatgctgttactttttcagagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctccacataaaaggctttgtttgtcctctgaggatgatcagagtattgatgattctactccttgcatatcagttgttgcacttccactttcagaaaatgatcagagctttgaagtgaccatgactgcaaccacagaagtagcagatgatgaggttactgaggggactgtgacacagatacagattttgcagaatgagcaactagatgaaatatctcccttgggtaacgaggaagtttcagcagttagccaagcatggtttacaactaaagaagataaggattctctgactaataaaggacataaatggaagcaggggatgtggtccaaggaagaaattgatattttgatgaacaatattgaacgctatcttaaggcacgcggaataaaagatgctacagaaatcatctttgagatgtcaaaagacgaaagaaaa

SEQ ID NO: 1182 - DNA, 533 bp, Homo sapiens
actccagctgcagccactctcgcccgtggctgcttcctccatcctggtattttttggagcttccatcctggttcttccaaagtgcccggacccaaaacaggaattgataggctcaccccaaaatatgcttttggggactgatttagcacctgcatattctgcgtgaatctctttaattggttgcagttgagctaatggtggagccaaaatgctattgccctgtcttcatcaacatttaatcaagtgttgcggagataggaacatgggagagaaacaatctgggtaacatgaaagtgatgctggttgctaagggaaggcaacttgattctgtgggaagggctgtagctgatccatccgttgtctagccatgagatgctatattctgagactagttattccatctgtctgaacaagaggaaaataatatttgtgtaaaatagcagatttgagtatgagcacagtggaagaggattctgacacagtaacagtagaaactgtgaactctgtgactttgactcaggacacagaaggga

SEQ ID NO: 1183 - DNA, 553 bp, Homo sapiens
actccagctgcagccactctcgcccgtggctgcttcctccatcctggtattttttggagcttccatcctggttcttccaaagtgcccggacccaaaacaggaaatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctccacataaaaggctttgtttgtcctctgaggatgatcagagtattgatgattctactccttgcatatcagttgttgcacttccactttcagaaaatgatcagagctttgaagtgaccatgactgcaaccacagaagtagcagatgatgaggttactgaggggactgtgacacagatacagattttgcagaatgagcaactagatgaaatatctcccttgggtaacgaggaagtttcagcagttagccaagcatggtttacaactaaagaagataaggattctctgactaataaag

SEQ ID NO: 1184 - DNA, 532 bp, Homo sapiens
ttgataggctcaccccaaaatatgcttttggggactgatttagcacctgcatattctgcgtgaatctctttaattggttgcagttgagctaatggtggagccaaaatgctattgccctgtcttcatcaacatttaatcactcctttatgtctccaaatgatacaagaagacccgagaaagtgagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctccacataaaaggctttgtttgtcctctgaggatgatcagagtattgatgattctactccttgcatatcagtt

SEQ ID NO: 1185 - DNA, 2411 bp, Homo sapiens
actctcgcccgtggctgcttcctccatcctggtattttttggagcttccatcctggttcttccaaagtgcccggacccaaaacaggaaagtgttgcggagataggaacatgggagagaaacaatctgggtaacatgaaagtgatgctggttgctaagggaaggcaacttgattctgtgggaagggctgtagctgatccatccgttgtctagaagcggatgaaatagactcagaagatagtattgaacctccacataaaaggctttgtttgtcctctgaggatgatcagagtattgatgattctactccttgcatatcagttgttgcacttccactttcagaaaatgatcagagctttgaagtgaccatgactgcaaccacagaagtagcagatgatgaggttactgaggggactgtgacacagatacagattttgcagaatgagcaactagatgaaatatctcccttgggtaacgaggaagtttcagcagttagccaagcatggtttacaactaaagaagataaggattctctgactaataaaggacataaatggaagcaggggatgtggtccaaggaagaaattgatattttgatgaacaatattgaacgctatcttaaggcacgcggaataaaagatgctacagaaatcatctttgagatgtcaaaagacgaaagaaaagatttctacaggactatagcatggggtctgaaccggcctttgtttgcagtttatagaagagtgcttcgcatgtatgatgacagaaaccatgtgggaaaatatacacctgaagaaattgagaagctcaaggagctccggataaagcatggcaatgactgggcaacaataggggcggcgctaggaagaagtgcatcttctgtcaaagatcggtgccgactgatgaaggatacttgcaacacagggaagtggacagaagaagaagaaaagagacttgcagaagtggttcatgagttgacaagcactgagccaggtgacatagtcacacagggtgtgtcttgggcagctgtggctgaacgagtcggtacccgctcagaaaagcaatgtcgttctaaatggctcaactacctgaattggaaacagagtgggggtactgaatggaccaaggaagatgaaatcaatctcatcctcaggatagcagaacttgatgtagctgatgaaaatgacattaactgggatctgttagctgagggatggagtagtgtccgttcaccacaatggctacgaagtaaatggtggaccatcaaaaggcaaattgcaaaccataaggatgtttcgttccctgtcttaataaaaggtcttaaacagttacatgagaaccaaaaaaacaacccaacgcttttggagaataaatcaggatctggagttccaaacagtaataccaattccagtgtgcagcatgttcagataagagttgcccgcttggaagataatacagccatctcttctagccccatggcagcattgcagattccagtccagatcacccatgtttcttcagcagactctcctgctaccgttgactcagaaacaataacactaaacagtggaacactacagacatttgagattcttccctctttccatctacagcccactggcactccaggcacctacctacttcaaacaagctcaagccaaggccttcccctaactctgactgctagtcccacagtaaccctgacagctgctgctcctgcttctcctgaacagattattgttcatgctttatccccagaacatttgttgaacacaagtgataatgttacagtgcagtgtcacacaccaagagtcatcattcagactgttgccacagaggacatcacttcttccatatcccaagcagaactgacagtcgatagtgatattcagtcatctgattttcctgagcctccagacgccctagaagcagacactttcccagatgaaattcatcaccctaagatgactgtggagccatcatttaatgatgctcatgtatccaaattcagtgaccaaaatagcacagaactgatgaatagtgttatggtcagaacagaagaagaaatctctgacaccgaccttaaacaagaggaatcaccctctgatttagccagtgcttatgttactgagggtttagagtctcccactatagaagaacaagttgatcaaacaattgatgatgaaacaatacttatcgttccttcaccacatggctttatccaggcatctgatgttatagatactgaatctgtcttgcctttgacaacactaacagatcccatactccaacatcatcaggaagaatcaaatatcattggatcatccttgggcagtcctgtttcagaagattcaaaggatgtcgaagatttggtaaactgtcattagaataattcttagaaataggcagttca

SEQ ID NO: 1186 - DNA, 581 bp, Homo sapiens
gctgcccgctagctcccgccggctggcgcaagctgtcggcgccggggcactgcgggcggggtcggagcctggccttcctgacgttgcagctgccgtccccgcacgttccggccagggcctccctcttagggccgggcggtgcccgtggctcaggctgcagaagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctccacataaaaggctttgtttgtcctctgaggatgatcagagtattgatgattctactccttgcatatcagttgttgcacttccactttcagaaaatgatcagagctttgaagtgaccatgactgcaaccacagaagtagcag

SEQ ID NO: 1187 - DNA, 523 bp, Homo sapiens
gtttccggtggctcgtcgcgctcgctcactccagctgcagccactctcgcccgtggctgcttcctccatcctggtattttttggagcttccatcctggttcttccaaagtgcccggacccaaaacaggaaagaacgtttgtctgcctgatgagagccacttgggttaagaaactacctgtgaatagtcatcatttctgtccttcattggggaatacttttagagagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctccacataaaaggctttgtttg

SEQ ID NO: 1188 - DNA, 3954 bp, Homo sapiens
gcggccgcagctccgtttccggtggctcgtcgcgctcgctcactccagctgcagccactctcgcccgtggctgcttcctccatcctggtattttttggagcttccatcctggttcttccaaagtgcccggacccaaaacaggaaagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctccacataaaaggctttgtttgtcctctgaggatgatcagagtattgatgattctactccttgcatatcagttgttgcacttccactttcagaaaatgatcagagctttgaagtgaccatgactgcaaccacagaagtagcagatgatgaggttactgaggggactgtgacacagatacagattttgcagaatgagcaactagatgaaatatctcccttgggtaacgaggaagtttcagcagttagccaagcatggtttacaactaaagaagataaggattctctgactaataaaggacataaatggaagcaggggatgtggtccaaggaagaaattgatattttgatgaacaatattgaacgctatcttaaggcacgcggaataaaagatgctacagaaatcatctttgagatgtcaaaagacgaaagaaaagatttctacaggactatagcatggggtctgaaccggcctttgtttgcagtttatagaagagtgcttcgcatgtatgatgacagaaaccatgtgggaaaatatacacctgaagaaattgagaagctcaaggagaaaaaggcaattgctgcctgtttttttttcacccacagacaactgtggaccccaaaaaaaggccacactttcaaactttggctctcaaagtattgctgcccacaacttccaaaccagtcaaatgggaagaagaagaatgaagaataaatgatgaaattaaaagggagaaaacaattgaaccaaatgctgattggcagactcttgttttaggctccggataaagcatggcaatgactgggcaacaataggggcggcgctaggaagaagtgcatcttctgtcaaagatcggtgccgactgatgaaggatacttgcaacacagggaagtggacagaagaagaagaaaagagacttgcagaagtggttcatgagttgacaagcactgagccaggtgacatagtcacacagggtgtgtcttgggcagctgtggctgaacgagtcggtacccgctcagaaaagcaatgtcgttctaaatggctcaactacctgaattggaaacagagtgggggtactgaatggaccaaggaagatgaaatcaatctcatcctcaggatagcagaacttgatgtagctgatgaaaatgacattaactgggatctgttagctgagggatggagtagtgtccgttcaccacaatggctacgaagtaaatggtggaccatcaaaaggcaaattgcaaaccataaggatgtttcgttccctgtcttaataaaaggtcttaaacagttacatgagaaccaaaaaaacaacccaacgcttttggagaataaatcaggatctggagttccaaacagtaataccaattccagtgtgcagcatgttcagataagagttgcccgcttggaagataatacagccatctcttctagccccatggcagcattgcagattccagtccagatcacccatgtttcttcagcagactctcctgctaccgttgactcagaaacaataacactaaacagtggaacactacagacatttgagattcttccctctttccatctacagcccactggcactccaggcacctacctacttcaaacaagctcaagccaaggccttcccctaactctgactgctagtcccacagtaaccctgacagctgctgctcctgcttctcctgaacagattattgttcatgctttatccccagaacatttgttgaacacaagtgataatgttacagtgcagtgtcacacaccaagagtcatcattcagactgttgccacagaggacatcacttcttccatatcccaagcagaactgacagtcgatagtgatattcagtcatctgattttcctgagcctccagacgccctagaagcagacactttcccagatgaaattcatcaccctaagatgactgtggagccatcatttaatgatgctcatgtatccaaattcagtgaccaaaatagcacagaactgatgaatagtgttatggtcagaacagaagaagaaatctctgacaccgaccttaaacaagaggaatcaccctctgatttagccagtgcttatgttactgagggtttagagtctcccactatagaagaacaagttgatcaaacaattgatgatgaaacaatacttatcgttccttcaccacatggctttatccaggcatctgatgttatagatactgaatctgtcttgcctttgacaacactaacagatcccatactccaacatcatcaggaagaatcaaatatcattggatcatccttgggcagtcctgtttcagaagattcaaaggatgtcgaagatttggtaaactgtcattagaataattcttagaaataggcagttcaagcaaagaaggcacactgttaattacaacctcttcaaagaaataggagcaacccccaagaggcttaatttaccaatttaaatagccacagtccttaagccacacacattgttgctgctatgactttttacctcctttaaacacatcatctgaggttgagttttatgacagtatgtagttgagtggaggctgggagttttaagcataaatccctgtttagtgttacatgggaataaggaatttcattcacttcagccactaagaaaagtttagaatcacgaaagcttaactgctgtggtttaaagtacagtttctctaaagatcagacatggcactgtctcctctcaagcctggttgtagttcagatgagtcttttcaacatggtcttcaacatggtctagagcttaccagtgatcttctgatcttcaagaagactaagtttgagacttgaccagcatacaagtatagagacctaggaggtggtcttgtggtggtacatttggttaacccattgctggcagtgggagctgatttaggcagggtaaacaggaaagcattaaaagttaaaattcactacaggttttttgttacttttaaagggaatatggataagcatagtaacaaaacccaccagaatctaagcagttttcaccccctcagaaaccactgtcattagtttacaaagttagcactttgaagtaaaactaaatgaggaaggaagtaatgttacctatccttgataccatgaccatttattagatgttttgctatataaattaccgagagaatagtttgtcatccacttagtgtgttagctggtggggtacaatataacctctcatctcaggctattttaaaaaaacaatatttgcttctataacaaaaggaaacaaatctaagaatcattcctgtactacagaagggttaaggcaaaggtagccttttgggctttttaatgaatatgacccctatagaaaagtcaagaaaaaaaaacccttgtataaattattttatttattattgtaattagatcttcacaaagttgtcttttcactgtgttttgtcaacgtgaaattaaattgtagttataagcaaaagttggttgcctagggaacaattgtatattcagtttaacagaaataaaagaatatttgtcttaa

SEQ ID NO: 1189 - DNA, 572 bp, Homo sapiens
actccagctgcagccactctcgcccgtggctgcttcctccatcctggtattttttggagcttccatcctggttcttccaaagtgcccggacccaaaacaggaaaaagcacaaaaaccagcctgattgtatctggaaaaaaccattatgttacagttgataggctcaccccaaaatatgcttttggggactgatttagcacctgcatattctgcgtgaatctctttaattggttgcagttgagctaatggtggagccaaaatgctattgccctgtcttcatcaacatttaatcaagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctc

SEQ ID NO: 1190 - DNA, 700 bp, Homo sapiens
actccagctgcagccactctcgcccgtggctgcttcctccatcctggtattttttggagcttccatcctggttcttccaaagtgcccggacccaaaacaggaattgataggctcaccccaaaatatgcttttggggactgatttagcacctgcatattctgcgtgaatctctttaattggttgcagttgagctaatggtggagccaaaatgctattgccctgtcttcatcaacatttaatcaagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctccacataaaaggctttgtttgtcctctgaggatgatcagagtattgatgattctactccttgcatatcagttgttgcacttccactttcagaaaatgatcagagctttgaagtgaccatgactgcaaccacagaagtagcagatgatgaggttactgaggggactgtgacacagatacag

SEQ ID NO: 1191 - DNA, 585 bp, Homo sapiens
cactccagctgcagccactctcgcccgtggctgcttcctccatcctggtattttttggagcttccatcctggttcttccaaagtgcccggacccaaaacaggaaagtgttgcggagataggaacatgggagagaaacaatctgggtaacatgaaagtgatgctggttgctaagggaaggcaacttgattctgtgggaagggctgtagctgatccatccgttgtctagccatgagatgctatattctgagactagttattccatctgtctgaacaagaggaaaataatatttgtgtaaaatagcagatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctccacataaaaggctttgtttgtcctctgaggatgatcagagtattgatgattctactccttgcatatcagttgttgcacttccactttcagaaaatgatcagagctttgaagtgaccatgactgc

SEQ ID NO: 1192 - DNA, 4307 bp, Homo sapiens
gcttaacaacagtaacgtcacacggactacaggggagttttgttgaagttgcaaagtcctggagcctccagagggctgtcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagccatggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatgtgtgcagaaggaggtcctgccgtccatgcggaagatcgtcgccacctggatgctggaggtctgcgaggaacagaagtgcgaggaggaggtcttcccgctggccatgaactacctggaccgcttcctgtcgctggagcccgtgaaaaagagccgcctgcagctgctgggggccacttgcatgttcgtggcctctaagatgaaggagaccatccccctgacggccgagaagctgtgcatctacaccgacaactccatccggcccgaggagctgctgcaaatggagctgctcctggtgaacaagctcaagtggaacctggccgcaatgaccccgcacgatttcattgaacacttcctctccaaaatgccagaggcggaggagaacaaacagatcatccgcaaacacgcgcagaccttcgttgccctctgtgccacagatgtgaagttcatttccaatccgccctccatggtggcagcggggagcgtggtggccgcagtgcaaggcctgaacctgaggagccccaacaacttcctgtcctactaccgcctcacacgcttcctctccagagtgatcaagtgtgacccggactgcctccgggcctgccaggagcagatcgaagccctgctggagtcaagcctgcgccaggcccagcagaacatggaccccaaggccgccgaggaggaggaagaggaggaggaggaggtggacctggcttgcacacccaccgacgtgcgggacgtggacatctgagggcgccaggcaggcgggcgccaccgccacccgcagcgagggcggagccggccccaggtgctcccctgacagtccctcctctccggagcattttgataccagaagggaaagcttcattctccttgttgttggttgttttttcctttgctctttcccccttccatctctgacttaagcaaaagaaaaagattacccaaaaactgtctttaaaagagagagagagaaaaaaaaaatagtatttgcataaccctgagcggtgggggaggagggttgtgctacagatgatagaggattttataccccaataatcaactcgtttttatattaatgtacttgtttctctgttgtaagaataggcattaacacaaaggaggcgtctcgggagaggattaggttccatcctttacgtgtttaaaaaaaagcataaaaacattttaaaaacatagaaaaattcagcaaaccatttttaaagtagaagagggttttaggtagaaaaacatattcttgtgcttttcctgataaagcacagctgtagtggggttctaggcatctctgtactttgcttgctcatatgcatgtagtcactttataagtcattgtatgttattatattccgtaggtagatgtgtaacctcttcaccttattcatggctgaagtcacctcttggttacagtagcgtagcgtgcccgtgtgcatgtcctttgcgcctgtgaccaccaccccaacaaaccatccagtgacaaaccatccagtggaggtttgtcgggcaccagccagcgtagcagggtcgggaaaggccacctgtcccactcctacgatacgctactataaagagaagacgaaatagtgacataatatattctatttttatactcttcctatttttgtagtgacctgtttatgagatgctggttttctacccaacggccctgcagccagctcacgtccaggttcaacccacagctacttggtttgtgttcttcttcatattctaaaaccattccatttccaagcactttcagtccaataggtgtaggaaatagcgctgtttttgttgtgtgtgcagggagggcagttttctaatggaatggtttgggaatatccatgtacttgtttgcaagcaggactttgaggcaagtgtgggccactgtggtggcagtggaggtggggtgtttgggaggctgcgtgccagtcaagaagaaaaaggtttgcattctcacattgccaggatgataagttcctttccttttctttaaagaagttgaagtttaggaatcctttggtgccaactggtgtttgaaagtagggacctcagaggtttacctagagaacaggtggtttttaagggttatcttagatgtttcacaccggaaggtttttaaacactaaaatatataatttatagttaaggctaaaaagtatatttattgcagaggatgttcataaggccagtatgatttataaatgcaatctccccttgatttaaacacacagatacacacacacacacacacacacacaaaccttctgcctttgatgttacagatttaatacagtttatttttaaagatagatccttttataggtgagaaaaaaacaatctggaagaaaaaaaccacacaaagacattgattcagcctgtttggcgtttcccagagtcatctgattggacaggcatgggtgcaaggaaaattagggtactcaacctaagttcggttccgatgaattcttatcccctgccccttcctttaaaaaacttagtgacaaaatagacaatttgcacatcttggctatgtaattcttgtaatttttatttaggaagtgttgaagggaggtggcaagagtgtggaggctgacgtgtgagggaggacaggcgggaggaggtgtgaggaggaggctcccgaggggaaggggcggtgcccacaccggggacaggccgcagctccattttcttattgcgctgctaccgttgacttccaggcacggtttggaaatattcacatcgcttctgtgtatctctttcacattgtttgctgctattggaggatcagttttttgttttacaatgtcatatactgccatgtactagttttagttttctcttagaacattgtattacagatgccttttttgtagttttttttttttttatgtgatcaattttgacttaatgtgattactgctctattccaaaaaggttgctgtttcacaatacctcatgcttcacttagccatggtggacccagcgggcaggttctgcctgctttggcgggcagacacgcgggcgcgatcccacacaggctggcgggggccggccccgaggccgcgtgcgtgagaaccgcgccggtgtccccagagaccaggctgtgtccctcttctcttccctgcgcctgtgatgctgggcacttcatctgatcgggggcgtagcatcatagtagtttttacagctgtgttattctttgcgtgtagctatggaagttgcataattattattattattattataacaagtgtgtcttacgtgccaccacggcgttgtacctgtaggactctcattcgggatgattggaatagcttctggaatttgttcaagttttgggtatgtttaatctgttatgtactagtgttctgtttgttattgttttgttaattacaccataatgctaatttaaagagactccaaatctcaatgaagccagctcacagtgctgtgtgccccggtcacctagcaagctgccgaaccaaaagaatttgcaccccgctgcgggcccacgtggttggggccctgccctggcagggtcatcctgtgctcggaggccatctcgggcacaggcccaccccgccccacccctccagaacacggctcacgcttacctcaaccatcctggctgcggcgtctgtctgaaccacgcgggggccttgagggacgctttgtctgtcgtgatggggcaagggcacaagtcctggatgttgtgtgtatcgagaggccaaaggctggtggcaagtgcacggggcacagcggagtctgtcctgtgacgcgcaagtctgagggtctgggcggcgggcggctgggtctgtgcatttctggttgcaccgcggcgcttcccagcaccaacatgtaaccggcatgtttccagcagaagacaaaaagacaaacatgaaagtctagaaataaaactggtaaaacccca

SEQ ID NO: 1193 - DNA, 1394 bp, Homo sapiens
agagggctgtcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagccatggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatgtgtgcagaccttcgttgccctctgtgccacagatgtgaagttcatttccaatccgccctccatggtggcagcggggagcgtggtggccgcagtgcaaggcctgaacctgaggagccccaacaacttcctgtcctactaccgcctcacacgcttcctctccagagtgatcaagtgtgacccggactgcctccgggcctgccaggagcagatcgaagccctgctggagtcaagcctgcgccaggcccagcagaacatggaccccaaggccgccgaggaggaggaagaggaggaggaggaggtggacctggcttgcacacccaccgacgtgcgggacgtggacatctgagggcgccaggcaggcgggcgccaccgccacccgcagcgagggcggagccggccccaggtgctcccctgacagtccctcctctccggagcattttgataccagaagggaaagcttcattctccttgttgttggttgttttttcctttgctctttcccccttccatctctgacttaagcaaaagaaaaagattacccaaaaactgtctttaaaagagagagagagaaaaaaaaaatagtatttgcataaccctgagcggtgggggaggagggttgtgctacagatgatagaggattttataccccaataatcaactcgtttttatattaatgtacttgtttctctgttgtaagaataggcattaacacaaaggaggcgtctcgggagaggattaggttccatcctttacgtgtttaaaaaaaagcataaaaacattttaaaaacatagaaaaattcagcaaaccatttttaaagtagaagagggttttaggtagaaaaacatattcttgtgcttttcctgataaagcacagctgtagtggggttctaggcatctctgtactttgcttgctcatatgcatgtagtcactttataagtcattgtatgttattatattccgtaggtagatgtgtaacctcttcaccttattcatggctgaagtcacctcttggttacagtagcgtagcgtgcccgtgtgcatgtcctttgcgcctgtgaccaccaccccaacaaaccatccagtgacaaaccatc

SEQ ID NO: 1194 - DNA, 6480 bp, Homo sapiens
agagcgagcaggggagagcgagaccagttttaaggggaggaccggtgcgagtgaggcagccccgaggctctgctcgcccaccacccaatcctcgcctcccttctgctccaccttctctctctgccctcacctctcccccgaaaaccccctatttagccaaaggaaggaggtcaggggaacgctctcccctccccttccaaaaaacaaaaacagaaaaacctttttccaggccggggaaagcaggagggagaggggccgccgggctggccatggagctgctgtgccacgaggtggacccggtccgcagggccgtgcgggaccgcaacctgctccgagacgaccgcgtcctgcagaacctgctcaccatcgaggagcgctaccttccgcagtgctcctacttcaagtgcgtgcagaaggacatccaaccctacatgcgcagaatggtggccacctggatgctggaggtctgtgaggaacagaagtgcgaagaagaggtcttccctctggccatgaattacctggaccgtttcttggctggggtcccgactccgaagtcccatctgcaactcctgggtgctgtctgcatgttcctggcctccaaactcaaagagaccagcccgctgaccgcggagaagctgtgcatttacaccgacaactccatcaagcctcaggagctgctggagtgggaactggtggtgctggggaagttgaagtggaacctggcagctgtcactcctcatgacttcattgagcacatcttgcgcaagctgccccagcagcgggagaagctgtctctgatccgcaagcatgctcagaccttcattgctctgtgtgccaccgactttaagtttgccatgtacccaccgtcgatgatcgcaactggaagtgtgggagcagccatctgtgggctccagcaggatgaggaagtgagctcgctcacttgtgatgccctgactgagctgctggctaagatcaccaacacagacgtggattgtctcaaagcttgccaggagcagattgaggcggtgctcctcaatagcctgcagcagtaccgtcaggaccaacgtgacggatccaagtcggaggatgaactggaccaagccagcacccctacagacgtgcgggatatcgacctgtgaggatgccagttgggccgaaagagagagacgcgtccataatctggtctcttcttctttctggttgtttttgttctttgtgttttagggtgaaacttaaaaaaaaaattctgcccccacctagatcatatttaaagatcttttagaagtgagagaaaaaggtcctacgaaaacggaataataaaaagcatttggtgcctatttgaagtacagcataagggaatcccttgtatatgcgaacagttattgtttgattatgtaaaagtaatagtaaaatgcttacaggaaaacctgcagagtagttagagaatatgtatgcctgcaatatgggaacaaattagaggagacttttttttttcatgttatgagctagcacatacacccccttgtagtataatttcaaggaactgtgtacgccatttatggcatgattagattgcaaagcaatgaactcaagaaggaattgaaataaggagggacatgatggggaaggagtacaaaacaatctctcaacatgattgaaccatttgggatggagaagcacctttgctctcagccacctgttactaagtcaggagtgtagttggatctctacattaatgtcctcttgctgtctacagtagctgctacctaaaaaaagatgttttattttgccagttggacacaggtgattggctcctgggtttcatgttctgtgacatcctgcttcttcttccaaatgcagttcattgcagacaccaccatattgctatctaatggggaaatgtagctatgggccataaccaaaactcacatgaaacggaggcagatggagaccaagggtgggatccagaatggagtcttttctgttattgtatttaaaagggtaatgtggccttggcatttcttcttagaaaaaaactaatttttggtgctgattggcatgtctggttcacagtttagcattgttataaaccattccattcgaaaagcactttgaaaaattgttcccgagcgatagatgggatggtttatgcaagtcatgctgaatactcctcccctcttctcttttgccccctcccttcctgcccccagtctgggttactcttcgcttctggtatctggcgttctttggtacacagttctggtgttcctaccaggactcaagagacaccccttcctgctgacattcccatcacaacattcctcagacaagcctgtaaactaaaatctgttaccattctgatggcacagaaggatcttaattcccatctctatacttctcctttggacatggaaagaaaagttattgctggtgcaaagatagatggctgaacatcagggtgtggcattttgttcccttttccgtttttttttttttattgttgttgttaattttattgcaaagttgtattcagcgtacttgaatttttcttcctctccacttcttagaggcattcagttagcaaagaggttggagcaacaacttttttttttttttttgcacaattgtaattgacaggtaatgaagctatttgttaaaatatttgcctttttaagtaaaaaagaaaaatcagaacagggctatttgaagaattattttatacacagattctgccttgtttcatagtatgagggttgaagacggaaaacaatctaagggtctctcatttttttaattttgttttgttcagtttggtttttttttttttttgcgctgctaagaagctaaagtcatccatccttattcacgttgacagtacctagctgtaatgtttcacagagtgtgctgctattttataaacatttttataatatattattttactgcttaaattccaagtcctgaagtagatggttgagatatgagttcttcgtactggaaaagcccttccgtagtttgttttcttctggtagcatattcatggttgtttttttttttcttttttggttttttggttttttttttttcctctgatcacattcttcaaagacggagtattctttacctcaggtttactggacaaaatcaataactacaaaaggcaatgattcacgcttttgttttcataatacctcacaaccgtacagtttctgcttgggagcccattcgcatgaggaatacagaagcagtgtgagcagggctgactccctctcaggtggaaggcagggcggtctcactcccagggacctttttggtcatggaggccatcgggctcccagttagaccctggtatcctcatcatgatggaaaaaatacattgaaccaagggatcctccctccccttcaaggcagacgttcagtacaaacatttatgcggtaggctcagatgtcgtaatttgcacttaggtaccaggtgtcaggaaacagactaaaaagaattccaccaggctgtttggagatcctcatcttggagctttttcaaaagcggggcttcatctgcaaagggccctttcatcttgaagtttttcccctccgtctttcccctcccctggcatggacaccttgtgtttaggatcatctctgcaggtttcctaggtctgaatctgcgagtagatgaacctgcagcaagcagcgtttatggtgcttccttctccctcctctgtctcaaactgcgcaggcaagcactatgcaagcccaggccctctgctgagcggtactaaacggtcgggttttcaatcacactgaattggcaggataagaaaaataggtcagataagtatgggatgatagttgaagggaggtgaagaggctgcttctctacagaggtgaaattccagatgagtcagtctcttgggaagtgtgtttagaagggttcaggactttgtgagttagcatgaccctaaaattctaggggatttctggtgggacaatgggtggtgaattctgaagttttggagagggaagtggagcagccagcaagtaagctagccagagttttctcaagagccagctttgctcagcacactctcctgggccccaaggagtcccacggaatggggaaagcgggaaccctggagttcttgggaatcttggagcctaaagagaaaccgaggtgcaaattcatttcatggtgactgacccttgagcttaaacagaagcagcaaatgaaagaaccggacaaataaggaagggcacaagcctacccgactctatttacagtctgtaactttccactcttcctgtagtcccgaggcccctgggtccttctagcttttctctttcccatccttggggccttgtgtgatgatgggtgtggggctgccgatgggaaagtcgggggttgttaggcttttctgcctgctcctgcttaaacacaagaaggaatcctggattttgccctctccttagctcttagtctctttggtaggagttttgttccagaggagctctcccccttggatttgaacttgctctttttgttgttgttgttctttctcttctttttcttacctcccactaaaggggttccaaattatcctggtctttttctaccttgttgtgtttctatctcgtctttacttccatctgtttgtttttttctccatcagtgggggccgagttgttcccccagcctgccaaattttgatccttcccctcttttggccaaatcctagggggaagaaatcctagtatgccaaaaatatatgctaagcataattaaactccatgcgggtccataacagccaagaagcctgcaggagaaagccaagggcagttccctccgcagaacaccccatgcgtgctgagaggcgagctccttgaagaaggggctgttcttccaggaggccttattttgaactgcctcaggaccccactggagagcacagcatgccttactactgggtcatccttggtctatgtgctctgtactggaggctctgttctgcctcttatcagccaggtcaggggcacacatggcttaagtgacaaagccagaggagaagacaaccctgacagcatcacgctgcatcccattgctagcaggattggcaactcttcagacggagctgcgcttccctgcagtctagcacctctagggcctctccagactgtgccctgggagctctgggactgaaaggttaagaacataaggcaggatcagatgactctctccaagagggcaggggaattttctctccatgggccacaggggacagggctgggagaagaaatagacttgcaccttatgtcatgtaaataattgattttctagttcaagaagataatattggtagtgtgggaattggaggtaggaaggggaggaagtctgagtaagccagttggcttctaagccaaaaggattcctctttgtttatctctgagacagtccaaccttgagaatagctttaaaagggaaattaatgctgagatgataaagtccccttaagccaacaaaccctctgtagctatagaatgagtgcaggtttctattggtgtggactcagagcaatttacaagagctgttcatgcagccatccatttgtgcaaaatagggtaagaagattcaagaggatatttattacttcctcataccacatggcttttgatgattctggattctaaacaacccagaatggtcatttcaggcacaacgatactacattcgtgtgtgtctgcttttaaacttggctgggctatcagaccctattctcggctcaggttttgagaagccatcagcaaatgtgtacgtgcatgctgtagctgcagcctgcatcccttcgcctgcagcctactttggggaaataaagtgccttactgactgtagccattacagtatccaatgtcttttgacaggtgcctgtccttgaaaaacaaagtttctatttttatttttaattggtttagttcttaactgctggccaactcttacatccccagcaaatcatcgggccattggattttttccattatgttcatcacccttatatcatgtacctcagatctctctctctctcctctctctcagttatgtagtttcttgtcttggacttttttttttcttttctttttctttttttttttgctttaaaacaagtgtgatgccatatcaagtccatgttattctctcacagtgtactctataagaggtgtgggtgtctgtttggtcaggatgttagaaagtgctgataagtagcatgatcagtgtatgcgaaaaggtttttaggaagtatggcaaaaatgttgtattggctatgatggtgacatgatatagtcagctgccttttaagaggtcttatctgttcagtgttaagtgatttaaaaaaataataacctgttttctgactagtttaaagatggatttgaaaatggttttgaatgcaattaggttatgctatttggacaataaactcaccttgacct

SEQ ID NO: 1195 - DNA, 2233 bp, Homo sapiens
acttccagtgcgtgcagcgggagatcaagccgcacatgcggaagatgctggcttactggatgctggaggtaccgcccggacgcgtccccctcccccaccgctcccgggtctggacacaccggggccgccctgtcgggacatcccggtccccacagcaatctgcaggatgctccgaggctaagactcccggggcctggcctttcactagggcacccacgccagctgcctcccttgctttcccgagccctaatcggctcctcccgacagtgactgccagtcacttggcaccctaactgtgcctctcttcgggccgagcaaacgggaccaaggacactctctccccttcggcttctcacagcgtctcccgcttccctccgcctcccggccttctccggagagcgcgcctggaaaaccctgggctcggccgcccccgcccgggagccggttcctgtgtctttcgcggggttctggcggggaaggcgatgggggtggcgcgcgccctgttccggccgacagggaaatgaaaagtgcaggaggcagcggcaggagcctcctcccttcccctcgggtatgtgaggagcagcgctgtgaggaggaagtcttccccctggccatgaactacctggatcgctacctgtcttgcgtccccacccgaaaggcgcagttgcagctcctgggtgcggtctgcatgctgctggcctccaagctgcgcgagaccacgcccctgaccatcgaaaaactgtgcatctacaccgaccacgctgtctctccccgccagttgcgggactgggaggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacagattatacctttgccatgtacccgccatccatgatcgccacgggcagcattggggctgcagtgcaaggcctgggtgcctgctccatgtccggggatgagctcacagagctgctggcagggatcactggcactgaagtggactgcctgcgggcctgtcaggagcagatcgaagctgcactcagggagagcctcagggaagcctctcagaccagctccagcccagcgcccaaagccccccggggctccagcagccaagggcccagccagaccagcactcctacagatgtcacagccatacacctgtagccctggagaggccctctggagtggccactaagcagaggaggggccgctgccacccacctccctgcctccaggaaccacaccacatctaagcctgaaggggcgtctgttcccccttcacaaagcccaagggatctggtcctacccatccccgcagtgtgcactaaggggcccggccagccatgtctgcatttcggtggctagtcaagctcctcctccctgcatctgaccagcagcgcctttcccaactctagctgggggtgggccaggctgatgggacagaattggatacatacaccagcattccttttgaacgcccccccccacccctgggggctctcatgttttcaactgccaaaatgctctagtgccttctaaaggtgttgtcccttctagggttattgcatttggattggggtccctctaaaatttaatgcatgatagacacatatgagggggaatagtctagatggctcctctcagtactttggaggcccctatgtagtccgtgctgacagctgctcctagagggaggggcctaggcctcagccagagaagctataaattcctctttgctttgctttctgctcagcttctcctgtgtgattgacagctttgctgctgaaggctcattttaatttattaattgctttgagcacaactttaagaggacataatggggtcctggccatcccacaagtggtggtaaccctggtggttgctgttttcctcccttctgctactggcaaaaggatctttgtggccaaggagctgctatagcctggggtggggtcatgccctcctctcccattgtccctctgccccatcctccagcagggaaaatgcagcagggatgccctggaggtggctgagcccctgtctagagagggaggcaagccctgttgacacaggtctttcctaaggctgcaaggtttaggctggtggcccaggaccatcatcctactgtaataaagatgattgtgaaat

SEQ ID NO: 1196 - DNA, 2133 bp, Homo sapiens
ggcagcggtccgggaacccgtgctgccccggccccgccgcccacacctgagcctccgtggcgccccgcccccgcacctatgccgcgtggggcgggggctgcgggcgggggtgcgcggcgccggatgagcctcctggcctcgccgagggtgtacagggggtgggagagtcaggccggggaccgaaacttggctgagcagagcaccagcccctttgtctcctccgccccctcttccccacttcctgcccagctctggatcggcggcgcggcgcggactttgtaaacacttcgccactgcaggggtggagactggctctgttcggatgccggccgggggggagaggtgcaatcctctcctcgcggctggtggttgcgaccacccccactccccaaaggcaggctccggaggcggcgggacagagcgcctgcgaccccagtcggtgctccggggaggtcacctgacgaggaggtatgtgaggagcagcgctgtgaggaggaagtcttccccctggccatgaactacctggatcgctacctgtcttgcgtccccacccgaaaggcgcagttgcagctcctgggtgcggtctgcatgctgctggcctccaagctgcgcgagaccacgcccctgaccatcgaaaaactgtgcatctacaccgaccacgctgtctctccccgccagttgcgggactgggaggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacagattatacctttgccatgtacccgccatccatgatcgccacgggcagcattggggctgcagtgcaaggcctgggtgcctgctccatgtccggggatgagctcacagagctgctggcagggatcactggcactgaagtggactgcctgcgggcctgtcaggagcagatcgaagctgcactcagggagagcctcagggaagcctctcagaccagctccagcccagcgcccaaagccccccggggctccagcagccaagggcccagccagaccagcactcctacagatgtcacagccatacacctgtagccctggagaggccctctggagtggccactaagcagaggaggggccgctgccacccacctccctgcctccaggaaccacaccacatctaagcctgaaggggcgtctgttcccccttcacaaagcccaagggatctggtcctacccatccccgcagtgtgcactaaggggcccggccagccatgtctgcatttcggtggctagtcaagctcctcctccctgcatctgaccagcagcgcctttcccaactctagctgggggtgggccaggctgatgggacagaattggatacatacaccagcattccttttgaacgcccccccccacccctgggggctctcatgttttcaactgccaaaatgctctagtgccttctaaaggtgttgtcccttctagggttattgcatttggattggggtccctctaaaatttaatgcatgatagacacatatgagggggaatagtctagatggctcctctcagtactttggaggcccctatgtagtccgtgctgacagctgctcctagagggaggggcctaggcctcagccagagaagctataaattcctctttgctttgctttctgctcagcttctcctgtgtgattgacagctttgctgctgaaggctcattttaatttattaattgctttgagcacaactttaagaggacataatggggtcctggccatcccacaagtggtggtaaccctggtggttgctgttttcctcccttctgctactggcaaaaggatctttgtggccaaggagctgctatagcctggggtggggtcatgccctcctctcccattgtccctctgccccatcctccagcagggaaaatgcagcagggatgccctggaggtggctgagcccctgtctagagagggaggcaagccctgttgacacaggtctttcctaaggctgcaaggtttaggctggtggcccaggaccatcatcctactgtaataaagatgattgtgaaat

SEQ ID NO: 1197 - DNA, 2085 bp, Homo sapiens
attccacggttgctacatcgtcgcgaggggcggggcgcctgtcagggaagcggcgcgcgcgcgcgggcggcgggcgggctggggatccgccgcgcagtgccagcgccagcgccagacccgcgccccgcgctctccggcccgtcgcctgccttgggactcgcgagcccgcactcccgccctgcctgttcgctgcccgagtatggagctgctgtgttgcgaaggcacccggcacgcgccccgggccgggccggacccgcggctgctgggggaccagcgtgtcctgcagagcctgctccgcctggaggagcgctacgtaccccgcgcctcctacttccagtgcgtgcagcgggagatcaagccgcacatgcggaagatgctggcttactggatgctggaggtatgtgaggagcagcgctgtgaggaggaagtcttccccctggccatgaactacctggatcgctacctgtcttgcgtccccacccgaaaggcgcagttgcagctcctgggtgcggtctgcatgctgctggcctccaagctgcgcgagaccacgcccctgaccatcgaaaaactgtgcatctacaccgaccacgctgtctctccccgccagttgcgggactgggaggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacagattatacctttgccatgtacccgccatccatgatcgccacgggcagcattggggctgcagtgcaaggcctgggtgcctgctccatgtccggggatgagctcacagagctgctggcagggatcactggcactgaagtggactgcctgcgggcctgtcaggagcagatcgaagctgcactcagggagagcctcagggaagcctctcagaccagctccagcccagcgcccaaagccccccggggctccagcagccaagggcccagccagaccagcactcctacagatgtcacagccatacacctgtagccctggagaggccctctggagtggccactaagcagaggaggggccgctgccacccacctccctgcctccaggaaccacaccacatctaagcctgaaggggcgtctgttcccccttcacaaagcccaagggatctggtcctacccatccccgcagtgtgcactaaggggcccggccagccatgtctgcatttcggtggctagtcaagctcctcctccctgcatctgaccagcagcgcctttcccaactctagctgggggtgggccaggctgatgggacagaattggatacatacaccagcattccttttgaacgcccccccccacccctgggggctctcatgttttcaactgccaaaatgctctagtgccttctaaaggtgttgtcccttctagggttattgcatttggattggggtccctctaaaatttaatgcatgatagacacatatgagggggaatagtctagatggctcctctcagtactttggaggcccctatgtagtccgtgctgacagctgctcctagagggaggggcctaggcctcagccagagaagctataaattcctctttgctttgctttctgctcagcttctcctgtgtgattgacagctttgctgctgaaggctcattttaatttattaattgctttgagcacaactttaagaggacataatggggtcctggccatcccacaagtggtggtaaccctggtggttgctgttttcctcccttctgctactggcaaaaggatctttgtggccaaggagctgctatagcctggggtggggtcatgccctcctctcccattgtccctctgccccatcctccagcagggaaaatgcagcagggatgccctggaggtggctgagcccctgtctagagagggaggcaagccctgttgacacaggtctttcctaaggctgcaaggtttaggctggtggcccaggaccatcatcctactgtaataaagatgattgtgaaataaaactggctttggcttcttgga

SEQ ID NO: 1198 - DNA, 1724 bp, Homo sapiens
gcagtgccagcgccagcgccagacccgcgccccgcgctctccggcccgtcgcctgccttgggactcgcgagcccgcactcccgccctgcctgttcgctgcccgagtatggagctgctgtgttgcgaaggcacccggcacgcgccccgggccgggccggacccgcggctgctgggggaccagcgtgtcctgcagagcctgctccgcctggaggagcgctacgtaccccgcgcctcctacttccagtgcgtgcagcgggagatcaagccgcacatgcggaagatgctggcttactggatgctggaggactgggaggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacagattatacctttgccatgtacccgccatccatgatcgccacgggcagcattggggctgcagtgcaaggcctgggtgcctgctccatgtccggggatgagctcacagagctgctggcagggatcactggcactgaagtggactgcctgcgggcctgtcaggagcagatcgaagctgcactcagggagagcctcagggaagcctctcagaccagctccagcccagcgcccaaagccccccggggctccagcagccaagggcccagccagaccagcactcctacagatgtcacagccatacacctgtagccctggagaggccctctggagtggccactaagcagaggaggggccgctgccacccacctccctgcctccaggaaccacaccacatctaagcctgaaggggcgtctgttcccccttcacaaagcccaagggatctggtcctacccatccccgcagtgtgcactaaggggcccggccagccatgtctgcatttcggtggctagtcaagctcctcctccctgcatctgaccagcagcgcctttcccaactctagctgggggtgggccaggctgatgggacagaattggatacatacaccagcattccttttgaacgcccccccccacccctgggggctctcatgttttcaactgccaaaatgctctagtgccttctaaaggtgttgtcccttctagggttattgcatttggattggggtccctctaaaatttaatgcatgatagacacatatgagggggaatagtctagatggctcctctcagtactttggaggcccctatgtagtccgtgctgacagctgctcctagagggaggggcctaggcctcagccagagaagctataaattcctctttgctttgctttctgctcagcttctcctgtgtgattgacagctttgctgctgaaggctcattttaatttattaattgctttgagcacaactttaagaggacataatggggtcctggccatcccacaagtggtggtaaccctggtggttgctgttttcctcccttctgctactggcaaaaggatctttgtggccaaggagctgctatagcctggggtggggtcatgccctcctctcccattgtccctctgccccatcctccagcagggaaaatgcagcagggatgccctggaggtggctgagcccctgtctagagagggaggcaagccctgttgacacaggtctttcctaaggctgcaaggtttaggctggtggcccaggaccatca

SEQ ID NO: 1199 - DNA, 1843 bp, Homo sapiens
acctatgccgcgtggggcgggggctgcgggcgggggtgcgcggcgccggatgagcctcctggcctcgccgagggtgtacagggggtgggagagtcaggccggggaccgaaacttggctgagcagagcaccagcccctttgtctcctccgccccctcttccccacttcctgcccagctctggatcggcggcgcggcgcggactttgtaaacacttcgccactgcaggggtggagactggctctgttcggatgccggccgggggggagaggtgcaatcctctcctcgcggctggtggttgcgaccacccccactccccaaaggcaggctccggaggcggcgggacagagcgcctgcgaccccagtcggtgctccggggaggtcacctgacgaggaggactgggaggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacagattatacctttgccatgtacccgccatccatgatcgccacgggcagcattggggctgcagtgcaaggcctgggtgcctgctccatgtccggggatgagctcacagagctgctggcagggatcactggcactgaagtggactgcctgcgggcctgtcaggagcagatcgaagctgcactcagggagagcctcagggaagcctctcagaccagctccagcccagcgcccaaagccccccggggctccagcagccaagggcccagccagaccagcactcctacagatgtcacagccatacacctgtagccctggagaggccctctggagtggccactaagcagaggaggggccgctgccacccacctccctgcctccaggaaccacaccacatctaagcctgaaggggcgtctgttcccccttcacaaagcccaagggatctggtcctacccatccccgcagtgtgcactaaggggcccggccagccatgtctgcatttcggtggctagtcaagctcctcctccctgcatctgaccagcagcgcctttcccaactctagctgggggtgggccaggctgatgggacagaattggatacatacaccagcattccttttgaacgcccccccccacccctgggggctctcatgttttcaactgccaaaatgctctagtgccttctaaaggtgttgtcccttctagggttattgcatttggattggggtccctctaaaatttaatgcatgatagacacatatgagggggaatagtctagatggctcctctcagtactttggaggcccctatgtagtccgtgctgacagctgctcctagagggaggggcctaggcctcagccagagaagctataaattcctctttgctttgctttctgctcagcttctcctgtgtgattgacagctttgctgctgaaggctcattttaatttattaattgctttgagcacaactttaagaggacataatggggtcctggccatcccacaagtggtggtaaccctggtggttgctgttttcctcccttctgctactggcaaaaggatctttgtggccaaggagctgctatagcctggggtggggtcatgccctcctctcccattgtccctctgccccatcctccagcagggaaaatgcagcagggatgccctggaggtggctgagcccctgtctagagagggaggcaagccctgttgacacaggtctttcctaaggctgcaaggtttaggctggtggcccaggaccatcatcctactgtaataaagatgattgtgaaat

SEQ ID NO: 1200 - DNA, 544 bp, Homo sapiens
acacttcgccactgcaggggtggagactggctctgttcggatgccggccgggggggagaggtgcaatcctctcctcgcggctggtggttgcgaccacccccactccccaaaggcaggctccggaggcggcgggacagagcgcctgcgaccccagtcggtgctccggggaggtcacctgacgaggagctccaacctgagcggcaagacccagatggacatgggcacctaggggctttggggcagcactggtttaccacgtgtccctccatatcctgaagatgtaggcctccgtggacacacctgtattcctgagctgtgcatggcctctgtcctggttgcacagaggattggacccacagggcagatgggtatgtgaggagcagcgctgtgaggaggaagtcttccccctggccatgaactacctggatcgctacctgtcttgcgtccccacccgaaaggcgcagttgcagctcctgggtgcggtctgcatgctgctggcctccaagctgcgcgagaccacgcccctgaccatcgaaaaactgtg

SEQ ID NO: 1201 - DNA, 540 bp, Homo sapiens
tttattggtccttgtctctctaagtagcttaccctctctgccgtttttgctccctatcccacctcacttcagcgctcccacccccccgctgctgtgttccccacgctccagacccagcagtgactgtgcgccctcccccaggtatgtgaggagcagcgctgtgaggaggaagtcttccccctggccatgaactacctggatcgctacctgtcttgcgtccccacccgaaaggcgcagttgcagctcctgggtgcggtctgcatgctgctggcctccaagctgcgcgagaccacgcccctgaccatcgaaaaactgtgcatctacaccgaccacgctgtctctccccgccagttgcgggactgggaggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacagattatacctttgccatgtacccg

SEQ ID NO: 1202 - DNA, 574 bp, Homo sapiens
aaacacttcgccactgcaggggtggagactggctctgttcggatgccggccgggggggagaggtgcaatcctctcctcgcggctggtggttgcgaccacccccactccccaaaggcaggctccggaggcggcgggacagagcgcctgcgaccccagtcggtgctccggggaggtcacctgacgaggagctccaacctgagcggcaagacccagatggacatgggcacctaggggctttggggcagcactggtttaccacgtgtccctccatatcctgaagatgtaggcctccgtggacacacctgtattcctgagctgtgcatggcctctgtcctggttgcacagaggattggacccacagggcagatgggactgggaggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacagattatacctttgccatgtacccgccatccatgatcgccacgggc

SEQ ID NO: 1203 - DNA, 2394 bp, Homo sapiens
cacaggctagagtgcaatggcgcgatctcggttcactgcaacctccacctcccaggctcaagcgatcctcccgcctcagcctccggagtagctgggattacaggcgggcaccaccacgccccgctagtttttgtatttttagtagagaccgagtttcgccatgttggccaggctggtctcgaacacctaagctcaagcagtccgcggcctcggcctcacaaggtgctgggattacaggcgtgagctaccgcgccagcctcacgtgaccttttgagagtgaagtgttctggggccttcagtggcttggttgtgggccaggaaaacgcgcccggtttcactgagttaaaagaaacctattttaatatgaaaatcggttcttataaagagcataccaggagatcatctacactcgcagggttttccaaacttgtcttattattagtaacacctggctgggcccagcccaatcccagtgacttcactctctggaagaggggcttgggaatctttctcattaaggagctccccagatgattcttctgagcgagtaatgttgggaaaccctggagcatccagcctggtgattttgtgctgagggccgccccgcctgtcaatggcccacttggaagtagagcctggaccacctagtccaagtctatcgctgcatcctgctgccttcgcgccctcgacccgcaagtatttgcgaggtatgtgaggagcagcgctgtgaggaggaagtcttccccctggccatgaactacctggatcgctacctgtcttgcgtccccacccgaaaggcgcagttgcagctcctgggtgcggtctgcatgctgctggcctccaagctgcgcgagaccacgcccctgaccatcgaaaaactgtgcatctacaccgaccacgctgtctctccccgccagttgcgggactgggaggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacagattatacctttgccatgtacccgccatccatgatcgccacgggcagcattggggctgcagtgcaaggcctgggtgcctgctccatgtccggggatgagctcacagagctgctggcagggatcactggcactgaagtggactgcctgcgggcctgtcaggagcagatcgaagctgcactcagggagagcctcagggaagcctctcagaccagctccagcccagcgcccaaagccccccggggctccagcagccaagggcccagccagaccagcactcctacagatgtcacagccatacacctgtagccctggagaggccctctggagtggccactaagcagaggaggggccgctgccacccacctccctgcctccaggaaccacaccacatctaagcctgaaggggcgtctgttcccccttcacaaagcccaagggatctggtcctacccatccccgcagtgtgcactaaggggcccggccagccatgtctgcatttcggtggctagtcaagctcctcctccctgcatctgaccagcagcgcctttcccaactctagctgggggtgggccaggctgatgggacagaattggatacatacaccagcattccttttgaacgcccccccccacccctgggggctctcatgttttcaactgccaaaatgctctagtgccttctaaaggtgttgtcccttctagggttattgcatttggattggggtccctctaaaatttaatgcatgatagacacatatgagggggaatagtctagatggctcctctcagtactttggaggcccctatgtagtccgtgctgacagctgctcctagagggaggggcctaggcctcagccagagaagctataaattcctctttgctttgctttctgctcagcttctcctgtgtgattgacagctttgctgctgaaggctcattttaatttattaattgctttgagcacaactttaagaggacataatggggtcctggccatcccacaagtggtggtaaccctggtggttgctgttttcctcccttctgctactggcaaaaggatctttgtggccaaggagctgctatagcctggggtggggtcatgccctcctctcccattgtccctctgccccatcctccagcagggaaaatgcagcagggatgccctggaggtggctgagcccctgtctagagagggaggcaagccctgttgacacaggtctttcctaaggctgcaaggtttaggctggtggcccaggaccatcatcctactgtaataaagatgattgtgaaataaaactggctttggcttcttgg

SEQ ID NO: 1204 - DNA, 1948 bp, Homo sapiens
agcagccggcgcggccgccagcgcggtgtagggggcaggcgcggatcccgccaccgccgcgcgctcggcccgccgactcccggcgccgccgccgccactgccgtcgccgccgccgcctgccgggactggagcgcgccgtccgccgcggacaagaccctggcctcaggccggagcagccccatcatgccgagggagcgcagggagcgggatgcgaaggagcgggacaccatgaaggaggacggcggcgcggagttctcggctcgctccaggaagaggaaggcaaacgtgaccgtttttttgcaggatccagatgaagaaatggccaaaatcgacaggacggcgagggaccagtgtgggagccagccttgggacaataatgcagtctgtgcagacccctgctccctgatccccacacctgacaaagaagatgatgaccgggtttacccaaactcaacgtgcaagcctcggattattgcaccatccagaggctccccgctgcctgtactgagctgggcaaatagagaggaagtctggaaaatcatgttaaacaaggaaaagacatacttaagggatcagcactttcttgagcaacaccctcttctgcagccaaaaatgcgagcaattcttctggattggttaatggaggtgtgtgaagtctataaacttcacagggagaccttttacttggcacaagatttctttgaccggtatatggcgacacaagaaaatgttgtaaaaactcttttacagcttattgggatttcatctttatttattgcagccaaacttgaggaaatctatcctccaaagttgcaccagtttgcgtatgtgacagatggagcttgttcaggagatgaaattctcaccatggaattaatgattatgaaggcccttaagtggcgtttaagtcccctgactattgtgtcctggctgaatgtatacatgcaggttgcatatctaaatgacttacatgaagtgctactgccgcagtatccccagcaaatctttatacagattgcagagctgttggatctctgtgtcctggatgttgactgccttgaatttccttatggtatacttgctgcttcggccttgtatcatttctcgtcatctgaattgatgcaaaaggtttcagggtatcagtggtgcgacatagagaactgtgtcaagtggatggttccatttgccatggttataagggagacggggagctcaaaactgaagcacttcaggggcgtcgctgatgaagatgcacacaacatacagacccacagagacagcttggatttgctggacaaagcccgagcaaagaaagccatgttgtctgaacaaaatagggcttctcctctccccagtgggctcctcaccccgccacagagcggtaagaagcagagcagcgggccggaaatggcgtgaccaccccatccttctccaccaaagacagttgcgcgcctgctccacgttctcttctgtctgttgcagcggaggcgtgcgtttgcttttacagatatctgaatggaagagtgtttcttccacaacagaagtatttctgtggatggcatcaaacagggcaaagtgttttttattgaatgcttataggttttttttaaataagtgggtcaagtacaccagccacctccagacaccagtgcgtgctcccgatgctgctatggaaggtgctacttgacctaagggactcccacaacaacaaaagcttgaagctgtggagggccacggtggcgtggctctcctcgcaggtgttctgggctccgttgtaccaagtggagcaggtggttgcgggcaagcgttgtgcagagcccatagccagctgggcagggggctgccctctccacattatcagttgacagtgtacaatgcctttgatgaactgttttgtaagtgctgctatatctatccattttttaataaagataatactgtttttgag

SEQ ID NO: 1205 - DNA, 1807 bp, Homo sapiens
gcggccgccagcgcggtgtagggggcaggcgcggatcccgccaccgccgcgcgctcggcccgccgactcccggcgccgccgccgccactgccgtcgccgccgccgcctgccgggactggagcgcgccgtccgccgcggacaagaccctggcctcaggccggagcagccccatcatgccgagggagcgcagggagcgggatgcgaaggagcgggacaccatgaaggaggacggcggcgcggagttctcggctcgctccaggaagaggaaggcaaacgtgaccgtttttttgcaggatccagatgaagaaatggccaaaatcgacaggacggcgagggaccagtgtgggagccagccttgggacaataatgcagtctgtgcagacccctgctccctgatccccacacctgacaaagaagatgatgaccgggtttacccaaactcaacgtgcaagcctcggattattgcaccatccagaggctccccgctgcctgtactgagctgggcaaatagagaggaagtctggaaaatcatgttaaacaaggaaaagacatacttaagggatcagcactttcttgagcaacaccctcttctgcagccaaaaatgcgagcaattcttctggattggttaatggaggtgagcttgagtcttcctgaaatctatcctccaaagttgcaccagtttgcgtatgtgacagatggagcttgttcaggagatgaaattctcaccatggaattaatgattatgaaggcccttaagtggcgtttaagtcccctgactattgtgtcctggctgaatgtatacatgcaggttgcatatctaaatgacttacatgaagtgctactgccgcagtatccccagcaaatctttatacagattgcagagctgttggatctctgtgtcctggatgttgactgccttgaatttccttatggtatacttgctgcttcggccttgtatcatttctcgtcatctgaattgatgcaaaaggtttcagggtatcagtggtgcgacatagagaactgtgtcaagtggatggttccatttgccatggttataagggagacggggagctcaaaactgaagcacttcaggggcgtcgctgatgaagatgcacacaacatacagacccacagagacagcttggatttgctggacaaagcccgagcaaagaaagccatgttgtctgaacaaaatagggcttctcctctccccagtgggctcctcaccccgccacagagcggtaagaagcagagcagcgggccggaaatggcgtgaccaccccatccttctccaccaaagacagttgcgcgcctgctccacgttctcttctgtctgttgcagcggaggcgtgcgtttgcttttacagatatctgaatggaagagtgtttcttccacaacagaagtatttctgtggatggcatcaaacagggcaaagtgttttttattgaatgcttataggttttttttaaataagtgggtcaagtacaccagccacctccagacaccagtgcgtgctcccgatgctgctatggaaggtgctacttgacctaagggactcccacaacaacaaaagcttgaagctgtggagggccacggtggcgtggctctcctcgcaggtgttctgggctccgttgtaccaagtggagcaggtggttgcgggcaagcgttgtgcagagcccatagccagctgggcagggggctgccctctccacattatcagttgacagtgtacaatgcctttgatgaactgttttgtaagtgctgctatatctatccattttttaataaagataatactgtttttg

SEQ ID NO: 1206 - DNA, 1777 bp, Homo sapiens
gtgctcacccggcccggtgccacccgggtccacagggatgcgaaggagcgggacaccatgaaggaggacggcggcgcggagttctcggctcgctccaggaagaggaaggcaaacgtgaccgtttttttgcaggatccagatgaagaaatggccaaaatcgacaggacggcgagggaccagtgtgggagccagccttgggacaataatgcagtctgtgcagacccctgctccctgatccccacacctgacaaagaagatgatgaccgggtttacccaaactcaacgtgcaagcctcggattattgcaccatccagaggctccccgctgcctgtactgagctgggcaaatagagaggaagtctggaaaatcatgttaaacaaggaaaagacatacttaagggatcagcactttcttgagcaacaccctcttctgcagccaaaaatgcgagcaattcttctggattggttaatggaggtgtgtgaagtctataaacttcacagggagaccttttacttggcacaagatttctttgaccggtatatggcgacacaagaaaatgttgtaaaaactcttttacagcttattgggatttcatctttatttattgcagccaaacttgaggaaatctatcctccaaagttgcaccagtttgcgtatgtgacagatggagcttgttcaggagatgaaattctcaccatggaattaatgattatgaaggcccttaagtggcgtttaagtcccctgactattgtgtcctggctgaatgtatacatgcaggttgcatatctaaatgacttacatgaagtgctactgccgcagtatccccagcaaatctttatacagattgcagagctgttggatctctgtgtcctggatgttgactgccttgaatttccttatggtatacttgctgcttcggccttgtatcatttctcgtcatctgaattgatgcaaaaggtttcagggtatcagtggtgcgacatagagaactgtgtcaagtggatggttccatttgccatggttataagggagacggggagctcaaaactgaagcacttcaggggcgtcgctgatgaagatgcacacaacatacagacccacagagacagcttggatttgctggacaaagcccgagcaaagaaagccatgttgtctgaacaaaatagggcttctcctctccccagtgggctcctcaccccgccacagagcggtaagaagcagagcagcgggccggaaatggcgtgaccaccccatccttctccaccaaagacagttgcgcgcctgctccacgttctcttctgtctgttgcagcggaggcgtgcgtttgcttttacagatatctgaatggaagagtgtttcttccacaacagaagtatttctgtggatggcatcaaacagggcaaagtgttttttattgaatgcttataggttttttttaaataagtgggtcaagtacaccagccacctccagacaccagtgcgtgctcccgatgctgctatggaaggtgctacttgacctaagggactcccacaacaacaaaagcttgaagctgtggagggccacggtggcgtggctctcctcgcaggtgttctgggctccgttgtaccaagtggagcaggtggttgcgggcaagcgttgtgcagagcccatagccagctgggcagggggctgccctctccacattatcagttgacagtgtacaatgcctttgatgaactgttttgtaagtgctgctatatctatccattttttaataaagataatactgtttttgag

SEQ ID NO: 1207 - DNA, 4087 bp, Homo sapiens
cgatggggagcggcggcgtggtccactgtaggtgtgccaagtgtttctgttatcctacaaagcgaagaataaggaggaggccccgaaacctgaccatcttgagtctccccgaagatgtgctctttcacatcctgaaatggctttctgtagaggacatcctggccgtccgagctggctgctgaaaaggggaatttcgaagctgctgtgaagctgggcatagcctacctctacaatgaaggcctgtctgtgtctgatgaggcccgcgcagaagtgaatggcctgaaggcctctcgcttcttcagtctcgctgagcggctgaatgtgggtgccgcacctttcatctggctcttcatccgccctccgtggtcggtgagcggaagctgctgcaaggccgtggttcacgagagcctcagggcagagtgccagctgcagaggactcacaaagcatccatattgcactgcttgggcagagtgctgagtctgttcgaggatgaggagaagcagcagcaggcccatgacctgtttgaggaggctgctcatcagggatgtctgaccagctcctacctcctctgggaaagcgacaggaggacagatgtgtcagatcctgggcgatgcctccacagcttccgaaaactcagggactacgctgccaaaggctgctgggaagcgcagctgtctttagccaaagcctgtgcaaatgcaaaccagcttggactggaggtgagagcttccagtgagatcgtctgccagctatttcaggcttcccaggctgtcagtaaacaacaagtcttctccgtgcagaagggactcaatgacacaatgaggtacattctgatcgactggctggtggaagttgccaccatgaaggacttcacaagcctgtgcctgcacctgaccgtggagtgtgtggaccggtacctgcggaggaggctggtgccgcggtacaggctccagctgctgggcatcgcctgcatggtcatctgcacccggtttatcagtaaagagatcctgaccatccgggaggccgtatggctcacggacaacacttacaagtacgaggacctggtgagaatgatgggcgagatcgtctccgccttggaagggaagattcgagtccccactgtggtggattacaaggaggtcctgctgacgctagtccctgtggagctgagaacccagcacctgtgcagcttcctctgcgagctctccctgctgcacaccagcctgtccgcctacgccccagcccgcctggctgccgcagccctgctcctggccagactgacgcacgggcagacacagccctggaccactcagctgtgggacctcaccggattctcctatgaagacctcattccctgcgtcttgagcctccataagaagtgcttccatgatgacgcccccaaggactacaggcaagtctctctgaccgccgtgaagcagcggtttgaggacaagcgctatggagaaatcagccaggaagaggtgctgagctacagccagttgtgtgctgcattaggagtgacacaagacagccccgaccccccgactttcctcagcacaggggagatccacgccttcctcagctctccctcggggcggagaaccaaacggaagcgggagaacagcctccaggaagacagaggcagcttcgttaccacccccactgcggagctgtccagccaggaggagacgctgctgggcagcttcctcgactggagcctggactgctgctctggctatgaaggcgaccaggagagtgagggcgagaaggagggcgacgtgacagctcccagcggcatcctcgatgtcaccgtggtctacctgaacccagaacagcattgctgccaggaatccagtgatgaggaggcttgtccagaggacaagggaccccaggacccacaggcactggcgctggacacccagatccctgcaacccctggacccaaacccctggtccgcaccagccgggagccagggaaggacgtcacgacctcagggtactcctccgtcagcaccgcaagtcccacaagctccgtggacggtggcttgggggccctgccccaacctacctcagtgctgtccctggacagtgactcgcacacacagccctgccaccatcaggccaggaagtcatgtttacagtgtcgtcccccaagtcccccggagagcagtgttccccagcaacaggtgaagcggataaacctatgcatacacagtgaggaggaggacatgaacctgggccttgtgaggctgtaagtgtgtcagcacatttgccgcagtggatgtgtactgagggggctggaggcgaagggtgggagcatagcataggaacgctgcatagaccatggaggcctttgcgcagagagcagagaggatgacttgcggccaccaagtttctgtctccgcgggagtcccgtgcaagccatcagaatgttgaaatgagggtgaagagctcagatccctctctttggaaagtttagcctggaagcagttggccacactgtgtggagggcacctctctgtcccttccgtgtctcactgtctctggaagcttcagcccatgtgtgtcctggtgttcccagccccaccagagccccgtgccgggagctgacagctttcacgcttaaggcacgtgtgacctgggtagtcagacaccacttgagcccctgcccacatctgctggtttggggcttcagtggggagctgacagctgtgagcacaccactgtcccctcatccacctcggcctgcatggggcacccacttccttctgggtggggcttccatggtaagggggcctgcgtccctgcacactgcgaggactgccttggccacaggcccactccctacgacacgtgactcgttttagagctctgtcccagaggcgttcgtatgtgacccacagatggcgtcaatgtgaacacctctctttgtgctgaatttctgggccattcttttcctgtcttatttctaaatttccttcttccaagatgaaaacaaaagaaaaacttaaaacagaaggtattaaaaaaacaagagattcccaccattatttaggttcacctgcaaaacaaaaatcttactccagcccctcaatgccatcctgacacactttatgcaaaaagaattttcccagataggctagccagaaaaaacttcaagtcctctgtaacatctgaggtgaccaagaggcagaagagcagagcagtcgggggccgtgtcctggctgatcccaactgcagctctgctgtgggggcccgtgggagggaggcagacccctgggctttcctgctggccacggagactctgctcctgcatggaaagggagcctgggagccagcagcccacgcctggggagcctgcctggggccatgtgaccatggcctctccctgggaacgggctgaccacaacacaccctgctgccatccacttctgtttactctgcaaatgtaagaaagaaccacttggccagaagtgtcccccagatgcttttttttttttttttttggagacagttttgctcttgtctccccggctggagtgcagtggcatgatctcaactctcaactcactgtaacctccgcctcccggatactcctgcctcagcctcctgggtagctgggattacaagcacccaaccacgcccagctaatttttgtattttcggtagagacgggatttcaccatgttggccaggctagtctcgaactcatgacctcaagtgatccgcccacttcggtctcccaaagtgctgggattacaggcatgagccacggcgcctggcccccaaatgctcttgaaccggaaacccagggatgggagatgctcactgagctgctgcttttatgtgtgctggtgctatgtgtgttcatgtccgcggcagctgtctttttgctactataagggaattctggccaccctgggtggggtgtggtcggggtgagaacccaagcgttggaactgtagacccgtcctgtcgactgtgtgcccctgggcatgtgtgagcctcagtttcctcatctgtaaggggggcaatgatacctacctcacaggggtgttgtgaggattaaatgtgaggaggatagtg

SEQ ID NO: 1208 - DNA, 4258 bp, Homo sapiens
gctccggccggggcgcgggcgcgctctcaggcgggctccggcggcagcgacgcgagcgcggcgatggggagcggcggcgtggtccactgtaggtgtgccaagtgtttctgttatcctacaaagcgaagaataaggaggaggccccgaaacctgaccatcttgagtctccccgaagatgtgctctttcacatcctgaaatggctttctgtagaggacatcctggccgtccgagctgtacactcccagctgaaggacctggtggacaaccacgccagtgtgtgggcatgtgccagcttccaggagctgtggccgtctccagggaacctgaagctctttgaaagggctgctgaaaaggggaatttcgaagctgctgtgaagctgggcatagcctacctctacaatgaaggcctgtctgtgtctgatgaggcccgcgcagaagtgaatggcctgaaggcctctcgcttcttcagtctcgctgagcggctgaatgtgggtgccgcacctttcatctggctcttcatccgccctccgtggtcggtgagcggaagctgctgcaaggccgtggttcacgagagcctcagggcagagtgccagctgcagaggactcacaaagcatccatattgcactgcttgggcagagtgctgagtctgttcgaggatgaggagaagcagcagcaggcccatgacctgtttgaggaggctgctcatcagggatgtctgaccagctcctacctcctctgggaaagcgacaggaggacagatgtgtcagatcctgggcgatgcctccacagcttccgaaaactcagggactacgctgccaaaggctgctgggaagcgcagctgtctttagccaaagcctgtgcaaatgcaaaccagcttggactggaggtgagagcttccagtgagatcgtctgccagctatttcaggcttcccaggctgtcagtaaacaacaagtcttctccgtgcagaagggactcaatgacacaatgaggtacattctgatcgactggctggtggaagttgccaccatgaaggacttcacaagcctgtgcctgcacctgaccgtggagtgtgtggaccggtacctgcggaggaggctggtgccgcggtacaggctccagctgctgggcatcgcctgcatggtcatctgcacccggtttatcagtaaagagatcctgaccatccgggaggccgtatggctcacggacaacacttacaagtacgaggacctggtgagaatgatgggcgagatcgtctccgccttggaagggaagattcgagtccccactgtggtggattacaaggaggtcctgctgacgctagtccctgtggagctgagaacccagcacctgtgcagcttcctctgcgagctctccctgctgcacaccagcctgtccgcctacgccccagcccgcctggctgccgcagccctgctcctggccagactgacgcacgggcagacacagccctggaccactcagctgtgggacctcaccggattctcctatgaagacctcattccctgcgtcttgagcctccataagaagtgcttccatgatgacgcccccaaggactacaggcaagtctctctgaccgccgtgaagcagcggtttgaggacaagcgctatggagaaatcagccaggaagaggtgctgagctacagccagttgtgtgctgcattaggagtgacacaagacagccccgaccccccgactttcctcagcacaggggagatccacgccttcctcagctctccctcggggcggagaaccaaacggaagcgggagaacagcctccaggaagacagaggcagcttcgttaccacccccactgcggagctgtccagccaggaggagacgctgctgggcagcttcctcgactggagcctggactgctgctctggctatgaaggcgaccaggagagtgagggcgagaaggagggcgacgtgacagctcccagcggcatcctcgatgtcaccgtggtctacctgaacccagaacagcattgctgccaggaatccagtgatgaggaggcttgtccagaggacaagggaccccaggacccacaggcactggcgctggacacccagatccctgcaacccctggacccaaacccctggtccgcaccagccgggagccagggaaggacgtcacgacctcagggtactcctccgtcagcaccgcaagtcccacaagctccgtggacggtggcttgggggccctgccccaacctacctcagtgctgtccctggacagtgactcgcacacacagccctgccaccatcaggccaggaagtcatgtttacagtgtcgtcccccaagtcccccggagagcagtgttccccagcaacaggtgaagcggataaacctatgcatacacagtgaggaggaggacatgaacctgggccttgtgaggctgtaagtgtgtcagcacatttgccgcagtggatgtgtactgagggggctggaggcgaagggtgggagcatagcataggaacgctgcatagaccatggaggcctttgcgcagagagcagagaggatgacttgcggccaccaagtttctgtctccgcgggagtcccgtgcaagccatcagaatgttgaaatgagggtgaagagctcagatccctctctttggaaagtttagcctggaagcagttggccacactgtgtggagggcacctctctgtcccttccgtgtctcactgtctctggaagcttcagcccatgtgtgtcctggtgttcccagccccaccagagccccgtgccgggagctgacagctttcacgcttaaggcacgtgtgacctgggtagtcagacaccacttgagcccctgcccacatctgctggtttggggcttcagtggggagctgacagctgtgagcacaccactgtcccctcatccacctcggcctgcatggggcacccacttccttctgggtggggcttccatggtaagggggcctgcgtccctgcacactgcgaggactgccttggccacaggcccactccctacgacacgtgactcgttttagagctctgtcccagaggcgttcgtatgtgacccacagatggcgtcaatgtgaacacctctctttgtgctgaatttctgggccattcttttcctgtcttatttctaaatttccttcttccaagatgaaaacaaaagaaaaacttaaaacagaaggtattaaaaaaacaagagattcccaccattatttaggttcacctgcaaaacaaaaatcttactccagcccctcaatgccatcctgacacactttatgcaaaaagaattttcccagataggctagccagaaaaaacttcaagtcctctgtaacatctgaggtgaccaagaggcagaagagcagagcagtcgggggccgtgtcctggctgatcccaactgcagctctgctgtgggggcccgtgggagggaggcagacccctgggctttcctgctggccacggagactctgctcctgcatggaaagggagcctgggagccagcagcccacgcctggggagcctgcctggggccatgtgaccatggcctctccctgggaacgggctgaccacaacacaccctgctgccatccacttctgtttactctgcaaatgtaagaaagaaccacttggccagaagtgtcccccagatgcttttttttttttttttttggagacagttttgctcttgtctccccggctggagtgcagtggcatgatctcaactctcaactcactgtaacctccgcctcccggatactcctgcctcagcctcctgggtagctgggattacaagcacccaaccacgcccagctaatttttgtattttcggtagagacgggatttcaccatgttggccaggctagtctcgaactcatgacctcaagtgatccgcccacttcggtctcccaaagtgctgggattacaggcatgagccacggcgcctggcccccaaatgctcttgaaccggaaacccagggatgggagatgctcactgagctgctgcttttatgtgtgctggtgctatgtgtgttcatgtccgcggcagctgtctttttgctactataagggaattctggccaccctgggtggggtgtggtcggggtgagaacccaagcgttggaactgtagacccgtcctgtcgactgtgtgcccctgggcatgtgtgagcctcagtttcctcatctgtaaggggggcaatgatacctacctcacaggggtgttgtgaggattaaatgtgaggaggatagtggca

SEQ ID NO: 1209 - DNA, 2458 bp, Homo sapiens
agggcaggcgcggccccttcggctccgagctgaccctgatcagggccgagttgtctcggcggcgctgccgaggcctccacccaggacagtccccctccccgggcctctctcctcttgcctacgagtcccctctcctcgtaggcctctcggatctgatatcgtggggtgaggtgagcaggcccggggagggtggttaccgctgaggagctgcagtctctgtcaagatgatagaggtactgacaacaactgactctcagaaactgctacaccagctgaatgccctgttggaacaggagtctagatgtcagccaaaggtctgtggtttgagactaattgagtctgcacacgataatggcctcagaatgactgcaagactaagggactttgaagtaaaagatcttcttagtctaactcagttctttggctttgacacagagacattttctctagctgtgaatttactggacagattcctgtctaaaatgaaggtacagcccaagcaccttgggtgtgttggactgagctgcttttatttggctgtaaaatcaatagaagaggaaaggaatgtcccattggcaactgacttgatccgaataagtcaatataggtttacggtttcagacttgatgagaatggaaaagattgtattggagaaggtgtgttggaaagtcaaagctactactgcctttcaatttctgcaactgtattattcactccttcaagagaacttgccacttgaaaggagaaatagcattaattttgaaagactagaagctcaactgaaggcatgtcattgcaggatcatattttctaaagcaaagccttctgtgttggcattgtctatcattgcattagagatccaagcacagaagtgtgtagagttaacagaaggaatagaatgtcttcagaaacattccaagataaatggcagagatctgaccttctggcaagagcttgtatccaaatgtttaactgaatattcatcaaataagtgttccaaaccaaatgttcagaagttgaaatggattgtttctgggcgtactgcacggcaattgaagcatagctactacagaataactcaccttccaacaattcctgaaatggtcccttaactggattattacagcaccaaaaaacttctctgaagcctttctccacaaccttgttctatggattccataatgttacaatggatttaagctatgaagcctcaaaacatcacgagataagcatgatggtctcagacttgggaaaactgcctaatattatgctgtagtggaattatgtttagatttgaattcatctgtgaagcattcaaatcaaagctaaaagcctaaatgtgaaatgctaatgacaagcctgagaaggtaaactgtgaatcttcatttctatcattgatctaactttagatattggatcaatatatttaggtggtattgaaaatgctattggaggagtcacactaatactatcaactatcagtcttcccacagcttcaatcactgtcattattctaatcctactcctacttaaattttaagttatgaggtttatgtcaaaagcaacatttcacaaatgtacttttaaggcataataagggttaacattctaggcagtataaacacaccccataatgcaagtaataggtaatctagagatgtggactttattgctatatgggaattacatttaaatttgagggcattttatataaagaaaaatacagacctataaagtttggcatattcattaagttatcttttaatatttttttctagaaaacaggtgacatttgtatctacgataaaaatttttatacagaacctactgcctcaaactgaatcccatcaagaaaactagtttctattgtattagtaactcaaaataaattatcacttcgaaaacttgctttcccacactaaggtaagttcagactagattgaacactccagaattttttactacagactgtttttaagttagaagtgatggcaattttataaatagagaatatacttccactgatgcccttactgtgccaaaacaaaaatcttaagaaaagcaagtagacaccttcataactatgaatgaagctgctgaagtagtgtttaggatcctccatggcagttagtgaatgtaagaagtacagtgttaaagtgttgtaaacagttactcagtgcaatgtatagcctgagtctatccatgatggctatatccaatttgacatcacgttatggatcagtacacaatgaaaaaccaaagaaccacagtatatcttattcttaacttttgtaaaccatgttttatgggtaactttttagttttcccaaaaggctgataaatttcaatattttgaatacatcattgttaattttgagttggcagaggtaaactaaccaactaccattatgttttagtactaagggatatacctttcaataaagttaatgaaattcaa

SEQ ID NO: 1210 - DNA, 2366 bp, Homo sapiens
attcctcgttagggcaggcgcggccccttcggctccgagctgaccctgatcagggccgagttgtctcggcggcgctgccgaggcctccacccagggagggtggttaccgctgaggagctgcagtctctgtcaagatgatagaggtactgacaacaactgactctcagaaactgctacaccagctgaatgccctgttggaacaggagtctagatgtcagccaaaggtctgtggtttgagactaattgagtctgcacacgataatggcctcagaatgactgcaagactaagggactttgaagtaaaagatcttcttagtctaactcagttctttggctttgacacagagacattttctctagctgtgaatttactggacagattcctgtctaaaatgaaggtacagcccaagcaccttgggtgtgttggactgagctgcttttatttggctgtaaaatcaatagaagaggaaaggaatgtcccattggcaactgacttgatccgaataagtcaatataggtttacggtttcagacttgatgagaatggaaaagattgtattggagaaggtgtgttggaaagtcaaagctactactgcctttcaatttctgcaactgtattattcactccttcaagagaacttgccacttgaaaggagaaatagcattaattttgaaagactagaagctcaactgaaggcatgtcattgcaggatcatattttctaaagcaaagccttctgtgttggcattgtctatcattgcattagagatccaagcacagaagtgtgtagagttaacagaaggaatagaatgtcttcagaaacattccaagataaatggcagagatctgaccttctggcaagagcttgtatccaaatgtttaactgaatattcatcaaataagtgttccaaaccaaatgttcagaagttgaaatggattgtttctgggcgtactgcacggcaattgaagcatagctactacagaataactcaccttccaacaattcctgaaatggtcccttaactggattattacagcaccaaaaaacttctctgaagcctttctccacaaccttgttctatggattccataatgttacaatggatttaagctatgaagcctcaaaacatcacgagataagcatgatggtctcagacttgggaaaactgcctaatattatgctgtagtggaattatgtttagatttgaattcatctgtgaagcattcaaatcaaagctaaaagcctaaatgtgaaatgctaatgacaagcctgagaaggtaaactgtgaatcttcatttctatcattgatctaactttagatattggatcaatatatttaggtggtattgaaaatgctattggaggagtcacactaatactatcaactatcagtcttcccacagcttcaatcactgtcattattctaatcctactcctacttaaattttaagttatgaggtttatgtcaaaagcaacatttcacaaatgtacttttaaggcataataagggttaacattctaggcagtataaacacaccccataatgcaagtaataggtaatctagagatgtggactttattgctatatgggaattacatttaaatttgagggcattttatataaagaaaaatacagacctataaagtttggcatattcattaagttatcttttaatatttttttctagaaaacaggtgacatttgtatctacgataaaaatttttatacagaacctactgcctcaaactgaatcccatcaagaaaactagtttctattgtattagtaactcaaaataaattatcacttcgaaaacttgctttcccacactaaggtaagttcagactagattgaacactccagaattttttactacagactgtttttaagttagaagtgatggcaattttataaatagagaatatacttccactgatgcccttactgtgccaaaacaaaaatcttaagaaaagcaagtagacaccttcataactatgaatgaagctgctgaagtagtgtttaggatcctccatggcagttagtgaatgtaagaagtacagtgttaaagtgttgtaaacagttactcagtgcaatgtatagcctgagtctatccatgatggctatatccaatttgacatcacgttatggatcagtacacaatgaaaaaccaaagaaccacagtatatcttattcttaacttttgtaaaccatgttttatgggtaactttttagttttcccaaaaggctgataaatttcaatattttgaatacatcattgttaattttgagttggcagaggtaaactaaccaactaccattatgttttagtactaagggatatacctttcaataaagttaatgaaattc

SEQ ID NO: 1211 - DNA, 564 bp, Homo sapiens
cccttcggctccgagctgaccctgatcagggccgagttgtctcggcggcgctgccgaggcctccacccaggacagtccccctccccgggcctctctcctcttgcctacgagtcccctctcctcgtaggcctctcggatctgatatcgtggggtgagatgatagaggtactgacaacaactgactctcagaaactgctacaccagctgaatgccctgttggaacaggagtctagatgtcagccaaaggtctgtggtttgagactaattgagtctgcacacgataatggcctcagaatgactgcaagactaagggactttgaagtaaaagatcttcttagtctaactcagttctttggctttgacacagagacattttctctagctgtgaatttactggacagattcctgtctaaaatgaaggtacagcccaagcaccttgggtgtgttggactgagctgcttttatttggctgtaaaatcaatagaagaggaaaggaatgtcccattggcaactgacttgatccgaataagtcaatataggtttacggtttcagacttgatgaga

SEQ ID NO: 1212 - DNA, 564 bp, Homo sapiens; identical to SEQ ID NO: 1211

SEQ ID NO: 1213 - DNA, 994 bp, Homo sapiens
ccctgatcagggccgagttgtctcggcggcgctgccgaggcctccacccaggacagtccccctccccgggcctctctcctcttgcctacgagtcccctctcctcgtaggcctctcggatctgatatcgtggggtgaggtgagcaggcccggggagggtggttaccgctgaggagctgcagtctctgtcaagatgatagaggtactgacaacaactgactctcagaaactgctacaccagctgaatgccctgttggaacaggagtctagatgtcagccaaagacttgatgagaatggaaaagattgtattggagaaggtgtgttggaaagtcaaagctactactgcctttcaatttctgcaactgtattattcactccttcaagagaacttgccacttgaaaggagaaatagcattaattttgaaagactagaagctcaactgaaggcatgtcattgcaggatcatattttctaaagcaaagccttctgtgttggcattgtctatcattgcattagagatccaagcacagaagtgtgtagagttaacagaaggaatagaatgtcttcagaaacattccaagataaatggcagagatctgaccttctggcaagagcttgtatccaaatgtttaactgaatattcatcaaataagtgttccaaaccaaatgttcagaagttgaaatggattgtttctgggcgtactgcacggcaattgaagcatagctactacagaataactcaccttccaacaattcctgaaatggtcccttaactggattattacagcaccaaaaaacttctctgaagcctttctccacaaccttgttctatggattccataatgttacaatggatttaagctatgaagcctcaaaacatcacgagataagcatgatggtctcagacttgggaaaactgcctaatattatgctgtagtggaattatgtttagatttgaattcatctgtgaagcattcaaatcaaagctaaaagcc

SEQ ID NO: 1214 - DNA, 418 bp, Homo sapiens
gagctgaccctgatcagggccgagttgtctcggcggcgctgccgaggcctccacccaggacagtctctgtcaagatgatagaggtactgacaacaactgactctcagaaactgctacaccagctgaatgccctgttggaacaggagtctagatgtcagccaaaggtctgtggtttgagactaattgagtctgcacacgataatggcctcagaatgactgcaagactaagggactttgaagtaaaagatcttcttagtctaactcagttctttggctttgacacagagacattttctctagctgtgaatttactggacagattcctgtctaaaatgaaggtacagcccaagcaccttgggtgtgttggactgagctgcttttatttggctgtaaaatcaatagaagaggaaaggaatgt

SEQ ID NO: 1215 - DNA, 1143 bp, Homo sapiens
ccccttcggctccgagctgaccctgatcagggccgagttgtctcggcggcgctgccgaggcctccacccagggagggtggttaccgctgaggagctgcagtctctgtcaaggtacagcccaagcaccttgggtgtgttggactgagctgcttttatttggctgtaaaatcaatagaagaggaaaggaatgtcccattggcaactgacttgatccgaataagtcaatataggtttacggtttcagacttgatgagaatggaaaagattgtattggagaaggtgtgttggaaagtcaaagctactactgcctttcaatttctgcaactgtattattcactccttcaagagaacttgccacttgaaaggagaaatagcattaattttgaaagactagaagctcaactgaaggcatgtcattgcaggatcatattttctaaagcaaagccttctgtgttggcattgtctatcattgcattagagatccaagcacagaagtgtgtagagttaacagaaggaatagaatgtcttcagaaacattccaagataaatggcagagatctgaccttctggcaagagcttgtatccaaatgtttaactgaatattcatcaaataagtgttccaaaccaaatgttcagaagttgaaatggattgtttctgggcgtactgcacggcaattgaagcatagctactacagaataactcaccttccaacaattcctgaaatggtcccttaactggattattacagcaccaaaaaacttctctgaagcctttctccacaaccttgttctatggattccataatgttacaatggatttaagctatgaagcctcaaaacatcacgagataagcatgatggtctcagacttgggaaaactgcctaatattatgctgtagtggaattatgtttagatttgaattcatctgtgaagcattcaaatcaaagctaaaagcctaaatgtgaaatgctaatgacaagcctgagaaggtaaactgtgaatcttcatttctatcattgatctaactttagatattggatcaatatatttaggtggtattgaaaatgctattggaggagtcacactaatactatcaactatcagtcttcccacagcttcaatcactgtcattattctaatcc

SEQ ID NO: 1216 - DNA, 919 bp, Homo sapiens
atattcctcgttagggcaggcgcggccccttcggctccgagctgaccctgatcagggccgagttgtctcggcggcgctgccgaggcctccacccaggacagtccccctccccgggcctctctcctcttgcctacgagtcccctctcctcgtaggcctctcggatctgatatcgtggggtgaggtgagcaggcccggggagggtggttaccgctgaggagctgcagtctctgtcaaggtacagcccaagcaccttgggtgtgttggactgagctgcttttatttggctgtaaaatcaatagaagaggaaaggaatgtcccattggcaactgacttgatccgaataagtcaatataggtttacggtttcagacttgatgagaatggaaaagattgtattggagaaggtgtgttggaaagtcaaagctactactgcctttcaatttctgcaactgtattattcactccttcaagagaacttgccacttgaaaggagaaatagcattaattttgaaagactagaagctcaactgaaggcatgtcattgcaggatcatattttctaaagcaaagccttctgtgttggcattgtctatcattgcattagagatccaagcacagaagtgtgtagagttaacagaaggaatagaatgtcttcagaaacattccaagataaatggcagagatctgaccttctggcaagagcttgtatccaaatgtttaactgaatattcatcaaataagtgttccaaaccaaatgttcagaagttgaaatggattgtttctgggcgtactgcacggcaattgaagcatagctactacagaataactcaccttccaacaattcctgaaatggtcccttaactggattattacagcaccaaaaaacttctctgaagcctttctccacaaccttgttctat

SEQ ID NO: 1217 - DNA, 2796 bp, Homo sapiens
ggccccttcggctccgagctgaccctgatcagggccgagttgtctcggcggcgctgccgaggcctccacccagggagggtggttaccgctgaggagctgcagtctctgtcaagatgatagaggtactgacaacaactgactctcagaaactgctacaccagctgaatgccctgttggaacaggagtctagatgtcagccaaagagacattttctctagctgtgaatttactggacagattcctgtctaaaatgaaggtacagcccaagcaccttgggtgtgttggactgagctgcttttatttggctgtaaaatcaatagaagaggaaaggaatgtcccattggcaactgacttgatccgaataagtcaatataggtttacggtttcagacttgatgagaatggaaaagattgtattggagaaggtgtgttggaaagtcaaagctactactgcctttcaatttctgcaactgtattattcactccttcaagagaacttgccacttgaaaggagaaatagcattaattttgaaagactagaagctcaactgaaggcatgtcattgcaggatcatattttctaaagcaaagccttctgtgttggcattgtctatcattgcattagagatccaagcacagaagtgtgtagagttaacagaaggaatagaatgtcttcagaaacattccaagataaatggcagagatctgaccttctggcaagagcttgtatccaaatgtttaactgaatattcatcaaataagtgttccaaaccaaatgttcagaagttgaaatggattgtttctgggcgtactgcacggcaattgaagcatagctactacagaataactcaccttccaacaattcctgaaatggtcccttaactggattattacagcaccaaaaaacttctctgaagcctttctccacaaccttgttctatggattccataatgttacaatggatttaagctatgaagcctcaaaacatcacgagataagcatgatggtctcagacttgggaaaactgcctaatattatgctgtagtggaattatgtttagatttgaattcatctgtgaagcattcaaatcaaagctaaaagcctaaatgtgaaatgctaatgacaagcctgagaagaaaacaggtgacatttgtatctacgataaaaatttttatacagaacctactgcctcaaactgaatcccatcaagaaaactagtttctattgtattagtaactcaaaataaattatcacttcgaaaacttgctttcccacactaagaaaccaaaaaacagtaaacatgagtcaagatgaattaaaagataagccaatttttaaggccgagcgcagtggctcacacctgtaatcccagcactttgggaggccaaggtggacggatcacttgaggccaggagttcgagaccagcatggccaacatggtgaaaccccatctctactaaaaatacaaaaatcagctgggtgtggtggcgcatgcctgtagtaccagttactccagagactgaggcaggagaattgcttgaacctgtgaggcagtgagacaagatcacaccactgctctccaacctgggcaacagagtgaggctcttgtctcaaaaaataaattaaaaagccatttttatattcatcaaagtagagttaggaacaaccaaaattgccaaggataattagggacattatataatgataaaattcaccaagacagtgctaaaagtgtaagcacttattatcagatcttaaaaatacatgaagagaccaggtacagagactcattcattcctgtaattccaatgctttgggaagccaaggtgggaggattgcttgaggccaagagttcaagaccagcctactcaacatagggagaccctatctctacaaaaaatcaaaaattagctaggcatagtgatatacatctgtagtcctaggtactgaggagcctgaggtgggaagactgtctgagcccaggagtttgaggctgcagtgaagcatgacagagttgctatgctccagcctgagtgacagggtaagactcaaaaaaaaaaaaaaaaacatgaagcaaaaagtggtagcattaaaaggaggactggacaaatcttcatttacagttggaaacttaaacattcctctctcagtagtccatagaattaatagaaaattagcaaagatgtaggaaaatggaataatactaataaccagctagatttaattgacataaaacccttctacctaaaacagcagaataagcattcttttcaagtacacatggaacactcaccaagataaaccacatcatgggtcttaaaccttaacaaatttaaaagagatgaaatcatataaaatatgttttttgaccataatctagaaatcagtaacagcaagaaaatctccaaacacttggaaattaaacaacacatttctaaataactcatgatactacagggaagtcttaaaaaatattttaaaataaatgaaaatatcaccgtgcttggaatgcagccatgctggtgctgcaatttataacaatcgactgctttttactaaacaagaaaaagttctcaaattaacactctaagctcccactttaagaaagtaggaaaatctaactgggtgtggtggcacaccactatagtcccagccactcagaaggctgaggtaggaggatcatgaccccacgagtttgaggctgcagtgagctatgatcataacactactccagtctgggtgatgaagtgagacctgtctacaaaaaaaagaagcccaaactaaacctaaagcaagc

SEQ ID NO: 1218 - DNA, 5526 bp, Homo sapiens
aagtgcaggatccctccgcggggagtcacgtgccccgcccccttgggggcgtcgaaactcttaacaaaaacaaggggctcggggaggtttccgctgaggcggcgggggtgcggcggtgggctggtcttccgcggccggcgttgcgccgcggcggagggtgggcgcgcggggagcgggatggagccggggctgtgaggccgaggcggcggtgcctgggaggaagggtcggatgccggaccgggggcaccgctgaggcggtgggtccccgacctgcgagacaggtttggaagcccccgctgcgcccagtccgtgcggaccgcgaggccgcgggcgggtggaggcgcgtctccggcacgatgaaggatttgggggcagagcacttggcaggtcatgaaggggtccaacttctcgggttgttgaacgtctacctggaacaagaagagagattccaacctcgagaaaaagggctgagtttgattgaggctaccccggagaatgataacactttgtgtccaggattgagaaatgccaaagttgaagatttaaggagtttagccaacttttttggatcttgcactgaaacttttgtcctggctgtcaatattttggacaggttcttggctcttatgaaggtgaaacctaaacatttgtcttgcattggagtctgttcttttttgctggctgctagaatagttgaagaagactgcaatattccatccactcatgatgtgatccggattagtcagtgtaaatgtactgcttctgacataaaacggatggaaaaaataatttcagaaaaattgcactatgaattggaagctactactgccttaaactttttgcacttataccatactattatactttgtcatacttcagaaaggaaagaaatactgagccttgataaactagaagctcagctgaaagcttgcaactgccgactcatcttttcaaaagcaaaaccatctgtattagccttgtgccttctcaatttggaagtggaaactttgaaatctgttgaattactggaaattctcttgctagttaaaaaacattccaagattaatgacactgagttcttctactggagagagttggtttctaaatgcctagccgagtattcttctcctgaatgttgcaaaccagatcttaagaagttggtttggatcgtttcaaggcgcacagcccagaacctccacaacagctactatagtgttcctgagctgccaacgatacctgaggggggttgttttgatgaaagtgaaagtgaggactcttgtgaagatatgagttgtggagaggagagtctcagcagctctcctcccagtgatcaagagtgcaccttctttttcaacttcaaagtggcacaaacactgtgctttccatcttagaaatctgattgttctgtcagaatttatatttacaggtttcaaagcaataaatgggggaataggtagtttcctggtttagcccccatctagtcaggaattaatatactggaatacctaccttctatttgttattcagatcagatctggcctattttcatatttatcctaagccatcaaatggggtagtgcctcttaaaccattaacagtactttagacattggcactttatttttctcgtagatctttagctactttggggaggagggaaggtgctgataccttcaatttgttacttttcaagatttttaaaaataactagtgtagcttatcttaaacattttataaaaccttcagatgtctttaagcagattggaagtatgcaagtgcttccttagcagggacagtggataatccttaatggtttatcatagatttcaccctccccccttctcagaagagtgagtatgctcttaaatgtcaaacacatttttgttgttttgttttttaaatgatcagtgtctatttgatgtgatgcagatcttataaatttgggaattataatattgacatttctgtgatttttatatatgtaatgtcttaattgagatttctgttaaggcagaaataattaggctagggctcttagttttcattcctattgcccaagtattgtcaaactatggtattattttaatgttactttaaaaatccataatctgctagttttgcatgtacttatatgaaaacagtgcagtaagttgaaaactcagtatctatggaattgataaatgttgatctggtgtagtatattttatcgcattttcttatattaaaaaatgtctgcatgattacattttatttcctttgtaatttacatttcagaatagtgtattgctatatgggtgccaagattgaatatgaagaacccgagtgtttgtagtattatagttttaagcaaatctgtgtggtgatacagccataagaatggggcttatataaactctgtacatgtaagattttgtacagagaatttttaactttataaattgtatatgaacatgtaaatcttttaaaatgtacataaaatactgtatttttttaccttgtgtgtgatagtctagtcattgcatgtaaatataatttattatgtattctgtagtataaatcatacattgatgacttacatttttactggtaagtcaacatccgttggatgttttctgaagtggctctttttgaagtgataatagattgtaattcaaaataaaattattaatgaattctccttgtttgggatcacatcttaatttttaatctgttaaaagttcttgatgtattttaatgagaagactttaggtgaggctacagtgattccagagtgagccttctaactggctagcagaagttctctaggtttggcatctgtgccttggagatactgaaagagaatctgtcatttgacaattgacctctttgtgggatggactcattaagtatgctctcagagactggtatattaccagaatgcctattaattttcagtgagaggcaacaggtattaagtagaacagaatgctcaggttggcagattagaacgatctttcaggagacaaagcaagttttaatcagttgtttggttaataagtatggggtgttcgctgtgatagggccccgccagcttctggctcttgtggacctcaaaagtatcaggtggttttgcaagtggtggtcctttcccctgccccaccccaataggttccccatctgtctagtttgatttttgtagacctttgttttctctagttagaaaatcaggtacactgaatatggttttcatgtaacacctcttctctggagataggggtatgttttcctacccttctagtggagaatcctacttgaggatgacctttcctctcttactaaataatattagtaaatagtgggcaatatattctgctttcagattttgatttgttgagatgtaaaagttgtttggggcttaccaaatctcaagactctctttagctcctgcaggattgtattgcttttcttactggatatttttcctgggtaagcatctttgtggcttcatctcttccccctgtggttttcagtgtatttagtcgagacctctctgctgagcttgcaacctgtttattcacatggcctgccatgccacttggaggtttctgattactcccaaacctgctggttctttatgtctttctcagcgaataattccatctattcatgttggaaacttaggtgatatgctcatctccttttgcctgtttatggaggtcaccagcctctatcatttgtatgatttcgtttacactgtttatatctctctgtcccccctttttctgccattggcatggtttagacctgtactctttatcagcagaggtactgtaatatatttgtgatccctcagcttccaggcttactcctggtctctgccttcctatctacatatccttttaaaataaaattttaactatctcctgaaaaattgttgagtaggtcacgcacaatcaggagaaaaatctattcatgacatacaagtctctgtctaatctgaacactgcacctgtctctggcctttttttcttgtcatttcctagaccttaaaaaatgtgtattgagaaagaactctgttagctatacagaagatgaactgggcaatatagagtagcagcatggagaccagtctgactgaactaaggcagtggaagtgtggatgaggaagagaggtgaaaattgagaagcgctatcctttctctttgggcattattaggaggctcacagacaagtccaggagcctggttataccctcctgtgccattcaaccaggtggctttcccatgactgtgatgaataaaattgagaagcccctgcccttttcagagcagagggtgaggagaaagctaccattttgtcctcatccttacccccgttgacttggcgagagatttgacctttcaggttttgatcctgtcattttctaggatgtggtgcacgcactttgctgttgcgcatggtgaagtattgtgcctaggtcctgggtcttcatctgtttggctctgctactgtttcctcctcccaggaagtgtggttagacaaataatgtgttttaattacctgtcacactcaggattaatacatactcaggttaactgtagagaggcattggcttcagaacactcctcgtgacaattttaaccattttctttgtctagagtctgcctttttcttttttacaatttcttttatttcaacactaggtttcaatatggtgttcctgctacctcccacctccctcctccctcatcacacatgcaaattgtcagcttattgagacaacccacttagattcatatatggacaaggacaaggtattttgcatttgttactggaattcagttttcctaactatttactaccagaaatggtcaataacttactttgtgtttagcaaatcaaattgtgtgatagatagtttcccagtatgatggccagtcagtctttccatccctgtgcctacatgctgctcttcccgtccacaagtggagtctgtttctcttgagttttggctggccttatgaatggctttgcttactgaagtgcagcagaagaaatttagtatatgtccaagcctaggctttaagagactggcagctttccttttatcctttttggaagctagccaccatgctgcaaagaagctcagctggattactgaaagatgagaggccatgtggagagagactcttgaggatgagagattatcttggatgttccagccttaagctcccagctgaatgtgggtgtatcctcagctacaccacagaaaacagaggaactactcagtcgatcccaatcaacccacagactcactagaaataacaaattattgttttaagccacgaggttttgggggagggttgttaaacagtaatagataagtgagacagattgcttgttatttatggtcaaatggtgattatctctggtgagattacaggtgatgttttttttaagttatgcctatctgtagtttcctttttttcctaaaattgatttgaattattagtgtattaacagaataaagaatgaactttaaaacac

SEQ ID NO: 1219 - DNA, 1338 bp, Homo sapiens
gaaactcttaacaaaaacaaggggctcggggaggtttccgctgaggcggcgggggtgcggcggtgggctggtcttccgcggccggcgttgcgccgcggcggagggtgggcgcgcggggagcgggatggagccggggctgtgaggccgaggcggcggtgcctgggaggaagggtcggatgccggaccgggggcaccgctgaggcggtgggtccccgacctgcgagacaggtttggaagcccccgctgcgcccagtccgtgcggaccgcgaggccgcgggcgggtggaggcgcgtctccggcacgatgaaggatttgggggcagagcacttggcaggtcatgaaggggtccaacttctcgggttgttgaacgtctacctggaacaagaagagagattccaacctcgagaaaaagggctgagtttgattgaggctaccccggagaatgataacactttgtgtccaggattgagaaatgccaaagttgaagatttaaggagtttagccaacttttttggatcttgcactgaaacttttgtcctggctgtcaatattttggacaggttcttggctcttatgaaggtgaaacctaaacatttgtcttgcattggagtctgttcttttttgctggctgctagaatagttgaagaagactgcaatattccatccactcatgatgtgatccggattagtcagtgtaaatgtactgcttctgacataaaacggatggaaaaaataatttcagaaaaattgcactatgaattggaagctactactgccttaaactttttgcacttataccatactattatactttgtcatacttcagaaaggaaagaaatactgagccttgataaactagaagctcagctgaaagcttgcaactgccgactcatcttttcaaaagcaaaaccatctgtattagccttgtgccttctcaatttggaagtggaaactttgaaatctgttgaattactggaaattctcttgctagttaaaaaacattccaagattaatgacactgagttcttctactggagagagttggtttctaaatgcctagccgagtattcttctcctgaatgttgcaaaccagatcttaagaagttggtttggatcgtttcaaggcgcacagcccagaacctccacaacagctactatagtgttcctgagctgccaacgatacctgaggggggttgttttgatgaaagtgaaagctctgttgcccaggctggagtgcagtggcccgatctcagctcattccaacctccacctaccaggttcaagcgattctcatgcctcagcctccggagtagctgggattacagctcctggacctga

SEQ ID NO: 1220 - DNA, 1410 bp, Homo sapiens
ggtcttacccagcgctggccggcggacctgaccacggctcctccccctgccacacctccctggccgtggtggggattgccctggggctctggcggacgtgactggtcccttcacccgctccttgtcggggtgtgctggggcgacccttgctggaggtactggcctcagccctttctcccgcttccccacccctcttacccccagattacattctctgtgtggtgtctttactgcagatgaaggatttgggggcagagcacttggcaggtcatgaaggggtccaacttctcgggttgttgaacgtctacctggaacaagaagagagattccaacctcgagaaaaagggctgagtttgattgaggctaccccggagaatgataacactttgtgtccaggattgagaaatgccaaagttgaagatttaaggagtttagccaacttttttggatcttgcactgaaacttttgtcctggctgtcaatattttggacaggttcttggctcttatgaaggtgaaacctaaacatttgtcttgcattggagtctgttcttttttgctggctgctagaatagttgaagaagactgcaatattccatccactcatgatgtgatccggattagtcagtgtaaatgtactgcttctgacataaaacggatggaaaaaataatttcagaaaaattgcactatgaattggaagctactactgccttaaactttttgcacttataccatactattatactttgtcatacttcagaaaggaaagaaatactgagccttgataaactagaagctcagctgaaagcttgcaactgccgactcatcttttcaaaagcaaaaccatctgtattagccttgtgccttctcaatttggaagtggaaactttgaaatctgttgaattactggaaattctcttgctagttaaaaaacattccaagattaatgacactgagttcttctactggagagagttggtttctaaatgcctagccgagtattcttctcctgaatgttgcaaaccagatcttaagaagttggtttggatcgtttcaaggcgcacagcccagaacctccacaacagctactatagtgttcctgagctgccaacgatacctgaggggggttgttttgatgaaagtgaaagtgaggactcttgtgaagatatgagttgtggagaggagagtctcagcagctctcctcccagtgatcaagagtgcaccttctttttcaacttcaaagtggcacaaacactgtgctttccatcttagaaatctgattgttctgtcagaatttatatttacaggtttcaaagcaataaatgggggaataggtagtttcctggtttagcccccatctagtcaggaattaatatactggaatacctaccttctatttgttattcagatc

SEQ ID NO: 1221 - DNA, 1459 bp, Homo sapiens
cttaacaaaaacaaggggctcggggaggaagggtcggatgccggaccgggggcaccgctgaggcggtgggtccccgacctgcgagacaggtttggaagcccccgctgcgcccagtccgtgcggaccgcgaggccgcgggcgggtggaggcgcgtctccggcacgatgaaggatttgggggcagagcacttggcaggtcatgaaggggtccaacttctcgggttgttgaacgtctacctggaacaagaagagagattccaacctcgagaaaaagggctgagtttgattgaggctaccccggagaatgataacactttgtgtccaggattgagaaatgccaaagttgaagatttaaggagtttagccaacttttttggatcttgcactgaaacttttgtcctggctgtcaatattttggacaggttcttggctcttatgaaggtgaaacctaaacatttgtcttgcattggagtctgttcttttttgctggctgctagaatagttgaagaagactgcaatattccatccactcatgatgtgatccggattagtcagtgtaaatgtactgcttctgacataaaacggatggaaaaaataatttcagaaaaattgcactatgaattggaagctactactgccttaaactttttgcacttataccatactattatactttgtcatacttcagaaaggaaagaaatactgagccttgataaactagaagctcagctgaaagcttgcaactgccgactcatcttttcaaaagcaaaaccatctgtattagccttgtgccttctcaatttggaagtggaaactttgaaatctgttgaattactggaaattctcttgctagttaaaaaacattccaagattaatgacactgagttcttctactggagagagttggtttctaaatgcctagccgagtattcttctcctgaatgttgcaaaccagatcttaagaagttggtttggatcgtttcaaggcgcacagcccagaacctccacaacagctactatagtgttcctgagctgccaacgatacctgaggggggttgttttgatgaaagtgaaagtgaggactcttgtgaagatatgagttgtggagaggagagtctcagcagctctcctcccagtgatcaagagtgcaccttctttttcaacttcaaagtggcacaaacactgtgctttccatcttagaaatctgattgttctgtcagaatttatatttacaggtttcaaagcaataaatgggggaataggtagtttcctggtttagcccccatctagtcaggaattaatatactggaatacctaccttctatttgttattcagatcagatctggcctattttcatatttatcctaagccatcaaatggggtagtgcctcttaaaccattaacagtactttagacattggcactttatttttctcgtagatctttagctactttgggg

SEQ ID NO: 1222 - DNA, 578 bp, Homo sapiens
ctggccgtggtggggattgccctggggctctggcggacgtgactggtcccttcacccgctccttgtcggggtgtgctggggcgacccttgctggagatgaaggatttgggggcagagcacttggcaggtcatgaaggggtccaacttctcgggttgttgaacgtctacctggaacaagaagagagattccaacctcgagaaaaagggctgagtttgattgaggctaccccggagaatgataacactttgtgtccaggattgagaaatgccaaagttgaagatttaaggagtttagccaacttttttggatcttgcactgaaacttttgtcctggctgtcaatattttggacaggttcttggctcttatgaaggtgaaacctaaacatttgtcttgcattggagtctgttcttttttgctggctgctagaatagttgaagaagactgcaatattccatccactcatgatgtgatccggattagtcagtgtaaatgtactgcttctgacataaaacggatggaaaaaataatttcagaaaaattgcactatgaattggaagctactactgccttaaactt

SEQ ID NO: 1223 - DNA, 1378 bp, Homo sapiens
gggcgccctaacgaacccgggatacggtctgttcctagtccgctccggaaatgcaactgcgtacgggctggccgcgtaatcgtgacgacagcgcgccagcgccggctagccggacgccctaggcttccgcgagatcttcggtgggggtacgggtgttttacgccaggacgctgatgcgtttgggttctcgtctgcagaccctctggacctggtcacgattccataatgtaccacaacagtagtcagaagcggcactggaccttctccagcgaggagcagctggcaagactgcgggctgacgccaaccgcaaattcagatgcaaagccgtggccaacgggaaggttcttccgaatgatccagtctttcttgagcctcatgaagaaatgacactctgcaaatactatgagaaaaggttattggaattctgttcggtgtttaagccagcaatgccaagatctgttgtgggtacggcttgtatgtatttcaaacgtttttatcttaataactcagtaatggaatatcaccccaggataataatgctcacttgtgcatttttggcctgcaaagtagatgaattcaatgtatctagtcctcagtttgttggaaacctccgggagagtcctcttggacaggagaaggcacttgaacagatactggaatatgaactacttcttatacagcaacttaatttccaccttattgtccacaatccttacagaccatttgagggcttcctcatcgacttaaagacccgctatcccatattggagaatccagagattttgaggaaaacagctgatgactttcttaatagaattgcattgacggatgcttaccttttatacacaccttcccaaattgccctgactgccattttatctagtgcctccagggctggaattactatggaaagttatttatcagagagtctgatgctgaaagagaacagaacttgcctgtcacagttactagatataatgaaaagcatgagaaacttagtaaagaagtatgaaccacccagatctgaagaagttgctgttctgaaacagaagttggagcgatgtcattctgctgagcttgcacttaacgtaatcacgaagaagaggaaaggctatgaagatgatgattacgtctcaaagaaatccaaacatgaggaggaagaatggactgatgacgacctggtagaatctctctaaccatttgaagttgatttctcaatgctaactaatcaagagaagtaggaagcatatcaaacgtttaactttatttaaaaagtataatgtgaaaacataaaatatattaaaacttttctattgttttctttccctttcacagtaactttatgtaaaataaaccatcttcaaaagagctagaata

SEQ ID NO: 1224 - DNA, 2391 bp, Homo sapiens
gcaaatactatgagaaaaggttattggaattctgttcggtgtttaagccagcaatgccaagatctgttgtgggtacggcttgtatgtatttcaaacgtttttatcttaataactcagtaatggaatatcaccccaggataataatgctcacttgtgcatttttggcctgcaaagtagatgaattcaatgtatctagtcctcagtttgttggaaacctccgggagagtcctcttggacaggagaaggcacttgaacagatactggaatatgaactacttcttatacagcaacttaatttccaccttattgtccacaatccttacagaccatttgagggcttcctcatcgacttaaagacccgctatcccatattggagaatccagagattttgaggaaaacagctgatgactttcttaatagaattgcattgacggatgcttaccttttatacacaccttcccaaattgccctgactgccattttatctagtgcctccagggctggaattactatggaaagttatttatcagagagtctgatgctgaaagagaacagaacttgcctgtcacagttactagatataatgaaaagcatgagaaacttagtaaagaagtatgaaccacccagatctgaagaagttgctgttctgaaacagaagttggagcgatgtcattctgctgagcttgcacttaacgtaatcacgaagaagaggaaaggctatgaagatgatgattacgtctcaaagaaatccaaacatgaggaggtatgttttactccaaagatgaactctaagttatttttgttatacattctggtgtgactatactgttaagatttattctccaagagtacaggcattatagagttgtgggttttttcattttttgcatacttccttacgtacagtactgttgtccattattaaagggatttttctctcttctgtctttatttaatgaagaatccttcctgtgttcatagaaagcagaagcaatatgtatacatactacatttttgctttttttcttattctccaaggatttttcccttacccccttttaaaaaaaattttctatctgtcaagtcaaataagtgaataatcagaggcaaaaggtcacagccataacctttattcctcactggaggagtctggtgagaccatgccaacattactaacagtgaactattacaaaatttcctggtttatcttttgtaatccacatgggtaaaaggaggagaacattttcttaaagggaggtaagaggtaaacaatactggttatgcttcagtgttatccttaccacactttttttccttcttaggaagaatggactgatgacgacctggtagaatctctctaaccatttgaagttgatttctcaatgctaactaatcaagagaagtaggaagcatatcaaacgtttaactttatttaaaaagtataatgtgaaaacataaaatatattaaaacttttctattgttttctttccctttcacagtaactttatgtaaaataaaccatcttcaaaagagctagaatagcacctgttttgaatattcttattccatcgtgactaatatcaaattaaagctgcaactcatttgcctaattttttaagcaaaatatgataggcaaacctatgctttttttaaaaaaggcaccacaaaaaacaaaacttagtagccagctttaaaagtgttaaggaatgtgttttgccctctagaaacctttataaatggctttttgaatgccatcctgatatatttagctatttgtccattactattaaactgcagaaggtatttcaactgttacatggtactgaaagccagtcgtctgggtaatgaatattatttttctttagttacccgaaaacatttccaaatgggtttttaaaaaaaaccagatatatgattttgaatagctgtctacatcaaactcttacgctagtatagataagtaggtagcagcaaattgtatattcagttgtggttgttttttaattttgttttgatgtaaggtcttgctatgttgcccaggctgtctcagactcctaggctctagtgatcctctgcctcagttttctgagtaattgggactacaggcacacatcaccacagccttataattaacctattagatcctataagtgaatccgtgtaagtagattataacagttactaggaattttgcagattaaatatgttagagaaatgtaattcaaattgaaatgagtcaatataaaaatatgaaagcacagactattacagcaaattacttacatatgaatcatggccagctgtatttcactatgtgaccttggtaagttattaaacctctaagtgccagtttcccacactgaaaatggggaagataaaaatgcctact

SEQ ID NO: 1225 - DNA, 1497 bp, Homo sapiens
gccctaggcttccgcgagatcttcggtgggggtacgggtgttttacgccaggacgctgatgcgtttgggttctcgtctgcagaccctctggacctggtcacgattccataatgtaccacaacagtagtcagaagcggcactggaccttctccagcgaggagcagctggcaagactgcgggctgacgccaaccgcaaattcagatgcaaagccgtggccaacgggaaggtgaggttttcccaacggttgcccagttgcccggtcactaaattctgagcagctgcgggagctcttctggctcccaggacaatctcgctccgtcgtttctctgcctctgcggcgcggagtgcgtttttctatcaaaataagcgagcaccttgccaggttccgtgggtacaaagacgaacaacgccatccccgtcgtcgaatggcagacaagtaaccagtctttgtaacgtagtgaagaagagagttcttccgaatgatccagtctttcttgagcctcatgaagaaatgacactctgcaaatactatgagaaaaggttattggaattctgttcggtgtttaagccagcaatgccaagatctgttgtgggtacggcttgtatgtatttcaaacgtttttatcttaataactcagtaatggaatatcaccccaggataataatgctcacttgtgcatttttggcctgcaaagtagatgaattcaatgtatctagtcctcagtttgttggaaacctccgggagagtcctcttggacaggagaaggcacttgaacagatactggaatatgaactacttcttatacagcaacttaatttccaccttattgtccacaatccttacagaccatttgagggcttcctcatcgacttaaagacccgctatcccatattggagaatccagagattttgaggaaaacagctgatgactttcttaatagaattgcattgacggatgcttaccttttatacacaccttcccaaattgccctgactgccattttatctagtgcctccagggctggaattactatggaaagttatttatcagagagtctgatgctgaaagagaacagaacttgcctgtcacagttactagatataatgaaaagcatgagaaacttagtaaagaagtatgaaccacccagatctgaagaagttgctgttctgaaacagaagttggagcgatgtcattctgctgagcttgcacttaacgtaatcacgaagaagaggaaaggctatgaagatgatgattacgtctcaaagaaatccaaacatgaggaggaagaatggactgatgacgacctggtagaatctctctaaccatttgaagttgatttctcaatgctaactaatcaagagaagtaggaagcatatcaaacgtttaactttatttaaaaagtataatgtgaaaacataaaatatattaaaacttttctattgttttctttccctttcacagtaactttatgtaaaataaaccatcttcaaaaga

SEQ ID NO: 1226 - DNA, 1433 bp, Homo sapiens
agtgagaggccgggggtgtggtagagagaaggagccggccgggtacttaggaccgcgccagcctctgagcccggcctccttcgcactttcgagtgcgcgtttgctgcccgccgcagcccgggcgttgaaggtagtaaagcggccacccggccgcatcatggtgaccccctgtcccaccagcccctcgagccccgccgcccgagcggggaggcgggacaacgaccagaaccttcgcgccccggtgaagaagagcaggcgtccgcgcctccggaggaagcagccgctgcatcccctgaacccgtgcccgctcccgggagactccggcatttgcgacctgttcgagtcccccagctccggctcagacggcgcagagagcccctctgcggcgcggggtggtagccccctgcccggcccggcccagcccgtggcgcagctagatctacagaccttccgcgactacggccagagctgctacgccttccgcaaggcgcaggagagccacttccacccgcgggaggcgctggcacggcagccacaagtgacggcggaatcccgctgtaagctgctcagctggctgatcccggtgcaccgccaattcggcctctccttcgagtcgctgtgcctgacggtgaacactctggaccgcttcctcaccaccacgccggtggctgcagactgcttccagctgcttggggtcacctccttgctcatcgcttgcaaacaggtggaggtgcacccgccgcgcgtgaagcagcttctggccctctgctgcggcgccttctcccggcagcagctctgcaacctcgagtgcatcgtgctgcacaagctgcacttcaccctgggtgcgcccaccattagcttcttcctggagcatttcacgcacgctcgcgtggaggcggggcaggctgaggcctccgaagctctggaagcgcaagccctggcgcggggggtggcagagctgagtctggccgactatgccttcaccagctactccccttccctcctggcgatctgctgcctggcgctggcggaccgcatgctgcgggtctcgcggcccgtggacttgcgactgggagaccacccggaggcggcgctggaggactgtatgggcaagttgcagctgctggtggccataaacagtacttccttgactcacatgctgcccgttcagatctgcgagaagtgcagcctgcccccgagctcgaaataaaacagatccttcgtttccttttagtccctggcccggctgctggacctctcccgtagcctcagaagagtgcagtactggtccacagagaaggcttcaggacctgcttggtcagctgcaggttgtaaatagtgtacgatactagcatctggtattttatttattttgcagcgagcacatgaggaagctgagtctttcaccaataaacagttgtggtttgtctaaa

SEQ ID NO: 1227 - DNA, 6973 bp, Homo sapiens
gcatattggctgttaactcggctacggggtgtagcgaggtgcattccggaagtaggtcctttgacttttgcttcctctacggaggcaagtaacaacccggcggtcgacgcttagcggaagttcgtcaagtcgcagttgcccccgcacagcggatgtgggtcgcctcttaggtgacgctgggaagtgcctgcagccttcgccgctgccttctggttgaagcactatggagggagagaggaagaacaacaacaaacggtggtatttcactcgagaacagctggaaaatagcccatcccgtcgttttggcgtggacccagataaagaactttcttatcgccagcaggcggccaatctgcttcaggacatggggcagcgtcttaacgtctcacaattgactatcaacactgctatagtatacatgcatcgattctacatgattcagtccttcacacagttccctggaaattctgtggctccagcagccttgtttctagcagctaaagtggaggagcagcccaaaaaattggaacatgtcatcaaggtagcacatacttgtctccatcctcaggaatcccttcctgatactagaagtgaggcttatttgcaacaagttcaagatctggtcattttagaaagcataattttgcagactttaggctttgaactaacaattgatcacccacatactcatgtagtaaagtgcactcaacttgttcgagcaagcaaggacttagcacagacttcttacttcatggcaaccaacagcctgcatttgaccacatttagcctgcagtacacacctcctgtggtggcctgtgtctgcattcacctggcttgcaagtggtccaattgggagatcccagtctcaactgacgggaagcactggtgggagtatgttgacgccactgtgaccttggaacttttagatgaactgacacatgagtttctacagattttggagaaaactcccaacaggctcaaacgcatttggaattggagggcatgcgaggctgccaagaaaacaaaagcagatgaccgaggaacagatgaaaagacttcagagcagacaatcctcaatatgatttcccagagctcttcagacacaaccattgcaggtttaatgagcatgtcaacttctaccacaagtgcagtgccttccctgccagtctccgaagagtcatccagcaacttaaccagtgtggagatgttgccgggcaagcgttggctgtcctcccaaccttctttcaaactagaacctactcagggtcatcggactagtgagaatttagcacttacaggagttgatcattccttaccacaggatggttcaaatgcatttatttcccagaagcagaatagtaagagtgtgccatcagctaaagtgtcactgaaagaataccgcgcgaagcatgcagaagaattggctgcccagaagaggcaactggagaacatggaagccaatgtgaagtcacaatatgcatatgctgcccagaatctcctttctcatcatgatagccattcttcagtcattctaaaaatgcccatagagggttcagaaaaccccgagcggccttttctggaaaaggctgacaaaacagctctcaaaatgagaatcccagtggcaggtggagataaagctgcgtcttcaaaaccagaggagataaaaatgcgcataaaagtccatgctgcagctgataagcacaattctgtagaggacagtgttacaaagagccgagagcacaaagaaaagcacaagactcacccatctaatcatcatcatcatcataatcaccactcacacaagcactctcattcccaacttccagttggtactgggaacaaacgtcctggtgatccaaaacatagtagccagacaagcaacttagcacataaaacctatagcttgtctagttctttttcctcttccagttctactcgtaaaaggggaccctctgaagagactggaggggctgtgtttgatcatccagccaagattgccaagagtactaaatcctcttccctaaatttctccttcccttcacttcctacaatgggtcagatgcctgggcatagctcagacacaagtggcctttccttttcacagcccagctgtaaaactcgtgtccctcattcgaaactggataaagggcccactggggccaatggtcacaacacgacccagacaatagactatcaagacactgtgaatatgcttcactccctgctcagtgcccagggtgttcagcccactcagcccactgcatttgaatttgttcgtccttatagtgactatctgaatcctcggtctggtggaatctcctcgagatctggcaatacagacaaaccccggccaccacctctgccatcagaacctcctccaccacttccaccccttcctaagtaaaaaaagaaaaagaagaggagaaaaaaacttctttaaaaaaacacataatttttcttttttttttttggactaagaaaattacttatgaaatatgtcatccttggactagggaataaattgatattgagacatagttaggagggtggtagaaggccttggctatatatctgctgtctcatgcatttaactattttcttacagtttttactggtattagagaggtgttgaagctgtgaaggattaaggacacattctgaattcttggcctctccaccatctaattaggttgattggagttgatatcttccctcttcttgccagagctgaaaaatggagggtttcttgtatcagacaattgtggatcctttcggtgtttaatatatcagaagagaggaagtatttaaacgtcaaatcttttaatagacttaataatttaaagaaagtaagttatctgtttagtttttttatataattgggaaggggatagggattttgctgtgtgtatatgatacatagcagtaactcctggtgggtgggattggagggtgggaatgtgtgagggtgggtgggaggctaggtttttggctaggagttctgaaataggctcaggccacttttttcagacttttaagtgtgtatgtaagtgtgggtatgtgtgtttttaagtgtgtgtgtttaaaaataatgttttatcttccctccctgttccttaccgttttcattttccaacagtctactagagaaaaacatggttggccttgagaacataaaggaagaggcatgtatttgacatggtatttttccctttctttatgttataattgagtagtagccctctaatttgtagtttgggcaagtacagccaacaccctgactcttaaccttattatgagaacttcctttttacccctttttttgtttttgtgcaaaacagagatggggttgaggaaggagggttggcgagcaaggccagcttctgccctacagaattgggtgtgtcttttttttcaagtgaggctttgggaaagtgttcaaatgagagcagtcttaaggtctctaagagatggggaatgtgctatgtatatcctgcctgtgaaagcccaaaccatatgggagaagctagaggatactaaaaacaatgaaattgtgatttggaagtttagaacattgttttaaaaattacattataaatgtaagacatgctttttatgtgtatatccgaagggaaacagctacatcctcaagtttttgcagcctatatgacttgagattggagcttgtgaatttaacagtactggtgccatgagaatgagcaaagcctagccaatggatactattgtgtttagattgttcatctttggtagctttaggttcttgatcgaggttcttaagatttctaagtcctttataaaaataggtcaagagtcctgttgttatggaggcttgattatcccagatattaggagtgaacatttttaataaatctttcagaaaatcttggctagaaagaattctaagttagttgtctaaccactgaaaactacctagccagagatcatttaatgagatattctttgatcttcattgcattttttttgctctggaaaaggtggttcaatttgagtttgttttcatgatttgattgcagcttacttcatgccaaggattttttagggagaggtcgaattatttttcatttggaagtcatagggagacaggagttgtacttatgctgctacttgccaggaacaggttgggaagaaaattgtggctgttggaattgatgatgtactggcctaatatagaaaggaatttgtaggcaggagtaaacgttaactgacggtgggttagtgccctgcatcttgcatatttgaactgtctagagttcctgccattgctgggtataaaacgaggagctctctgttgacctgtaaatcattaatacttcttgacttagagtgtcacttcactttatagatgacattttcctctttccccttgatattttctatgttgtgttagataattggtagatatatagttgtggtttagtacatttagggcttctatttatttagattttgtttgttggagtctgtttccaaaagggaatgtgccatttagtctgcatctgtatctttgtggacttgatgatcactggtttgattttgaaaaatgtcttttccagcttttagttactctcatcaaatgtcacatattttctaatcacatgcactcctttaccacagaggcacataatcatttggcctcatagcagttatccatggccgtactgtagtaaagttccttagaactttgccaggagtgaactagaaaaaagtgcttactagggcctaagagttgctttgtgccgtgtagtccggcctttgcactagtagatcattgctgacataggtcagtttagagacctttctgtgttaatgcctcctggtactgtcttaagatacgtacagtgtctgtttttagatctatgcatatgtcatgaagctccttgtgggctctgcatgaagctgctgctttgtttttgggttaacagatgtgcctgtcaactagcatgtgtattgtccaaattccataaacttaaggtttttaagggctgtgtggtttctgagctctatgtgtctttcctatccttgtaccttcaaagggtgagaaatgagatttatacatccaaagttagtctgataaatatggctttttgtttctccatgtaacctagactgtcaaaaataagtgatggtgataagtaggcctggagcctcagcttctgtaaatctcattcctaaaattttgctagactcgtgttggcaaaaacaaatacctgtggattgtccttaaggcttttaatcagatacctgtgttgctgttagctgaactgtagtgaagcatcgatccaaatcggtcttctgaagtatcagttatgcttttgagtttagaaaatacttaggtgttagtctagtcttcccattcatgaatcagtgtatgtccatatcagagagcctcaacttcttttttcttcctttttaaaaatgattttagtgttttgatttagtgtatactacatagttcagtattattggctttaccagtgttgacagaaaaattttaaatctccagttgcaaacagcaatggattaggatatggaaataaaatcatggtgacatcactgctgagttatcttaaacctctgctacttaattctccatattgaaatgcatactcctccacatacatggcttccaagtaaaggcaattgtagaggggccctgtctatcccagtatggttggattttaaacatatctgtgtttccgttattttgggaactgattaatatttacaattttttttgtttatgagttattttgatactaagaaaagagagaatctagaacatcttgcagttgaaatacaaattttattcttttggtcttgggagaatttaagcagtctatgcaactcatcaaatggtgagaaatagccctccgaggttccagtaagctttcagtgactttgatacctccccaagtttcttgagttgctgcttgttaacacccagcttttaactgagtgtttgctcctgatggtttaggagattttcatgttgtatcacactgtcaagttttattttgtctttttatccctccgtggatgtgagtttgaaacaagcacggtacagtaatcctgcctgatagagtagtctggaatgagaattactttttgggtgagagagttctccattttaatgtttctaaagtttttcatatgaacttggcattggaaaagggaggtaaagaaaaaggacgtttactaaaagcagtgtctactcttcccctttgtgagtgtttattcatggctaatgaaaaaaagagaaggactcttgggttttgtgttgccatgttaagcatggagagggatgcttgacagcatgctaattgaagccagagcaagtatgtccttcatcaggtaatcaggaactcttcagttgaagctgaggaactaactgattagttgttgatcataatataattggttacaaagtggaagtgccagctggcttaagtacccaaagaaaagaatgcagcagcctaacttagtgttaccatatgttactgaatttgaaactgaccttttttcccaccctacttcacacacctaaaactcttttcttgtcagaccaaagagcgaaaagaaaaaaaaaagtaaaacactttaccaatctgtcactcaggtacaattttgtggtgagatttttgtctgttctctttgtattgctcttaagagtcctttctcagcatattattctgccattgcctctgtcttccttggggcacctcagctctggatgctacccctgggatatctactgctgttatgtgaatgataggaggtaagtgaccattatagtaagggctctttgtaaaaaaattcaaaaaatttaaaaaggatgtatacattttatagtctggctatcagtttgatatcttgctgtcaagtatgtttctcaatctgtatttatccatcccatcaataaatgttaatggtaaaa

SEQ ID NO: 1228 - DNA, 1733 bp, Homo sapiens
agcgcggtgagtttgaaactgctcgcacttggcttcaaagctggctcttggaaattgagcggagagcgacgcggttgttgtagctgccgctgcggccgccgcggaataataagccgggatctaccatacccattgactaactatggaagattataccaaaatagagaaaattggagaaggtacctatggagttgtgtataagggtagacacaaaactacaggtcaagtggtagccatgaaaaaaatcagactagaaagtgaagaggaaggggttcctagtactgcaattcgggaaatttctctattaaaggaacttcgtcatccaaatatagtcagtcttcaggatgtgcttatgcaggattccaggttatatctcatctttgagtttctttccatggatctgaagaaatacttggattctatccctcctggtcagtacatggattcttcacttgttaaggtagtaacactctggtacagatctccagaagtattgctggggtcagctcgttactcaactccagttgacatttggagtataggcaccatatttgctgaactagcaactaagaaaccacttttccatggggattcagaaattgatcaactcttcaggattttcagagctttgggcactcccaataatgaagtgtggccagaagtggaatctttacaggactataagaatacatttcccaaatggaaaccaggaagcctagcatcccatgtcaaaaacttggatgaaaatggcttggatttgctctcgaaaatgttaatctatgatccagccaaacgaatttctggcaaaatggcactgaatcatccatattttaatgatttggacaatcagattaagaagatgtagctttctgacaaaaagtttccatatgttatatcaacagatagttgtgtttttattgttaactcttgtctatttttgtcttatatatatttctttgttatcaaacttcagctgtacttcgtcttctaatttcaaaaatataacttaaaaatgtaaatattctatatgaatttaaatataattctgtaaatgtgtgtaggtctcactgtaacaactatttgttactataataaaactataatattgatgtcaggaatcaggaaaaaatttgagttggcttaaatcatctcagtccttatggcagttttattttcctgtagttggaactactaaaatttaggaaaatgctaagttcaagtttcgtaatgctttgaagtatttttatgctctgaatgtttaaatgttctcatcagtttcttgccatgttgttaactatacaacctggctaaagatgaatatttttctactggtattttaatttttgacctaaatgtttaagcattcggaatgagaaaactatacagatttgagaaatgatgctaaatttataggagttttcagtaacttaaaaagctaacatgagagcatgccaaaatttgctaagtcttacaaagatcaagggctgtccgcaacagggaagaacagttttgaaaatttatgaactatcttatttttaggtaggttttgaaagctttttgtctaagtgaattcttatgccttggtcagagtaataactgaaggagttgcttatcttggctttcgagtctgagtttaaaactacacattttgacatagtgtttattagcagccatctaaaaaggctctaatgtatatttaactaaaattactagctttgggaattaaactgttt

SEQ ID NO: 1229 - DNA, 1613 bp, Homo sapiens
ccattgactaactatggaagattataccaaaatagagaaaattggagaaggtacctatggagttgtgtataagggtagacacaaaactacaggtcaagtggtagccatgaaaaaaatcagactagaaagtgaagaggaaggggttcctagtactgcaattcgggaaatttctctattaaaggaacttcgtcatccaaatatagtcagtcttcaggatgtgcttatgcaggattccaggttatatctcatctttgagtttctttccatggatctgaagaaatacttggattctatccctcctggtcagtacatggattcttcacttgttaaggtagtaacactctggtacagatctccagaagtattgctggggtcagctcgttactcaactccagttgacatttggagtataggcaccatatttgctgaactagcaactaagaaaccacttttccatggggattcagaaattgatcaactcttcaggattttcagagctttgggcactcccaataatgaagtgtggccagaagtggaatctttacaggactataagaatacatttcccaaatggaaaccaggaagcctagcatcccatgtcaaaaacttggatgaaaatggcttggatttgctctcgaaaatgttaatctatgatccagccaaacgaatttctggcaaaatggcactgaatcatccatattttaatgatttggacaatcagattaagaagatgtagctttctgacaaaaagtttccatatgttatatcaacagatagttgtgtttttattgttaactcttgtctatttttgtcttatatatatttctttgttatcaaacttcagctgtacttcgtcttctaatttcaaaaatataacttaaaaatgtaaatattctatatgaatttaaatataattctgtaaatgtgtgtaggtctcactgtaacaactatttgttactataataaaactataatattgatgtcaggaatcaggaaaaaatttgagttggcttaaatcatctcagtccttatggcagttttattttcctgtagttggaactactaaaatttaggaaaatgctaagttcaagtttcgtaatgctttgaagtatttttatgctctgaatgtttaaatgttctcatcagtttcttgccatgttgttaactatacaacctggctaaagatgaatatttttctactggtattttaatttttgacctaaatgtttaagcattcggaatgagaaaactatacagatttgagaaatgatgctaaatttataggagttttcagtaacttaaaaagctaacatgagagcatgccaaaatttgctaagtcttacaaagatcaagggctgtccgcaacagggaagaacagttttgaaaatttatgaactatcttatttttaggtaggttttgaaagctttttgtctaagtgaattcttatgccttggtcagagtaataactgaaggagttgcttatcttggctttcgagtctgagtttaaaactacacattttgacatagtgtttattagcagccatctaaaaaggctctaatgtatatttaactaaaattactagctttgggaattaaactgtttaacaaataa

SEQ ID NO: 1230 - DNA, 1913 bp, Homo sapiens
agcgcggtgagtttgaaactgctcgcacttggcttcaaagctggctcttggaaattgagcggagagcgacgcggttgttgtagctgccgctgcggccgccgcggaataataagccgggatctaccatacccattgactaactatggaagattataccaaaatagagaaaattggagaaggtacctatggagttgtgtataagggtagacacaaaactacaggtcaagtggtagccatgaaaaaaatcagactagaaagtgaagaggaaggggttcctagtactgcaattcgggaaatttctctattaaaggaacttcgtcatccaaatatagtcagtcttcaggatgtgcttatgcaggattccaggttatatctcatctttgagtttctttccatggatctgaagaaatacttggattctatccctcctggtcagtacatggattcttcacttgttaagagttatttataccaaatcctacaggggattgtgttttgtcactctagaagagttcttcacagagacttaaaacctcaaaatctcttgattgatgacaaaggaacaattaaactggctgattttggccttgccagagcttttggaatacctatcagagtatatacacatgaggtagtaacactctggtacagatctccagaagtattgctggggtcagctcgttactcaactccagttgacatttggagtataggcaccatatttgctgaactagcaactaagaaaccacttttccatggggattcagaaattgatcaactcttcaggattttcagagctttgggcactcccaataatgaagtgtggccagaagtggaatctttacaggactataagaatacatttcccaaatggaaaccaggaagcctagcatcccatgtcaaaaacttggatgaaaatggcttggatttgctctcgaaaatgttaatctatgatccagccaaacgaatttctggcaaaatggcactgaatcatccatattttaatgatttggacaatcagattaagaagatgtagctttctgacaaaaagtttccatatgttatatcaacagatagttgtgtttttattgttaactcttgtctatttttgtcttatatatatttctttgttatcaaacttcagctgtacttcgtcttctaatttcaaaaatataacttaaaaatgtaaatattctatatgaatttaaatataattctgtaaatgtgtgtaggtctcactgtaacaactatttgttactataataaaactataatattgatgtcaggaatcaggaaaaaatttgagttggcttaaatcatctcagtccttatggcagttttattttcctgtagttggaactactaaaatttaggaaaatgctaagttcaagtttcgtaatgctttgaagtatttttatgctctgaatgtttaaatgttctcatcagtttcttgccatgttgttaactatacaacctggctaaagatgaatatttttctactggtattttaatttttgacctaaatgtttaagcattcggaatgagaaaactatacagatttgagaaatgatgctaaatttataggagttttcagtaacttaaaaagctaacatgagagcatgccaaaatttgctaagtcttacaaagatcaagggctgtccgcaacagggaagaacagttttgaaaatttatgaactatcttatttttaggtaggttttgaaagctttttgtctaagtgaattcttatgccttggtcagagtaataactgaaggagttgcttatcttggctttcgagtctgagtttaaaactacacattttgacatagtgtttattagcagccatctaaaaaggctctaatgtatatttaactaaaattactagctttgggaattaaactgtttaacaaataa

SEQ ID NO: 1231 - DNA, 1948 bp, Homo sapiens
gctggctcttggaaattgagcggagagcgacgcggttgttgtagctgccgctgcggccgccgcggaataataagccgggtacagtggctggggtcagggtcgtgtctaggggacggccgagggcctcggagggcgagtattgaggaacggggtcctctaagaaggccggactggaggatctaccatacccattgactaactatggaagattataccaaaatagagaaaattggagaaggtacctatggagttgtgtataagggtagacacaaaactacaggtcaagtggtagccatgaaaaaaatcagactagaaagtgaagaggaaggggttcctagtactgcaattcgggaaatttctctattaaaggaacttcgtcatccaaatatagtcagtcttcaggatgtgcttatgcaggattccaggttatatctcatctttgagtttctttccatggatctgaagaaatacttggattctatccctcctggtcagtacatggattcttcacttgttaagagttatttataccaaatcctacaggggattgtgttttgtcactctagaagagttcttcacagagacttaaaacctcaaaatctcttgattgatgacaaaggaacaattaaactggctgattttggccttgccagagcttttggaatacctatcagagtatatacacatgaggcaataacactctggtacagatctccagaagtattgctggggtcagctcgttactcaactccagttgacatttggagtataggcaccatatttgctgaactagcaactaagaaaccacttttccatggggattcagaaattgatcaactcttcaggattttcagagctttgggcactcccaataatgaagtgtggccagaagtggaatctttacaggactataagaatacatttcccaaatggaaaccaggaagcctagcatcccatgtcaaaaacttggatgaaaatggcttggatttgctctcgaaaatgttaatctatgatccagccaaacgaatttctggcaaaatggcactgaatcatccatattttaatgatttggacaatcagattaagaagatgtagctttctgacaaaaagtttccatatgttatatcaacagatagttgtgtttttattgttaactcttgtctatttttgtcttatatatatttctttgttatcaaacttcagctgtacttcgtcttctaatttcaaaaatataacttaaaaatgtaaatattctatatgaatttaaatataattctgtaaatgtgtgtaggtctcactgtaacaactatttgttactataataaaactataatattgatgtcaggaatcaggaaaaaatttgagttggcttaaatcatctcagtccttatggcagttttattttcctgtagttggaactactaaaatttaggaaaatgctaagttcaagtttcgtaatgctttgaagtatttttatgctctgaatgtttaaatgttctcatcagtttcttgccatgttgttaactatacaacctggctaaagatgaatatttttctactggtattttaatttttgacctaaatgtttaagcattcggaatgagaaaactatacagatttgagaaatgatgctaaatttataggagttttcagtaacttaaaaagctaacatgagagcatgccaaaatttgctaagtcttacaaagatcaagggctgtccgcaacagggaagaacagttttgaaaatttatgaactatcttatttttaggtaggttttgaaagctttttgtctaagtgaattcttatgccttggtcagagtaataactgaaggagttgcttatcttggctttcgagtctgagtttaaaactacacattttgacatagtgtttattagcagccatctaaaaaggctctaatgtatatttaactaaaattactagctttg

SEQ ID NO: 1232 - DNA, 723 bp, Homo sapiens
agccgccctttcctctttctttcgcgctctagccacccgggaaggcctgcccagcgtagctgggctctgattggctgctttgaaagtctacgggctacccgattggtgaatccggggccctttagcgcggatctaccatacccattgactaactatggaagattataccaaaatagagaaaattggagaaggtacctatggagttgtgtataagggtagacacaaaactacaggtcaagtggtagccatgaaaaaaatcagactagaaagtgaagaggaaggggttcctagtactgcaattcgggaaatttctctattaaaggaacttcgtcatccaaatatagtcagtcttcaggatgtgcttatgcaggattccaggttatatctcatctttgagtttctttccatggatctgaagaaatacttggattctatccctcctggtcagtacatggattcttcacttgttaagagttatttataccaaatcctacaggggattgtgttttgtcactctagaagagttcttcacagagacttaaaacctcaaaatctcttgattgatgacaaaggaacaattaaactggctgattttggccttgccagagcttttggaatacctatcagagtatatacacatgaggcaataacactctggtacagatctccagaagtattgctggggtcagctcgttactcaactccagttgacatttggagtat

SEQ ID NO: 1233 - DNA, 2296 bp, Homo sapiens
aacgcgggaagcaggggcggggcctctggtggcggtcgggaactcggtgggaggcggcaacattgtttcaagttggccaaattgacaagagcgagaggtatactgcgttccatcccgacccggggccacggtactgggccctgtttccccctcctcggcccccgagagccagggtccgccttctgcagggttcccaggcccccgctccagggccgggctgacccgactcgctggcgcttcatggagaacttccaaaaggtggaaaagatcggagagggcacgtacggagttgtgtacaaagccagaaacaagttgacgggagaggtggtggcgcttaagaaaatccgcctggacactgagactgagggtgtgcccagtactgccatccgagagatctctctgcttaaggagcttaaccatcctaatattgtcaagctgctggatgtcattcacacagaaaataaactctacctggtttttgaatttctgcaccaagatctcaagaaattcatggatgcctctgctctcactggcattcctcttcccctcatcaagagctatctgttccagctgctccagggcctagctttctgccattctcatcgggtcctccaccgagaccttaaacctcagaatctgcttattaacacagagggggccatcaagctagcagactttggactagccagagcttttggagtccctgttcgtacttacacccatgaggtggtgaccctgtggtaccgagctcctgaaatcctcctgggctgcaaatattattccacagctgtggacatctggagcctgggctgcatctttgctgagatggtgactcgccgggccctattccctggagattctgagattgaccagctcttccggatctttcggactctggggaccccagatgaggtggtgtggccaggagttacttctatgcctgattacaagccaagtttccccaagtgggcccggcaagattttagtaaagttgtacctcccctggatgaagatggacggagcttgttatcgcaaatgctgcactacgaccctaacaagcggatttcggccaaggcagccctggctcaccctttcttccaggatgtgaccaagccagtaccccatcttcgactctgatagccttcttgaagcccccagccctaatctcaccctctcctccagtgtgggcttgaccaggcttggccttgggctatttggactcaggtgggccctctgaacttgccttaaacactcaccttctagtcttggccagccaactctgggaatacaggggtgaaaggggggaaccagtgaaaatgaaaggaagtttcagtattagatgcacttaagttagcctccaccaccctttcccccttctcttagttattgctgaagagggttggtataaaaataattttaaaaaagccttcctacacgttagatttgccgtaccaatctctgaatgccccataattattatttccagtgtttgggatgaccaggatcccaagcctcctgctgccacaatgtttataaaggccaaatgatagcgggggctaagttggtgcttttgagaaccaagtaaaacaaaaccactgggaggagtctattttaaagaattcggttgaaaaaatagatccaatcagtttataccctagttagtgttttgcctcacctaataggctgggagactgaagactcagcccgggtggggctgcagaaaaatgattggccccagtccccttgtttgtcccttctacaggcatgaggaatctgggaggccctgagacagggattgtgcttcattccaatctattgcttcaccatggccttatgaggcaggtgagagatgtttgaatttttctcttccttttagtattcttagttgttcagttgccaaggatccctgatcccattttcctctgacgtccacctcctaccccataggagttagaagttagggtttaggcatcattttgagaatgctgacactttttcagggctgtgattgagtgagggcatgggtaaaaatatttctttaaaagaaggatgaacaattatatttatatttcaggttatatccaatagtagagttggctttttttttttttttttggtcatagtgggtggatttgttgccatgtgcaccttggggttttgtaatgacagtgctaaaaaaaaaaagcattttttttttatgatttgtctctgtcacccttgtccttgagtgctcttgctattaacgttatttgtaatttagtttgtagctcattaaaaaaatgtgcctagttttata

SEQ ID NO: 1234 - DNA, 1260 bp, Homo sapiens
ttgtttcaagttggccaaattgacaagagcgagaggtatactgcgttccatcccgacccggggccacggtactgggccctgtttccccctcctcggcccccgagagccagggtccgccttctgcagggttcccaggcccccgctccagggccgggctgacccgactcgctggcgcttcatggagaacttccaaaaggtggaaaagatcggagagggcacgtacggagttgtgtacaaagccagaaacaagttgacgggagaggtggtggcgcttaagaaaatccgcctggacactgagactgagggtgtgcccagtactgccatccgagagatctctctgcttaaggagcttaaccatcctaatattgtcaagctgctggatgtcattcacacagaaaataaactctacctggtttttgaatttctgcaccaagatctcaagaaattcatggatgcctctgctctcactggcattcctcttcccctcatcaagagctatctgttccagctgctccagggcctagctttctgccattctcatcgggtcctccaccgagaccttaaacctcagaatctgcttattaacacagagggggccatcaagctagcagactttggactagccagagcttttggagtccctgttcgtacttacacccatgaggtgactcgccgggccctattccctggagattctgagattgaccagctcttccggatctttcggactctggggaccccagatgaggtggtgtggccaggagttacttctatgcctgattacaagccaagtttccccaagtgggcccggcaagattttagtaaagttgtacctcccctggatgaagatggacggagcttgttatcgcaaatgctgcactacgaccctaacaagcggatttcggccaaggcagccctggctcaccctttcttccaggatgtgaccaagccagtaccccatcttcgactctgatagccttcttgaagcccccagccctaatctcaccctctcctccagtgtgggcttgaccaggcttggccttgggctatttggactcaggtgggccctctgaacttgccttaaacactcaccttctagtcttggccagccaactctgggaatacaggggtgaaaggggggaaccagtgaaaatgaaaggaagtttcagtattagatgcacttaagttagcctccaccaccctttcccccttctcttagttattgctgaagagggttggtataaaaataattttaaaaaa

SEQ ID NO: 1235 - DNA, 1625 bp, Homo sapiens
gcccccaccatcaaggggaagaaagtgctcttcggattccggttcgccctggcctcccgcagccgccgcgggaccggcccccagcacacccccggggcgccgggcgcggggcagccgcccggacgcgcgcgggcctcaggcgccgccgggaccccagccccccaaactttggcaagttgcgggcgccgagcgcacccggaggcgcggggcgcggccgcaggcggagccgccccctgacgccgggccgccccctcccggccccggccgccccgccggctccgcggaaagtttgcggccgcccctgcgccgcacccggggcctgggtgagactgcggcggcggcagggcgcggacggccatatttgccggcgcggcccgagccgccgacaacaaaaagtgcgcgggcgctcggcgggcgctcggacgggcgcggggctgcagcgctaccgcccggcctcgccgccgccgccgccgccctcgcggcctggccccgccgcgcccggcgcgcccgccgcccggggggatgtcttacaaaccgaacttggccgcgcacatgcccgccgccgccctcaacgccgctgggagtgtccactcgccttccaccagcatggcaacgtcttcacagtaccgccagctgctcagtgactacgggccaccgtccctaggctacacccagggaactgggaacagccaggtgccccaaagcaaatacgcggagctgctggccatcattgaagagctggggaaggagatcagacccacgtacgcagggagcaagagtgccatggagaggctgaagcgcggcatcattcacgctagaggactggttcgggagtgcttggcagaaacggaacggaatgccagatcctagctgccttgttggttttgaaggatttccatctttttacaagatgagaagttacagttcatctcccctgttcagatgaaacccttgttttcaaaatggttacagtttcgtttttcctcccatggttcacttggctctgaacctacagtctcaaagattgagaaaagattttgcagttaattaggatttgcattttaagtagttaggaactgcccaggttttttttgttttttaagcattgatttaaaagatgcacggaaagttatcttacagcaaactgtagtttgcctccaagacaccattgtctccctttaatcttctcttttgtatacatttgttacccatggtgttctttgttccttttcataagctaataccactgtagggattttgttttgaacgcatattgacagcacgctttacttagtagccggttcccatttgccatacaatgtaggttctgcttaatgtaacttcttttttgcttaagcatttgcatgactattagtgcttcaaagtcaatttttaaaaatgcacaagttataaatacagaagaaagagcaacccaccaaacctaacaaggacccccgaacactttcatactaagactgtaagtagatctcagttctgcgtttattgtaagttgataaaaacatctggaagaaaatgactaaaactgtttgcatctttgtatgtatttattacttgatgtaataaagcttattttcattaacaatttgtattaaaatgtgggttcc

SEQ ID NO: 1236 - DNA, 1552 bp, Homo sapiens
gtgatagcaacagatcacgtggctgccatcgcccctccgcccccttacactcttcgccctcctcccagtcgaagcacctcctgtccgcccctcagcgcatgggtggcggtcacgtgcccagaacgtccggcgttcgccccgccctcccagtttccgcgcgcctctttggcagctggtcacatggtgagggtgggggtgagggggcctctctagcttgcggcctgtgtctatggtcgggccctctgcgtccagctgctccggaccgagctcgggtgtatggggccgtaggaaccggctccggggccccgataacgggccgcccccacagcaccccgggctggcgtgagggtctcccttgatctgagaatggctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggctgatggacgtctgtgccacatcccgaactgaccgggagatcaaggtaaccctggtgtttgagcatgtagaccaggacctaaggacatatctggacaaggcacccccaccaggcttgccagccgaaacgatcaaggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcacttacacccgtggttgttacactctggtaccgagctcccgaagttcttctgcagtccacatatgcaacacctgtggacatgtggagtgttggctgtatctttgcagagatgtttcgtcgaaagcctctcttctgtggaaactctgaagccgaccagttgggcaaaatctttgacctgattgggctgcctccagaggatgactggcctcgagatgtatccctgccccgtggagcctttccccccagagggccccgcccagtgcagtcggtggtacctgagatggaggagtcgggagcacagctgctgctggaaatgctgacttttaacccacacaagcgaatctctgcctttcgagctctgcagcactcttatctacataaggatgaaggtaatccggagtgagcaatggagtggctgccatggaaggaagaaaagctgccatttcccttctggacactgagagggcaatctttgcctttatctctgaggctatggagggtcctcctccatctttctacagagattactttgctgccttaatgacattcccctcccacctctccttttgaggcttctccttctccttcccatttctctacactaaggggtatgttccctcttgtccctttccctacctttatatttggggtccttttttatacaggaaaaacaaaac

SEQ ID NO: 1237 - DNA, 1000 bp, Homo sapiens
gtgggggtgagggggcctctctagcttgcggcctgtgtctatggtcgggccctctgcgtccagctgctccggaccgagctcgggtgtatggggccgtaggaaccggctccggggccccgataacgggccgcccccacagcaccccgggctggcgtgagggtctcccttgatctgagaatggctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggctgatggacgtctgtgccacatcccgaactgaccgggagatcaagagatgtttcgtcgaaagcctctcttctgtggaaactctgaagccgaccagttgggcaaaatctttgacctgattgggctgcctccagaggatgactggcctcgagatgtatccctgccccgtggagcctttccccccagagggccccgcccagtgcagtcggtggtacctgagatggaggagtcgggagcacagctgctgctggaaatgctgacttttaacccacacaagcgaatctctgcctttcgagctctgcagcactcttatctacataaggatgaaggtaatccggagtgagcaatggagtggctgccatggaaggaagaaaagctgccatttcccttctggacactgagagggcaatctttgcctttatctctgaggctatggagggtcctcctccatctttctacagagattactttgctgccttaatgacattcccctcccacctctccttttgaggcttctccttctccttcccatttctctacactaaggggtatgttccctcttgtccctttccctacctttatatttggggtccttttttatacagg

SEQ ID NO: 1238 - DNA, 952 bp, Homo sapiens
gtgagggggcctctctagcttgcggcctgtgtctatggtcgggccctctgcgtccagctgctccggaccgagctcgggtgtatggggccgtaggaaccggctccggggccccgataacgggccgcccccacagcaccccgggctggcgtgagggtctcccttgatctgagaatggctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcacttacacccgtggttgttacactctggtaccgagctcccgaagttcttctgcagtccacatatgcaacacctgtggacatgtggagtgttggctgtatctttgcagagatgtttcgtcgaaagcctctcttctgtggaaactctgaagccgaccagttgggcaaaatctttgacctgattgggctgcctccagaggatgactggcctcgagatgtatccctgccccgtggagcctttccccccagagggccccgcccagtgcagtcggtggtacctgagatggaggagtcgggagcacagctgctgctggaaatgctgacttttaacccacacaagcgaatctctgcctttcgagctctgcagcactcttatctacataaggatgaaggtaatccggagtgagcaat

SEQ ID NO: 1239 - DNA, 228 bp, Homo sapiens
cgcgttcgtttcgcgagctggttatggaagggtcgctcaagggcgggaagtggggcctttgtggtcatgggaaagtataattttagggactgaggtgtaggatcttcgatgcaaggcatgtgtcatgtgtgatctttgtgcggggcgcgattgtcccaaaggaaaaagcgttttctattgcagggcctcacgtggctggagggggtctcccttgatctgagaatggct

SEQ ID NO: 1240 - DNA, 769 bp, Homo sapiens
gccccaaggaagactgggagcgggggatgggatgctggtggtgttctttgcgctttttttttgggagtccctttgttgctgcaggctcataccatcctaactctgtaagcgacttttggtgataggagtctgtgattgtagggtctcccttgatctgagaatggctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggctgatggacgtctgtgccacatcccgaactgaccgggagatcaaggtaaccctggtgtttgagcatgtagaccaggacctaaggacatatctggacaaggcacccccaccaggcttgccagccgaaacgatcaaggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcacttacacccgtggttgttacactctggtaccgagctcccgaagttcttctgcagtccacatatgcaacacctgtggacatgtggagtgttggctgtatc

SEQ ID NO: 1241 - DNA, 694 bp, Homo sapiens
gggggcctctctagcttgcggcctgtgtctatggtcgggccctctgcgtccagctgctccggaccgagctcgggtgtatggggccgtaggaaccggctccggggccccgataacgggccgcccccacagcaccccgggctggcgtgaggagtctgtgattgtagggtctcccttgatctgagaatggctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggctgatggacgtctgtgccacatcccgaactgaccgggagatcaaggtaaccctggtgtttgagcatgtagaccaggacctaaggacatatctggacaaggcacccccaccaggcttgccagccgaaacgatcaaggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcac

SEQ ID NO: 1242 - DNA, 447 bp, Homo sapiens
accccattcccactccgtgtcctggggcccgcccagcctccttaggcgccgcgcctgctcgcggtctccgctgacaccccagggtctcccttgatctgagaatggctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggctgatggacgtctgtgccacatcccgaactgaccgggagatcaaggtaaccctggtgtttgagcatgtagaccaggacctaaggacatatctggacaaggcacccccaccaggcttgccagccgaaa

SEQ ID NO: 1243 - DNA, 4325 bp, Homo sapiens
ggctgctgttgggcggcggcgcggagcgggcggcgagctgtgcgggaggggcggccccgaggggcggggcgggccgacgccgcgtgtcccgccgcagccgcggagtccggctcctagatggggcccggcgcgtagaggtgcctcccgctcgttgccgcgtcctacccgcaccgtgcgcggctcgagctgaggacaccaacggccgcgactccccggcgagaccaggccggagcgtggacggcgcgcgcgccccgcgagggagggcgctgaggcgcgcgccggaagcgggagcgggagcgggagcgcggcggcggcggcgaaggtgcgggcggccgagcggggggcggggctgcggtgcctgcagaaccttggacagaagctccctagctgccgccgccgccgccgccgccgtcgccgccgccgagcgcgagcccagccgatccccgccgagcgcccccgagcgccgccgagcgccgggaccgcggcggcggggccgcggcgcgcattgcggagggcgcggagcgcaggagctgccgcctgccgggcagatccaagggggcagcacgcttcccgggagcgcccccgcctcctctccggggccgccgcaggctcggtgagcggttttatccctccggccggcaggctgggcgcgcaggggcgcgagcccccgcccggcgcgcagcagcaccatgggcacggtgctgtccctgtctcccagctaccggaaggccacgctgtttgaggatggcgcggccaccgtgggccactatacggccgtacagaacagcaagaacgccaaggacaagaacctgaagcgccactccatcatctccgtgctgccttggaagagaatcgtggccgtgtcggccaagaagaagaactccaagaaggtgcagcccaacagcagctaccagaacaacatcacgcacctcaacaatgagaacctgaagaagtcgctgtcgtgcgccaacctgtccacattcgcccagcccccaccggcccagccgcctgcacccccggccagccagctctcgggttcccagaccgggggctcctcctcagtcaagaaagcccctcaccctgccgtcacctccgcagggacgcccaaacgggtcatcgtccaggcgtccaccagtgagctgcttcgctgcctgggtgagtttctctgccgccggtgctaccgcctgaagcacctgtcccccacggaccccgtgctctggctgcgcagcgtggaccgctcgctgcttctgcagggctggcaggaccagggcttcatcacgccggccaacgtggtcttcctctacatgctctgcagggatgttatctcctccgaggtgggctcggatcacgagctccaggccgtcctgctgacatgcctgtacctctcctactcctacatgggcaacgagatctcctacccgctcaagcccttcctggtggagagctgcaaggaggccttttgggaccgttgcctctctgtcatcaacctcatgagctcaaagatgctgcagataaatgccgacccacactacttcacacaggtcttctccgacctgaagaacgagagcggccaggaggacaagaagcggctcctcctaggcctggatcggtgagcactgtagcctgcgtcatggctcaaggattcaatgcatttttaagaatttattattaaatcagttttgtgtacagtatgtgtctagcaaagccaccaagggcctcacctttcccacagtctctccctggggtttttttcatccctgccaagaactctgggcacttttgaactcacgagccttgcgcaaaacccagaagatgtattcagagccacccaggccactgacctcccactttggggaactcaaaggactgacctgcccctgccgcctgtgcccttgctgggtccagggtaggcaaggctgccggctgcaccctgtatggagctagagaggggcctctggctgcctggcccagggaggaattggggtttctggttggaggcccttttctggctcctgtgtggagttattcactctcccagaggctcctggagccagccaccctaactgagctgccagtggggtcgtgaggcaagatccccgccacccggggacatcttcaatctaggcgaggcgaagctgagcgggtctagtggaaagattgtgtctggtcgtttgaccacacaccgccctgatttgctgttttctttttttagggagaagggcttttctttagtggagaaatggaactcgcccccctacccccttgtctgctgctcccagccacgttggtggtattggccgatgagctggtttgactcattaatttctctcaatttgggtcccagctaaagaggtggggtgaagctggggacagctttcctgggtgagtttttcttttgaataatgtagtgcagtcaccctgtggcaaatgccaggacagctgcaggtgcccattagcaacgcctgccttctgggcaaggtgagggatgccataccttgagaccaagccggtgcccacctaagggctaaggcctcttgctggtgcacatgacatttgtcctgcagagctggggggaaggcgatgtggtgaccccacccccacccgttaatttaaagctgtttctaaacagttgagtttcttctaaagaggaagccttgcccagcaaggaccagtgagacagccggatcttggagacaattacaagacggggagtgagactcctgattgctctggaagcctgctgatttctacaactgatcatttgcagctgctggttttggtttccaccttaccctactggctgtaaaaacacaaatgtgtactttattgattttctttctaattctcccgcattggtggcttgggacttgggagagggagcaagccttcctccatggcccatcactcggctgtggagaacaaagaccaatgtgaagacactacagaggattctgtcttccaggcccagtccactggggagtgctggaatggggacctggggtggggaggcagagggtcactttacataggattaagttcgaggtggctaccgatttcagcacatgcactactgaaatttacacaaaaagaaagctgtgaaattgaagtcccaatttaagagtcctgaggcagaacctggtggctggaggcattcccagaggtggggaagagagcctgcccggccggagaacatctgccttgctgcacctgaggcccagcagagccgttcctgggactgtcagataatcggtgcagcggtggaaggagcctgcggctgctggcacagacttcacacagcacctcctctctgctgggtttccacacagcctgtcttcagatcctgctgccgcgtgcgaccagaggtgggaggcccctggtggcatggaagagggagggtcagtgccaagtctcaggaggagggcgcatgtgtgtatcaccctcagctggcggaacctggctgcgaactgtgcagttacgttgcatccacaggattccagttgcgtgtctgtttccttctctttctccgtatttatttttttattcttcggaggaggtggacatttcggaagtggtggggactaagggaagaactctctagttccctcagtgtgaagcctgtcgtgttctctccccttgcactggtcatcagtattgtgtaaaggaacaactgatatacttgagtgtgcaagcaaagaacccatttgccatgctgctatgaagactacttttagatcaacaataaaaaaaaacctacaaaaaaacctttattctttaattgttgcttttacggtgatattgtgcatgcaaaccaggagcattttgtgtcttaagaaaaataatcttagaacagatggctgtgaaaattacacccatgcacagaacaagccacaggaataatagttcaggatttggtttttctctttttcttgtaaacctggagggttgatatattctttccatgcagttattagaacttagttttgttccaacagttaaacttgcaatgaaaagaaaatgtgccatttttttcactcagaattattcatagctgtatatttgaaactgctaattacacacgtgtgatgtatgttggttttttagtgcaatttcttctgtagctattctttgaccaaactgtgggtattgttaatattaatttatatttgtctcattttgtatgtatgtgtagtgtgtttgtgagtatgtgtggtttataatctgacaaagtcatgaagctcagtttggctgtaatttaattccccttcccttatttttatttatttttgtactgtgctgattcaataaaatgcactgaccatccatta

SEQ ID NO: 1244 - DNA, 11612 bp, Homo sapiens
aacctctccgcgcgaagacggcttcagccctgcagggaaagaaaagtgcaatgattctggactgagacgcgcttgggcagaggctatgtaatcgtgtctgtgttgaggacttcgcttcgaggagggaagaggagggatcggctcgctcctccggcggcggcggcggcggcgactctgcaggcggagtttcgcggcggcggcaccagggttacgccagccccgcggggaggtctctccatccagcttctgcagcggcgaaagccccagcgcccgagcgcctgagccggcggggagcaagtaaagctagaccgatctccggggagccccggagtaggcgagcggcggccgccagctagttgagcgcaccccccgcccgccccagcggcgccgcggcgggcggcgtccaggcggcatggagaaggacggcctgtgccgcgctgaccagcagtacgaatgcgtggcggagatcggggagggcgcctatgggaaggtgttcaaggcccgcgacttgaagaacggaggccgtttcgtggcgttgaagcgcgtgcgggtgcagaccggcgaggagggcatgccgctctccaccatccgcgaggtggcggtgctgaggcacctggagaccttcgagcaccccaacgtggtcaggttgtttgatgtgtgcacagtgtcacgaacagacagagaaaccaaactaactttagtgtttgaacatgtcgatcaagacttgaccacttacttggataaagttccagagcctggagtgcccactgaaaccataaaggatatgatgtttcagcttctccgaggtctggactttcttcattcacaccgagtagtgcatcgcgatctaaaaccacagaacattctggtgaccagcagcggacaaataaaactcgctgacttcggccttgcccgcatctatagtttccagatggctctaacctcagtggtcgtcacgctgtggtacagagcacccgaagtcttgctccagtccagctacgccacccccgtggatctctggagtgttggctgcatatttgcagaaatgtttcgtagaaagcctctttttcgtggaagttcagatgttgatcaactaggaaaaatcttggacgtgattggactcccaggagaagaagactggcctagagatgttgcccttcccaggcaggcttttcattcaaaatctgcccaaccaattgagaagtttgtaacagatatcgatgaactaggcaaagacctacttctgaagtgtttgacatttaacccagccaaaagaatatctgcctacagtgccctgtctcacccatacttccaggacctggaaaggtgcaaagaaaacctggattcccacctgccgcccagccagaacacctcggagctgaatacagcctgaggcctcagcagccgccttaagctgatcctgcggagaacacccttggtggcttatgggtccccctcagcaagccctacagagctgtggaggattgctatctggaggccttccagctgctgtcttctggacaggctctgcttctccaaggaaaccgcctagtttactgttttgaaatcaatgcaagagtgattgcagctttatgttcatttgtttgtttgtttgtctgtttgtttcaagaacctggaaaaattccagaagaagagaagctgctgaccaattgtgctgccatttgatttttctaaccttgaatgctgccagtgtggagtgggtaatccaggcacagctgagttatgatgtaatctctctgcagctgccgggcctgatttggtacttttgagtgtgtgtgtgcatgtgtgtgtgtgtgtgtgtgtgtgtgtgtgtgtatgtgagagattctgtgatcttttaaagtgttactttttgtaaacgacaagaataattcaattttaaagactcaaggtggtcagtaaataacaggcatttgttcactgaaggtgattcaccaaaatagtcttctcaaattagaaagttaaccccatgtcctcagcatttcttttctggccaaaagcagtaaatttgctagcagtaaaagatgaagttttatacacacagcaaaaaggagaaaaaattctagtatattttaagagatgtgcatgcattctatttagtcttcagaatgctgaatttacttgttgtaagtctattttaaccttctgtatgacatcatgctttatcatttcttttggaaaatagcctgtaagctttttattacttgctataggtttagggagtgtacctcagatagattttaaaaaaaagaatagaaagcctttatttcctggtttgaaattcctttcttccctttttttgttgttgttattgttgtttgttgttgttattttgtttttgtttttaggaatttgtcagaaactctttcctgttttggtttggagagtagttctctctaactagagacaggagtggccttgaaattttcctcatctattacactgtactttctgccacacactgccttgttggcaaagtatccatcttgtctatctcccggcacttctgaaatatattgctaccattgtataactaataacagattgcttaagctgttcccatgcaccacctgtttgcttgctttcaatgaacctttcataaattcgcagtctcagcttatggtttatggcctcgattctgcaaacctaacagggtcacatatgttctctaatgcagtccttctacctggtgtttacttttgttacctaaataatgagtaggatcttgttttgttttatcaccagcacacagattgctataaactgttactttgtgaattacatttttatagaagatattttcagtgtctttacctgagggtatgtctttagctatgttttagggccatacatttactctatcaaatgatcttttctccatcccccaggctgtgcttatttctagtgccttgtgctcactcctgctctctacagagccagcctggcctgggcattgtaaacagcttttcctttttctcttactgttttctctacagtcctttatatttcataccatctctgccttataagtggtttagtgctcagttggctctagtaaccagaggacacagaaagtatcttttggaaagtttagccacctgtgctttctgactcagagtgcatgcaacagttagatcatgcaacagttagattatgtttagggttaggattttcaaagaatggaggttgctgcactcagaaaataattcagatcatgtttatgcattattaagttgtactgaattctttgcagcttaatgtgatatatgactatcttgaacaagagaaaaaactaggagatgtttctcctgaagagcttttggggttgggaactattcttttttaattgctgtactacttaacattgttctaattcagtagcttgaggaacaggaacattgttttctagagcaagataataaaggagatgggccatacaaatgttttctactttcgttgtgacaacattgattaggtgttgtcagtactataaatgcttgagatataatgaatccacagcattcaaggtcaggtctactcaaagtctcacatggaaaagtgagttctgcctttcctttgatcgagggtcaaaatacaaagacatttttgctagggcctacaaattgaatttaaaaactcactgcactgattcatctgagctttttggttagtattcatggctagagtgaacatagctttagtttttgctgttgtaaaagtgttttcataagttcactcaagaaaaatgcagctgttctgaactggaatttttcagcattctttagaattttaaatgagtagagagctcaacttttattcctagcatctgcttttgactcatttctaggcagtgcttatgaagaaaaattaaagcacaaacattctggcattcaatcgttggcagattatcttctgatgacacagaatgaaagggcatctcagcctctctgaactttgtaaaaatctgtccccagttcttccatcggtgtagttgttgcatttgagtgaatactctcttgatttatgtattttatgtccagattcgccatttctgaaatccagatccaacacaagcagtcttgccgttagggcattttgaagcagatagtagagtaagaacttagtgactacagcttattcttctgtaacatatggtttcaaacatctttgccaaaagctaagcagtggtgaactgaaaagggcatattgccccaaggttacactgaagcagctcatagcaagttaaaatattgtgacagatttgaaatcatgtttgaatttcatagtaggaccagtacaagaatgtccctgctagtttctgtttgatgtttggttctggcggctcaggcattttgggaactgttgcacagggtggagtcaaaacaacctacatataaaaagagaaaaagagaaacttgtccatttagctttcataagaaatcccatggcaaagggtaataaaaaggacctaatcttaaaaatacaatttctaagcacttgtaagaacccagtgggttggagcctcccactttgtccctcctttgaagtggatgggaactcaaggtgcaaagaacctgttttggaagaaagcttggggccatttcagccccctgtattctcatgattttctctcaggaagcacacactgtgaatggcagacttttcatttagccccaggtgacttactaaaaatagttgaaaattattcacctaagaatagaatctcagcattgtgttaaataaaaatgaaagctttagaaggcatgagatgttcctatcttaaataaagcatgtttcttttctatagagaaatgtatagtttgactctccagaatgtactatccatcttgatgagaaaactcttaaatagtaccaaacattttgaactttaaattatgtatttaaagtgagtgtttaagaaactgtagctgcttcttttacaagtggtgcctattaaagtcagtaatggccattattgttccattgtggaaattaaattatgtaagcttcctaatatcataaacatattaaaattcttctaaaatattgcttttcttttaagtgacaatttgactattcttatgataagcacatgagagtgtcttacattttccaaaagcaggctttaattgcatagttgagtctaggaaaaaataatgttaaaagtgaatatgccaccataattacttaattatgttagtatagaaactacagaatatttaccctggaaagaaaatattggaatgttattataaactcttagatatttatataattcaaaagaatgcatgtttcacattgtgacagataaagatgtatgatttctaaggctttaaaaattattcataaaacagtgggcaatagataaaggaaattctggagaaaatgaaggtatttaaagggtagtttcaaagctatatatattttgaaggatatattctttatgaacaaatatattgtaaaaatttatactaaggtcatctggtaactgtgggattaatatggtcgaaaacaaatgttatggagaagctgtcccaagcaaactaaattacctgtacttttttcccatttcaagggaagaggcaaccacatgaagcaatacttcttacacatgcctaagaacgttcattgaaaaaataaatttttaaaaggcatgtgtttcctatgccaccaatacttttgaaaaattgtgaaccttacccaaaaccatttatcatgtccattaagtatatttgggtatataattaggaagatatttacatgttccatctccacagtggaaaaacttattgaggctaccaaagtgtgccaagaaatgtaagtccttagagtaattagaaatgctgttttcctcaaaagcatgagaaactagcattttcatttcttatttactccctttctatatcaatgcaattcacaacccaattttaatacatccctatatctcaagcatttctatcttgtactttttcagaaaataaaccaaaaataatcctttggtctctctatcttctgacctttgtaagcaacagaaatgtaaaaacagaaggggtccaatttttacacgtttttttctcaagtagcctttctggggatttttattttcttaatgaagtgccaatcagcttttcaaaatgttttctatttctcagcatttccaggaagtgataacgtttagctaaatgagtagaagtggacttccttcaacatattgttaccttgtctagccttaggaagaaaacaagagccacctgaaaataaatacaggctcttttcgagcatctgctgaaatactgttacagcaatttgaagttgatgtggtaggaaaggaaggtgacttttcttgcaaaagtctttctaaacattcacactgtcctaagagatgagctttcttgttttattccggtatattccacaaggtggcacttttagagaaaaacaaatctgatgaagactaaagaggtacttctaaaagagatttcattctaactttatttttctgcgcatatttaactctttcctagcacttgttttttgggatgattaatagtctctataatgttctgtaacttcaatattttacttgttacctaggttctgaacaattgtctgcaaataaattgttcttaaggatggataatacacccattttgatcatttaagtaaagaaagcctagtcattcattcagtcaagaaaaaatttttgaagtacccagttaccttacttttctagattaaaacaggcttagttactaaaaaggcagtcctcatctgtgaacaggatagtttcgttagaagtataaaactcctttagtggccccagttaaaacacacataccctctctgctgctttcaaattccctagcatggtggcctttcaacattgattaaattttaaaatcctaatttaaagatcaggtgagcaaaatgagtagcacatcagtaattcagtagacaaaacttttgtctgaaaaattgctgtattgaaacagagccctaaaataccaaaagaccaggtaattttaacatttgtggaatcacaaatgtaaattcataagaagctctaattaaaaaaaaaaagtctgaagtatatgagcataacaacttaggagtgtgtctacatacttaacttttgaagttttttggcaactttatatactttttttaaatttacaagtctacttaaagacttcttataccccaaatgattaagttaattttagaggtcacctttctcacagcagtgtcacttgaaatttagtagggaaggatattgcagtatttttcagtttccttagcacagcaccacagaaagcagcttattccttttgagtggcagacactcgacggtgcctgcccaactttcctcctgagtggcaagcagatgagtctcagtaattcatactgaaccaaaatgccacatacactaggggcagtcagaaactggctgagaaatcccccgcctcattcgcccctctgctcccaggaactagagtccagttaaagcccctatgcgaaaggccgaattccaccccagggtttgttataacagtggccagtctgaaccccatttgctcgtgctcaaaacttgattcccacttgaaagccttccgggcgcgctgcctcgttgccccgcccctttggcaggagagaggcagtgggcgaggccgggctggggccccgcctcccactcacctgccggtgcctgaaattatgtgcggccccgcgggctgctttccgaggtcagagtgccctgctgctgtctcagaggcatctgttctgcaaatcttaggaagaaaaatgtccctagtagcaaacgggtgtcttctgtgcataaataagtacaacacaattctccgaaagttcgggtaaaaagagatgcggtagcagctgccctgtgtgaagctgtctaccccgcatctctcaggcgctaagctcagtttttgtttttgtttttgtttttttaaagaaaagatgtataattgcaggaatttttttttatttttttattttccatcattctatatatgtgatggtgaaagatatgcctggaaaagttttgttttgaaaagtttattttctgcttcgtcttcagttggcaaaagctctcaattctttagcttccagtttcttttctctctttttctttgttaggtaattaaaggtatgtaaacaaattatctcatgtagcaggggattttcatgttgagaggaatcttccgtgtgagttgtttggtcacacaaataaccctttctcaattttaggagtttggattgtcaaatgtaggtttttctcaaagggggcatataactacatattgactgccaagaactatgactgtagcactaatcagcacacatagagccacacaattatttaatttctaactctctgtggtccctagaaaaattccgttgatgtgcttaggttaaagttctgaagatacccgttgtacccttacttgaaagtttctaatcttaagttttatgaaatgcaataatatgtatcagctagcaatatttctgtgatcaccaacaactctcagtttgatcttaaagtctgaataataaaacaaatcccagcagtaatacatttcttaaacctcacagtgcatgatatatcttttcattctgatcctgtgtttgcaaaaatatacacatgtatatcatagttcctcactttttattcatttgttttcctattacctgtagtaaatatattagttagtacatggaatttatagcatcagctacccccaggaacagcacctgacaggcgggggattttttttcaagttgttctacatttgcataaattatttctattattattcatgtatgttatttatttctgaatcacactagtcctgtgaaagtacaactgaaggcagaaagtgttaggattttgcatctaatgttcattatcatggtattgatggacctaagaaaataaaaattagactaagcccccaaataagctgcatgcatttgtaacatgattagtagatttgaatatatagatgtagtattttgggtatctaggtgttttatcattatgtaaaggaattaaagtaaaggactttgtagttgtttttattaaatatgcatatagtagagtgcaaaaatatagcaaaaataaaaactaaaggtagaaaagcattttagatatgccttaatttagaaactgtgccaggtggccctcggaatagatgccaggcagagaccagtgcctgggtggtgcctcctcttgtctgccctcatgaagaagcttccctcacgtgatgtagtgccctcgtaggtgtcatgtggagtagtgggaacaggcagtactgttgagaggagagcagtgtgagagtttttctgtagaagcagaactgtcagcttgtgccttgaggcttccagaacgtgtcagatggagaagtccaagtttccatgcttcaggcaacttagctgtgtacagaagcaatccagtgtggtaataaaaagcaaggattgcctgtataatttattataaaataaaagggattttaacaaccaacaattcccaacacctcaaaagcttgttgcattttttggtatttgaggtttttatctgaaggttaaagggcaagtgtttggtatagaagagcagtatgtgttaagaaaagaaaaatattggttcacgtagagtgcaaattagaactagaaagttttatacgattatcattttgagatgtgttaaagtaggttttcactgtaaaatgtattagtgtttctgcattgccatagggcctggttaaaactttctcttaggtttcaggaagactgtcacatacagtaagcttttttccttctgacttataatagaaaatgttttgaaagtaaaaaaaaaaaatctaatttggaaatttgacttgttagtttctgtgtttgaaatcatggttctagaaatgtagaaattgtgtatatcagatactcatctaggctgtgtgaaccagcccaagatgaccaacatccccacacctctacatctctgtcccctgtatctcttcctttctaccactaaagtgttccctgctaccatcctggcttgtccacatggtgctctccatcttcctccacatcatggaccacaggtgtgcctgtctaggcctggccaccactcccaacttgacctagccacattcatctagagatggttcctgatgctgggcacagactgtgctcatggcacccattagaaatgcctctagcatctttgtatgcatcttgatttttaaaccaagtcattgtacagagcattcagttttggctgtggtaccaagagaaaaactaatcaagaatataaaccacattccaggctgctgttttctctccatctacaggccacacttttactgtatttcttcatacttgaaattcattctgctattttcatatcagggtacagacttataagggtgcatgttccttaaaggtgcataattattcttattccgtttgcttatattgctacagaatgctctgttttggtgctttgagttctgcagacccaagaagcagtgtggaaattcactgcctgggacacagtcttataagaatgttggcaggtgactttgtatcagatgttgcttctcttttctctgtacacagattgagagttaccacagtggcctgtcgggtccaccctgtgggtgcagcacagctctctgaaagcaagaaccttcctacctattctaacgtttttgccctctaagaaaaatggcctcaggtatggtatagacatagcaagaggggaagggctgtctcactctagcaaccatccctccattacacacagaaagccctcttgaagcaaaagaagaagaaagaaagaaagcttatctctaaggctactgtcttcagaatgctctgagctgaatgctcttgctcctttcccaagaggcagatgaaaatatagccagtttatctatacccttcctatctgaggaggagaatagaaaagtagggtaaatatgtaacgtaaaatatgtcattcaaggaccaccaaaactttaagtaccctatcattaaaaatctggttttaaaagtagctcaagtaagggatgctttgtgacccagggtttctgaagtcagatagccattcttacctgccccttactctgacttattgggaaagggagaactgcagtggtgtttctgttgcagtggcaaaggtaacatgtcagaaaattcagagggttgcataccaataatcctttggaaactggatgtcttactgggtgctagaatgaaaatgtaggtatttattgtcagatgatgaagttcattgtttttttcaaaattggtgttgaaatatcactgtccaatgtgttcacttatgtgaaagctaaattgaatgaggcaaaaagagcaaatagtttgtatatttgtaataccttttgtatttcttacaataaaaatattggtagcaaataaaaataataaaaacaataactttaaactgctttctggagatgaattactctcctggctattttcttttttactttaatgtaaaatgagtataactgtagtgagtaaaattcattaaattccaagttttagcagaa

SEQ ID NO: 1245 - DNA, 1465 bp, Homo sapiens
gctggtaactccttccccagagtctgattacctgctccgcgaggccgcggacacgtgcggagagccgactgacactcgcagccccctcgggaggcccgacgcgactgggcccctcaggtgcaatgattctggactgagacgcgcttgggcagaggctatgtaatcgtgtctgtgttgaggacttcgcttcgaggagggaagaggagggatcggctcgctcctccggcggcggcggcggcggcgactctgcaggcggagtttcgcggcggcggcaccagggttacgccagccccgcggggaggtctctccatccagcttctgcagcggcgaaagccccagcgcccgagcgcctgagccggcggggagcaagtaaagctagaccgatctccggggagccccggagtaggcgagcggcggccgccagctagttgagcgcaccccccgcccgccccagcggcgccgcggcgggcggcgtccaggcggcatggagaaggacggcctgtgccgcgctgaccagcagtacgaatgcgtggcggagatcggggagggcgcctatgggaaggtgttcaaggcccgcgacttgaagaacggaggccgtttcgtggcgttgaagcgcgtgcgggtgcagaccggcgaggagggcatgccgctctccaccatccgcgaggtggcggtgctgaggcacctggagaccttcgagcaccccaacgtggtcaggttgtttgatgtgtgcacagtgtcacgaacagacagagaaaccaaactaactttagtgtttgaacatgtcgatcaagacttgaccacttacttggataaagttccagagcctggagtgcccactgaaaccataaaggatatgatgtttcagcttctccgaggtctggactttcttcattcacaccgagtagtgcatcgcgatctaaaaccacagaacattctggtgaccagcagcggacaaataaaactcgctgacttcggccttgcccgcatctatagtttccagatggctctaacctcagtggtcgtcacgctgtggtacagagcacccgaagtcttgctccagtccagctacgccacccccgtggatctctggagtgttggctgcatatttgcagaaatgtttcgtagaaagcctctttttcgtggaagttcagatgttgatcaactaggaaaaatcttggacgtgattggactcccaggagaagaagactggcctagagatgttgcccttcccaggcaggcttttcattcaaaatctgcccaaccaattgagaagtttgtaacagatatcgatgaactaggcaaagacctacttctgaagtgtttgacatttaacccagccaaaagaatatctgcctacagtgccctgtctcacccatacttccaggacctggaaaggtgcaaagaaaacctggattcccacctgccgcccagccagaacacctcggagctgaatacagcctga

SEQ ID NO: 1246 - DNA, 1432 bp, Homo sapiens
cccggtggacggaagtgggtgttggaggctttaaggtagctttaaattcgtgttgtcctgggagctcgcccttttcggctggagtcgggctttacggcgccggatggctctggacgtgaagtctcgggcaaagcgttatgagaagctggacttccttggggagggacagtttgccaccgtttacaaggccagagataagaacaccaaccaaattgtcgccattaagaaaatcaaacttggacatagatcagaagctaaagatggtataaatagaaccgccttaagagagataaaattattacaggagctaagtcatccaaatataattggtctccttgatgcttttggacataaatctaatattagccttgtctttgattttatggaaactgatctagaggttataataaaggataatagtcttgtgctgacaccatcacacatcaaagcctacatgttgatgactcttcaaggattagaatatttacatcaacattggatcctacatagggatctgaaaccaaacaacttgttgctagatgaaaatggagttctaaaactggcagattttggcctggccaaatcttttgggagccccaatagagcttatacacatcaggttgtaaccaggtggtatcgggcccccgagttactatttggagctaggatgtatggtgtaggtgtggacatgtgggctgttggctgtatattagcagagttacttctaagggttccttttttgccaggagattcagaccttgatcagctaacaagaatatttgaaactttgggcacaccaactgaggaacagtggccggacatgtgtagtcttccagattatgtgacatttaagagtttccctggaatacctttgcatcacatcttcagtgcagcaggagacgacttactagatctcatacaaggcttattcttatttaatccatgtgctcgaattacggccacacaggcactgaaaatgaagtatttcagtaatcggccagggccaacacctggatgtcagctgccaagaccaaactgtccagtggaaaccttaaaggagcaatcaaatccagctttggcaataaaaaggaaaagaacagaggccttagaacaaggaggattgcccaagaaactaattttttaaagagaacactggacaacattttactactgagggaaatagccaaaaaggcaaataatggaaaaatagtaaacattaagtaaatgctgtagaagtgagtttgtaaatattctacacatgtaaaatatgtaaaactatgggttatttttattaaatgtattttaaaataaaaatttaattctggtttttctgattagagtgcaaaagtgagaaaagttcaatactcttgaaatgtagaattgaaaatgcattagggaaaacttaataaaaattattaccagttatttggaa

SEQ ID NO: 1247 - DNA, 3055 bp, Homo sapiens
cggctgttgtgcggctctgcccttctgtttgagtgtatgggagagtgagtgagtgagtgagtgtgagcgtgtgtgtgagagcgtgaggcgtgagtgcgcgtgtgagaggacgagagcccgcctggccgccccgccgctcccgccgcagcaggagcagaacgcgcggccggagagagcggcggagccggcgcccagggagcccgcggggacaagggcagagacaccgctccccacccccagccctcgtccctcggctctccttcgccgggggatcctccccgttcctccacccccggccggcctctgccccgccgtccccctggatgtccctggcgctttcgcggggcctcctcctgctcttgccgcatcagtcgggctggtgctgcggccggcgggcgtagagcgggcgggttcccgggggctgcggctgcccgtgcttccccggtccccacccctgccccccggccccccgacccagctctccggcctcagaggctgtgacaatggactatgactttaaagtgaagctgagcagcgagcgggagcgggtcgaggacctgtttgaatacgagggctgcaaagttggccgaggcacttatggtcacgtctacaaagccaagaggaaagatgggaaggatgataaagactatgctttaaaacaaatagaaggaactgggatctctatgtcggcatgtagagaaatagcattacttcgagagcttaagcatccaaacgtcatttctcttcaaaaggtgtttctgtctcatgctgataggaaggtgtggcttctgtttgactatgctgaacatgacctctggcatataatcaagtttcacagagcttctaaagcaaacaagaagccagttcagttacctcggggaatggtgaagtcactattatatcagatcctagatggtattcactacctgcatgctaactgggtgttgcacagagatttgaaacctgctaatattttagttatgggtgaaggtcctgagcgaggaagagtaaaaattgctgacatgggctttgcccgattatttaattcacctttgaagcctttagcagatttggatccagtggttgttacattctggtaccgagcccctgaactacttcttggagcaaggcattataccaaagctattgatatttgggctatagggtgtatatttgcagaactactaacgtcagaaccaatatttcactgtcgacaagaggacatcaaaactagtaatccttatcaccatgaccagctggacagaatattcaatgtaatgggatttcctgcagataaagattgggaagatataaaaaagatgcctgaacattcaacattaatgaaagatttcagaagaaatacgtataccaactgcagccttatcaagtatatggaaaaacataaagttaaaccagatagtaaagcattccacttgcttcagaagctgcttaccatggacccaataaagcgaattacctcagaacaggctatgcaggacccctatttcttagaagacccacttcctacatcagacgtttttgccggttgtcaaatcccttacccaaaacgagaatttttaacggaagaagaacctgatgacaaaggagacaaaaagaaccagcagcagcagcagggcaataaccacactaatggaactggccacccagggaatcaagacagcagtcacacacagggacccccgttgaagaaagtgagagttgttcctcctaccactacctcaggtggacttatcatgacctcagactatcagcgttccaatccacatgctgcctatcccaaccctggaccaagcacatcacagccgcagagcagcatgggatactcagctacctcccagcagcctccacagtactcacatcagacacatcggtactgagctgcatcggaatcttgtccatgcactgttgcgaatgctgcagggctgactgtgcagctctctgcgggaacctggtatgggccatgagaatgtactgtacaaccacatcttcaaaatgtccagtagccaagttccaccacttttcacagattggggtagtggcttccaagttgtacctattttggagttagacttgaaaagaaagtgctagcacagtttgtgttgtggatttgctacttccatagtttacttgacatggttcagactgaccaatgcatttttttcagtgacagtctgtagcagttgaagctgtgaatgtgctaggggcaagcatttgtctttgtatgtggtgaattttttcagtgtaacaacattatctgaccaatagtacacacacagacacaaagtttaactggtacttgaaacatacagtatatgttaacgaaataaccaagactcgaaatgagattattttggtacacctttctttttagtgtcttatcagtgggctgattcattttctacattaatcagtgttttctgaccaagaatattgcttggatttttttgaaagtacaaaaagccacatagtttttccagaaaggtttcaaaactcccaaagattaacttccaacttataagtttgtttttattttcaatctatgacttgactggtattaaagctgctatttgatagtaattaaatatgttgtcattgatataaacctgtttggttcagcaaacaaactaaaatgattgtcatagacagtgttttatttttcctgttggtgttgctgatttgtgagcatgctttaagatgaaaaaagcatgaatgataacttccttaaaaaggtgcggcatccaattcaaatattttcgtcctgattttaaagctggttggtgtagtgctattaaaatttcgttcagttaattttccttttgaaaacttgttcgcacgttgtttagggtgcccttacttcagcaaaggagaaggagtaggagagccttagaatttttgaggaaaaaaaaacctataacatacaatgtactgtatcaaactattttacatgaatgacacaagtattctgaataaaaaataattgaacattgttaaaaacaaggtgttatgtaataaatttatttttcataaatcaaaa

SEQ ID NO: 1248 - DNA, 1337 bp, Homo sapiens
atggactatgactttaaagtgaagctgagcagcgagcgggagcgggtcgaggacctgtttgaatacgagggctgcaaagttggccgaggcacttatggtcacgtctacaaagccaagaggaaagatgggaaggatgataaagactatgctttaaaacaaatagaaggaactgggatctctatgtcggcatgtagagaaatagcattacttcgagagcttaagcatccaaacgtcatttctcttcaaaaggtgtttctgtctcatgctgataggaaggtgtggcttctgtttgactatgctgaacatgacctctggcatataatcaagtttcacagagcttctaaagcaaacaagaagccagttcagttacctcggggaatggtgaagtcactattatatcagatcctagatggtattcactacctgcatgctaactgggtgttgcacagagatttgctgacatgggctttgcccgattatttaattcacctttgaagcctttagcagatttggatccagtggttgttacattctggtaccgagcccctgaactacttcttggagcaaggcattataccaaagctattgatatttgggctatagggtgtatatttgcagaactactaacgtcagaaccaatatttcactgtcgacaagaggacatcaaaactagtaatccttatcaccatgaccagctggacagaatattcaatgtaatgggatttcctgcagataaagattgggaagatataaaaaagatgcctgaacattcaacattaatgaaagatttcagaagaaatacgtataccaactgcagccttatcaagtatatggaaaaacataaagttaaaccagatagtaaagcattccacttgcttcagaagctgcttaccatggacccaataaagcgaattacctcagaacaggctatgcaggacccctatttcttagaagacccacttcctacatcagacgtttttgccggttgtcaaatcccttacccaaaacgagaatttttaacggaagaagaacctgatgacaaaggagacaaaaagaaccagcagcagcagcagggcaataaccacactaatggaactggccacccagggaatcaagacagcagtcacacacagggacccccgttgaagaaagtgagagttgttcctcctaccactacctcaggtggacttatcatgacctcagactatcagcgttccaatccacatgctgcctatcccaaccctggaccaagcacatcacagccgcagagcagcatgggatactcagctacctcccagcagcctccacagtactcacatcagacacatcggtactga

SEQ ID NO: 1249 - DNA, 2463 bp, Homo sapiens
gcgcggccgcggaggggcctggagtgcggcggcggcgggacccggagcaggagcggcggcagcagcgactgggggcggcggcggcgcgttggaggcggccatggcaaagcagtacgactcggtggagtgccctttttgtgatgaagtttccaaatacgagaagctcgccaagatcggccaaggcaccttcggggaggtgttcaaggccaggcaccgcaagaccggccagaaggtggctctgaagaaggtgctgatggaaaacgagaaggaggggttccccattacagccttgcgggagatcaagatccttcagcttctaaaacacgagaatgtggtcaacttgattgagatttgtcgaaccaaagcttccccctataaccgctgcaagggtagtatatacctggtgttcgacttctgcgagcatgaccttgctgggctgttgagcaatgttttggtcaagttcacgctgtctgagatcaagagggtgatgcagatgctgcttaacggcctctactacatccacagaaacaagatcctgcatagggacatgaaggctgctaatgtgcttatcactcgtgatggggtcctgaagctggcagactttgggctggcccgggccttcagcctggccaagaacagccagcccaaccgctacaccaaccgtgtggtgacactctggtaccggcccccggagctgttgctcggggagcgggactacggcccccccattgacctgtggggtgctgggtgcatcatggcagagatgtggacccgcagccccatcatgcagggcaacacggagcagcaccaactcgccctcatcagtcagctctgcggctccatcacccctgaggtgtggccaaacgtggacaactatgagctgtacgaaaagctggagctggtcaagggccagaagcggaaggtgaaggacaggctgaaggcctatgtgcgtgacccatacgcactggacctcatcgacaagctgctggtgctggaccctgcccagcgcatcgacagcgatgacgccctcaaccacgacttcttctggtccgaccccatgccctccgacctcaagggcatgctctccacccacctgacgtccatgttcgagtacttggcaccaccgcgccggaagggcagccagatcacccagcagtccaccaaccagagtcgcaatcccgccaccaccaaccagacggagtttgagcgcgtcttctgagggccggcgcttgccactagggctcttgtgttttttttcttctgctatgtgacttgcatcgtggagacagggcatttgagtttatatctctcatgcatattttatttaatccccaccctgggctctgggagcagcccgctgagtggactggagtggagcattggctgagagaccaggagggcactggagctgtcttgtccttgctggttttctggatggttcccagagggtttccatggggtaggaggatgggctcgcccaccagtgactttttctaagagctcccggcgtggtggaagaggggacaggtccctcacccacccacaatcctattctcgggctgagaaccctgcgtggggacagggctcgcctcaggaatgggctgtttttggcctaaccctcagaaacactggggctggcacaaactcttggtttcttcaacaggagaattttactgtgtttcttttggttccattgtttggagacattcctgggcacagtttggtccgttagaattaaaagttgaattttttttttttttaaatttttttttttcctccaggacttgtgtgttttgttctgcgcacacaccgccaactgttcccccacagtcagcagcaggttgggcctgaccattgggacttgattgtcaagtcactggaggtcttgacttttttatctcagttcatgttctcttccataattggaaaggacctttgtctgtttttcctcttgggtgccttccagaacgcatctcatgtccctggtgagggaattggtgagggcctgctgtgagctgctgtggctgcgatggtcacccagctgggcaaatcactggagtgacaatttgacctgtcacctgagaaggatggtccctcagactgctgggtagagggcctggggcaggctggagagagaaagtgggcagagggtgaagggatcacaggggtcttggaaggtggcagtagtttggacgggggtggggagtatgtgggagaaaaaaacagactgaaggtagaatccttgggaacctttgaggagcggcacattctggcaggcacgttttctgtgagcctgaagttaggaagagacattctggaggtcaatttcctacatcctcttacaggcggagaccttgaagtggggccaggaaggaaggttggcaaaacctttgaccagaactgtccttcatttacagaaactgacccagaccacaacacaaaaggccagtaaaagtaagaaaa

SEQ ID NO: 1250 - DNA, 2700 bp, Homo sapiens
atgcagcgggacgcgccaccccgagccccagctccggcgccccggctccccgcgcccccgatcggggccgccgctagtagtggcggcggcggaggcgggggcagcggcggcggcggcggaggcgcctctgcagctccggctccccctggcctctcgggaactacaagtcccagggggcctggcggtgggcggcgggcggaagaggcggggtcggcgccgcgaggccggaagtggccgtggaggcggaagtggcgcggccgcggaggggcctggagtgcggcggcggcgggacccggagcaggagcggcggcagcagcgactgggggcggcggcggcgcgttggaggcggccatggcaaagcagtacgactcggtggagtgccctttttgtgatgaagtttccaaatacgagaagctcgccaagatcggccaaggcaccttcggggaggtgttcaaggccaggcaccgcaagaccggccagaaggtggctctgaagaaggtgctgatggaaaacgagaaggaggggttccccattacagccttgcgggagatcaagatccttcagcttctaaaacacgagaatgtggtcaacttgattgagatttgtcgaaccaaagcttccccctataaccgctgcaagggtagtatatacctggtgttcgacttctgcgagcatgaccttgctgggctgttgagcaatgttttggtcaagttcacgctgtctgagatcaagagggtgatgcagatgctgcttaacggcctctactacatccacagaaacaagatcctgcatagggacatgaaggctgctaatgtgcttatcactcgtgatggggtcctgaagctggcagactttgggctggcccgggccttcagcctggccaagaacagccagcccaaccgctacaccaaccgtgtggtgacactctggtaccggcccccggagctgttgctcggggagcgggactacggcccccccattgacctgtggggtgctgggtgcatcatggcagagatgtggacccgcagccccatcatgcagggcaacacggagcagcaccaactcgccctcatcagtcagctctgcggctccatcacccctgaggtgtggccaaacgtggacaactatgagctgtacgaaaagctggagctggtcaagggccagaagcggaaggtgaaggacaggctgaaggcctatgtgcgtgacccatacgcactggacctcatcgacaagctgctggtgctggaccctgcccagcgcatcgacagcgatgacgccctcaaccacgacttcttctggtccgaccccatgccctccgacctcaagggcatgctctccacccacctgacgtccatgttcgagtacttggcaccaccgcgccggaagggcagccagatcacccagcagtccaccaaccagagtcgcaatcccgccaccaccaaccagacggagtttgagcgcgtcttctgagggccggcgcttgccactagggctcttgtgttttttttcttctgctatgtgacttgcatcgtggagacagggcatttgagtttatatctctcatgcatattttatttaatccccaccctgggctctgggagcagcccgctgagtggactggagtggagcattggctgagagaccaggagggcactggagctgtcttgtccttgctggttttctggatggttcccagagggtttccatggggtaggaggatgggctcgcccaccagtgactttttctaagagctcccggcgtggtggaagaggggacaggtccctcacccacccacaatcctattctcgggctgagaaccctgcgtggggacagggctcgcctcaggaatgggctgtttttggcctaaccctcagaaacactggggctggcacaaactcttggtttcttcaacaggagaattttactgtgtttcttttggttccattgtttggagacattcctgggcacagtttggtccgttagaattaaaagttgaattttttttttttttaaatttttttttttcctccaggacttgtgtgttttgttctgcgcacacaccgccaactgttcccccacagtcagcagcaggttgggcctgaccattgggacttgattgtcaagtcactggaggtcttgacttttttatctcagttcatgttctcttccataattggaaaggacctttgtctgtttttcctcttgggtgccttccagaacgcatctcatgtccctggtgagggaattggtgagggcctgctgtgagctgctgtggctgcgatggtcacccagctgggcaaatcactggagtgacaatttgacctgtcacctgagaaggatggtccctcagactgctgggtagagggcctggggcaggctggagagagaaagtgggcagagggtgaagggatcacaggggtcttggaaggtggcagtagtttggacgggggtggggagtatgtgggagaaaaaaacagactgaaggtagaatccttgggaacctttgaggagcggcacattctggcaggcacgttttctgtgagcctgaagttaggaagagacattctggaggtcaatttcctacatcctcttacaggcggagaccttgaagtggggccaggaaggaaggttggcaaaacctttgaccagaactgtccttcatttacagaaactgacccagaccacaacacaaaaggccag

SEQ ID NO: 1251 - DNA, 702 bp, Homo sapiens
cgccccgcgcagcccggcggaggcggcgccgtcggaggaggaggagcagggcactgcggctggccccggatcgggcgccagagcggcagcagcttcggcagcagcggcggcccgggcccatgcagcgggacgcgccaccccgagccccagctccggcgccccggctccccgcgcccccgatcggggccgccgctagtagtggcggcggcggaggcgggggcagcggcggcggcggcggaggcgcctctgcagctccggctccccctggcctctcgggaactacaagtcccagggggcctggcggtgggcggcgggcggaagaggcggggtcggcgccgcgaggccggaagtggccgtggaggcggaagtggcgcggccgcggaggggcctggagtgcggcggcggcgggacccggagcaggagcggcggcagcagcgactgggggcggcggcggcgcgttggaggcggccatggcaaagcagtacgactcggtggagtgccctttttgtgatgaagtttccaaatacgagaagctcgccaagatcggccaaggcaccttcggggaggtgttcaaggccaggcaccgcaagaccggccagaaggtggctctgaagaaggtgctgatggaaaacgagaaggaggggttccccattacagccttgcgggagatcaagatccttcagcttctaaaacacgagaatg

SEQ ID NO: 1252 - DNA, 2180 bp, Homo sapiens
gaggcgggcccgggcggggcggttgtatatcagggccgcgctgagctgcgccagctgaggtgtgagcagctgccgaagtcagttccttgtggagccggagctgggcgcggattcgccgaggcaccgaggcactcagaggaggcgccatgtcagaaccggctggggatgtccgtcagaacccatgcggcagcaaggcctgccgccgcctcttcggcccagtggacagcgagcagctgagccgcgactgtgatgcgctaatggcgggctgcatccaggaggcccgtgagcgatggaacttcgactttgtcaccgagacaccactggagggtgacttcgcctgggagcgtgtgcggggccttggcctgcccaagctctaccttcccacggggccccggcgaggccgggatgagttgggaggaggcaggcggcctggcacctcacctgctctgctgcaggggacagcagaggaagaccatgtggacctgtcactgtcttgtacccttgtgcctcgctcaggggagcaggctgaagggtccccaggtggacctggagactctcagggtcgaaaacggcggcagaccagcatgacagatttctaccactccaaacgccggctgatcttctccaagaggaagccctaatccgcccacaggaagcctgcagtcctggaagcgcgagggcctcaaaggcccgctctacatcttctgccttagtctcagtttgtgtgtcttaattattatttgtgttttaatttaaacacctcctcatgtacataccctggccgccccctgccccccagcctctggcattagaattatttaaacaaaaactaggcggttgaatgagaggttcctaagagtgctgggcatttttattttatgaaatactatttaaagcctcctcatcccgtgttctccttttcctctctcccggaggttgggtgggccggcttcatgccagctacttcctcctccccacttgtccgctgggtggtaccctctggaggggtgtggctccttcccatcgctgtcacaggcggttatgaaattcaccccctttcctggacactcagacctgaattctttttcatttgagaagtaaacagatggcactttgaaggggcctcaccgagtgggggcatcatcaaaaactttggagtcccctcacctcctctaaggttgggcagggtgaccctgaagtgagcacagcctagggctgagctggggacctggtaccctcctggctcttgatacccccctctgtcttgtgaaggcagggggaaggtggggtcctggagcagaccaccccgcctgccctcatggcccctctgacctgcactggggagcccgtctcagtgttgagccttttccctctttggctcccctgtaccttttgaggagccccagctaccctttttctccagctgggctctgcaattcccctctgctgctgtccctcccccttgtcctttcccttcagtaccctctcagctccaggtggctctgaggtgcctgtcccacccccacccccagctcaatggactggaaggggaagggacacacaagaagaagggcaccctagttctacctcaggcagctcaagcagcgaccgccccctcctctagctgtgggggtgagggtcccatgtggtggcacaggcccccttgagtggggttatctctgtgttaggggtatatgatgggggagtagatctttctaggagggagacactggcccctcaaatcgtccagcgaccttcctcatccaccccatccctccccagttcattgcactttgattagcagcggaacaaggagtcagacattttaagatggtggcagtagaggctatggacagggcatgccacgtgggctcatatggggctgggagtagttgtctttcctggcactaacgttgagcccctggaggcactgaagtgcttagtgtacttggagtattggggtctgaccccaaacaccttccagctcctgtaacatactggcctggactgttttctctcggctccccatgtgtcctggttcccgtttctccacctagactgtaaacctctcgagggcagggaccacaccctgtactgttctgtgtctttcacagctcctcccacaatgctgaatatacagcaggtgctcaataaatgattcttagtgactttacttgtaa

SEQ ID NO: 1253 - DNA, 766 bp, Homo sapiens
gagcagctgccgaagtcagttccttgtggagccggagctgggcgcggattcgccgaggcaccgaggcactcagaggaggaaaatccagttgctgccaaggtcgtgcagtcactcagccctggagtcaagccagagcaggcaggcgccatgtcagaaccggctggggatgtccgtcagaacccatgcggcagcaaggcctgccgccgcctcttcggcccagtggacagcgagcagctgagccgcgactgtgatgcgctaatggcgggctgcatccaggaggcccgtgagcgatggaacttcgactttgtcaccgagacaccactggagggtgacttcgcctgggagcgtgtgcggggccttggcctgcccaagctctaccttcccacggggccccggcgaggccgggatgagttgggaggaggcaggcggcctggcacctcacctgctctgctgcaggggacagcagaggaagaccatgtggacctgtcactgtcttgtacccttgtgcctcgctcaggggagcaggctgaagggtccccaggtggacctggagactctcagggtcgaaaacggcggcagaccagcatgacagatttctaccactccaaacgccggctgatcttctccaagaggaagccctaatccgcccacaggaagcctgcagtcctggaagcgcgagggcctcaaaggcccgctctacatcttctgccttagtctcagtttgtgtgtcttaattattatttgtgttttaatttaaacacctcct

SEQ ID NO: 1254 - DNA, 2261 bp, Homo sapiens
agctgaggtgtgagcagctgccgaagtcagttccttgtggagccggagctgggcgcggattcgccgaggcaccgaggcactcagaggaggtgagagagcggcggcagacaacaggggaccccgggccggcggcccagagccgagccaagcgtgcccgcgtgtgtccctgcgtgtccgcgaggatgcgtgttcgcgggtgtgtgctgcgttcacaggtgtttctgcggcaggcgccatgtcagaaccggctggggatgtccgtcagaacccatgcggcagcaaggcctgccgccgcctcttcggcccagtggacagcgagcagctgagccgcgactgtgatgcgctaatggcgggctgcatccaggaggcccgtgagcgatggaacttcgactttgtcaccgagacaccactggagggtgacttcgcctgggagcgtgtgcggggccttggcctgcccaagctctaccttcccacggggccccggcgaggccgggatgagttgggaggaggcaggcggcctggcacctcacctgctctgctgcaggggacagcagaggaagaccatgtggacctgtcactgtcttgtacccttgtgcctcgctcaggggagcaggctgaagggtccccaggtggacctggagactctcagggtcgaaaacggcggcagaccagcatgacagatttctaccactccaaacgccggctgatcttctccaagaggaagccctaatccgcccacaggaagcctgcagtcctggaagcgcgagggcctcaaaggcccgctctacatcttctgccttagtctcagtttgtgtgtcttaattattatttgtgttttaatttaaacacctcctcatgtacataccctggccgccccctgccccccagcctctggcattagaattatttaaacaaaaactaggcggttgaatgagaggttcctaagagtgctgggcatttttattttatgaaatactatttaaagcctcctcatcccgtgttctccttttcctctctcccggaggttgggtgggccggcttcatgccagctacttcctcctccccacttgtccgctgggtggtaccctctggaggggtgtggctccttcccatcgctgtcacaggcggttatgaaattcaccccctttcctggacactcagacctgaattctttttcatttgagaagtaaacagatggcactttgaaggggcctcaccgagtgggggcatcatcaaaaactttggagtcccctcacctcctctaaggttgggcagggtgaccctgaagtgagcacagcctagggctgagctggggacctggtaccctcctggctcttgatacccccctctgtcttgtgaaggcagggggaaggtggggtcctggagcagaccaccccgcctgccctcatggcccctctgacctgcactggggagcccgtctcagtgttgagccttttccctctttggctcccctgtaccttttgaggagccccagctaccctttttctccagctgggctctgcaattcccctctgctgctgtccctcccccttgtcctttcccttcagtaccctctcagctccaggtggctctgaggtgcctgtcccacccccacccccagctcaatggactggaaggggaagggacacacaagaagaagggcaccctagttctacctcaggcagctcaagcagcgaccgccccctcctctagctgtgggggtgagggtcccatgtggtggcacaggcccccttgagtggggttatctctgtgttaggggtatatgatgggggagtagatctttctaggagggagacactggcccctcaaatcgtccagcgaccttcctcatccaccccatccctccccagttcattgcactttgattagcagcggaacaaggagtcagacattttaagatggtggcagtagaggctatggacagggcatgccacgtgggctcatatggggctgggagtagttgtctttcctggcactaacgttgagcccctggaggcactgaagtgcttagtgtacttggagtattggggtctgaccccaaacaccttccagctcctgtaacatactggcctggactgttttctctcggctccccatgtgtcctggttcccgtttctccacctagactgtaaacctctcgagggcagggaccacaccctgtactgttctgtgtctttcacagctcctcccacaatgctgaatatacagcaggtgctcaataaatgattcttagtgacttt

SEQ ID NO: 1255 - DNA, 1157 bp, Homo sapiens
agtttccccagcagtgtatacgggctatgtggggagtattcaggagacagacaactcactcgtcaaatcctccccttcctggccaacaaagctgctgcaaccacagggatttcttctgttcaggcgccatgtcagaaccggctggggatgtccgtcagaacccatgcggcagcaaggcctgccgccgcctcttcggcccagtggacagcgagcagctgagccgcgactgtgatgcgctaatggcgggctgcatccaggaggcccgtgagcgatggaacttcgactttgtcaccgagacaccactggagggtgacttcgcctgggagcgtgtgcggggccttggcctgcccaagctctaccttcccacggggccccggcgaggccgggatgagttgggaggaggcaggcggcctggcacctcacctgctctgctgcaggggacagcagaggaagaccatgtggacctgtcactgtcttgtacccttgtgcctcgctcaggggagcaggctgaagggtccccaggtggacctggagactctcagggtcgaaaacggcggcagaccagcatgacagatttctaccactccaaacgccggctgatcttctccaagaggaagccctaatccgcccacaggaagcctgcagtcctggaagcgcgagggcctcaaaggcccgctctacatcttctgccttagtctcagtttgtgtgtcttaattattatttgtgttttaatttaaacacctcctcatgtacataccctggccgccccctgccccccagcctctggcattagaattatttaaacaaaaactaggcggttgaatgagaggttcctaagagtgctgggcatttttattttatgaaatactatttaaagcctcctcatcccgtgttctccttttcctctctcccggaggttgggtgggccggcttcatgccagctacttcctcctccccacttgtccgctgggtggtaccctctggaggggtgtggctccttcccatcgctgtcacaggcggttatgaaattcaccccctttcctggacactcagacctgaattctttttcatttgagaagtaaacagatggcactttgaaggggcctcaccgagtgggggcatcatcaaaaactttggagtcccctcacctcctcta

SEQ ID NO: 1256 - DNA, 2657 bp, Homo sapiens
tttaatttctccgaggccagccagagcaggtttgttggcagcagtacccctccagcagtcacgcgaccagccaatctcccggcggcgctcggggaggcggcgcgctcgggaacgaggggaggtggcggaaccgcgccggggccaccttaaggccgcgctcgccagcctcggcggggcggctcccgccgccgcaaccaatggatctcctcctctgtttaaatagactcgccgtgtcaatcattttcttcttcgtcagcctcccttccaccgccatattgggccactaaaaaaagggggctcgtcttttcggggtgtttttctccccctcccctgtccccgcttgctcacggctctgcgactccgacgccggcaaggtttggagagcggctgggttcgcgggacccgcgggcttgcacccgcccagactcggacgggctttgccaccctctccgcttgcctggtcccctctcctctccgccctcccgctcgccagtccatttgatcagcggagactcggcggccgggccggggcttccccgcagcccctgcgcgctcctagagctcgggccgtggctcgtcggggtctgtgtcttttggctccgagggcagtcgctgggcttccgagaggggttcgggctgcgtaggggcgctttgttttgttcggttttgtttttttgagagtgcgagagaggcggtcgtgcagacccgggagaaagatgtcaaacgtgcgagtgtctaacgggagccctagcctggagcggatggacgccaggcaggcggagcaccccaagccctcggcctgcaggaacctcttcggcccggtggaccacgaagagttaacccgggacttggagaagcactgcagagacatggaagaggcgagccagcgcaagtggaatttcgattttcagaatcacaaacccctagagggcaagtacgagtggcaagaggtggagaagggcagcttgcccgagttctactacagacccccgcggccccccaaaggtgcctgcaaggtgccggcgcaggagagccaggatgtcagcgggagccgcccggcggcgcctttaattggggctccggctaactctgaggacacgcatttggtggacccaaagactgatccgtcggacagccagacggggttagcggagcaatgcgcaggaataaggaagcgacctgcaaccgacgattcttctactcaaaacaaaagagccaacagaacagaagaaaatgtttcagacggttccccaaatgccggttctgtggagcagacgcccaagaagcctggcctcagaagacgtcaaacgtaaacagctcgaattaagaatatgtttccttgtttatcagatacatcactgcttgatgaagcaaggaagatatacatgaaaattttaaaaatacatatcgctgacttcatggaatggacatcctgtataagcactgaaaaacaacaacacaataacactaaaattttaggcactcttaaatgatctgcctctaaaagcgttggatgtagcattatgcaattaggtttttccttatttgcttcattgtactacctgtgtatatagtttttaccttttatgtagcacataaactttggggaagggagggcagggtggggctgaggaactgacgtggagcggggtatgaagagcttgctttgatttacagcaagtagataaatatttgacttgcatgaagagaagcaattttggggaagggtttgaattgttttctttaaagatgtaatgtccctttcagagacagctgatacttcatttaaaaaaatcacaaaaatttgaacactggctaaagataattgctatttatttttacaagaagtttattctcatttgggagatctggtgatctcccaagctatctaaagtttgttagatagctgcatgtggcttttttaaaaaagcaacagaaacctatcctcactgccctccccagtctctcttaaagttggaatttaccagttaattactcagcagaatggtgatcactccaggtagtttggggcaaaaatccgaggtgcttgggagttttgaatgttaagaattgaccatctgcttttattaaatttgttgacaaaattttctcattttcttttcacttcgggctgtgtaaacacagtcaaaataattctaaatccctcgatatttttaaagatctgtaagtaacttcacattaaaaaatgaaatattttttaatttaaagcttactctgtccatttatccacaggaaagtgttatttttcaaggaaggttcatgtagagaaaagcacacttgtaggataagtgaaatggatactacatctttaaacagtatttcattgcctgtgtatggaaaaaccatttgaagtgtacctgtgtacataactctgtaaaaacactgaaaaattatactaacttatttatgttaaaagattttttttaatctagacaatatacaagccaaagtggcatgttttgtgcatttgtaaatgctgtgttgggtagaataggttttcccctcttttgttaaataatatggctatgcttaaaaggttgcatactgagccaagtataattttttgtaatgtgtgaaaaagatgccaattattgttacacattaagtaatcaataaagaaaacttccatagctatt

SEQ ID NO: 1257 - DNA, 1405 bp, Homo sapiens
acggctctgcgactccgacgccggcaaggtttggagagcggctgggttcgcgggacccgcgggcttgcacccgcccagactcggacgggctttgccaccctctccgcttgcctggtcccctctcctctccgccctcccgctcgccagtccatttgatcagcggagactcggcctgcaggaacctcttcggcccggtggaccacgaagagttaacccgggacttggagaagcactgcagagacatggaagaggcgagccagcgcaagtggaatttcgattttcagaatcacaaacccctagagggcaagtacgagtggcaagaggtggagaagggcagcttgcccgagttctactacagacccccgcggccccccaaaggtgcctgcaaggtgccggcgcaggagagccaggatgtcagcgggagccgcccggcggcgcctttaattggggctccggctaactctgaggacacgcatttggtggacccaaagactgatccgtcggacagccagacggggttagcggagcaatgcgcaggaataaggaagcgacctgcaaccgacgattcttctactcaaaacaaaagagccaacagaacagaagaaaatgtttcagacggttccccaaatgccggttctgtggagcagacgcccaagaagcctggcctcagaagacgtcaaacgtaaacagctcgaattaagaatatgtttccttgtttatcagatacatcactgcttgatgaagcaaggaagatatacatgaaaattttaaaaatacatatcgctgacttcatggaatggacatcctgtataagcactgaaaaacaacaacacaataacactaaaattttaggcactcttaaatgatctgcctctaaaagcgttggatgtagcattatgcaattaggtttttccttatttgcttcattgtactacctgtgtatatagtttttaccttttatgtagcacataaactttggggaagggagggcagggtggggctgaggaactgacgtggagcggggtatgaagagcttgctttgatttacagcaagtagataaatatttgacttgcatgaagagaagcaattttggggaagggtttgaattgttttctttaaagatgtaatgtccctttcagagacagctgatacttcatttaaaaaaatcacaaaaatttgaacactggctaaagataattgctatttatttttacaagaagtttattctcatttgggagatctggtgatctcccaagctatctaaagtttgttagatagctgcatgtggcttttttaaaaaagcaacagaaacctatcctcactgccctccccagtctctcttaaagttggaatttaccagttaattactcagcagaatggtgatcactccaggtagtttggggc

SEQ ID NO: 1258 - DNA, 1745 bp, Homo sapiens
agtgcgctgtgctcgaggggtgccggccaggcctgagcgagcgagctagccagcaggcatcgagggggcgcggctgccgtccggacgagacaggcgaacccgacgcagaagagtccaccaccggacagccagcacatccacgatggagcgtcttgtcgcccgtgggaccttcccagtactagtgcgcaccagcgcctgccgcagcctcttcgggccggtggaccacgaggagctgagccgcgagctgcaggcccgcctggccgagctgaacgccgaggaccagaaccgctgggattacgacttccagcaggacatgccgctgcggggccctggacgcctgcagtggaccgaagtggacagcgactcggtgcccgcgttctaccgcgagacggtgcaggtggggcgctgccgcctgctgctggcgccgcggcccgtcgcggtcgcggtggctgtcagcccgcccctcgagccggccgctgagtccctcgacggcctcgaggaggcgccggagcagctgcctagtgtcccggtcccggccccggcgtccaccccgcccccagtcccggtcctggctccagccccggccccggctccggctccggtcgcggctccggtcgcggctccggtcgcggtcgcggtcctggccccggccccggccccggctccggctccggctccggccccggctccagtcgcggccccggccccagccccggccccggccccggccccggcccccgccccggccccggccccggacgcggcgcctcaagagagcgccgagcagggcgcgaaccaggggcagcgcggccaggagcctctcgctgaccagctgcactcggggatttcgggacgtcccgcggccggcaccgcggccgccagcgccaacggcgcggcgatcaagaagctgtccgggcctctgatctccgatttcttcgccaagcgcaagagatcagcgcctgagaagtcgtcgggcgatgtccccgcgccgtgtccctctccaagcgccgcccctggcgtgggctcggtggagcagaccccgcgcaagaggctgcggtgagccaaagcccaaagagccccgagggaacctgccggggcagcggacgttggaagggcgctgggcctcggctgggaccgttcatgtagcagcaaccggcggcggctgccgcagagcagcgttcggttttgtttttaaattttgaaaactgtgcaatgtattaataacgtctttttatatctaaatgtattctgcacgagaaggtacactggtcccaaggtgtaaagctttaagagtcatttatataaaatgtttaatctctgctgaaactcagtgcaaaaaaaagaaaaaagaaaaaaaaaaggaaaaaataaaaaaaccatgtatatttgtacaaaaagtttttaaagttatactaacttatattttctatttatgtccaggcgtggaccgctctgccacgcactagctcggttattggttatgccaaaggcactctccatctcccacatctggttattgacaagtgtaactttattttcatcgcggactctggggaagggggtcactcacaagctgtagctgccatacatgcccatctagcttgcagtctcttcgcgctttcgctgtctctcttattatgactgtgtttatctgaaacttgaagacaagtctgttaaaatggttcctgagccgtctgtaccactgccccggcccctcgtccgccgggttctaaataaagaggccg

SEQ ID NO: 1259 - DNA, 2051 bp, Homo sapiens
ggtgttgttgaaactgaaaatactacattatgctaatcgcggccgggcccgcgcgcacgggggtggggcccgcgcgtataaagggggcgcaggcgggctgggcgttccacaggccaagtgcgctgtgctcgaggggtgccggccaggcctgagcgagcgagctagccagcaggcatcgagggggcgcggctgccgtccggacgagacaggcgaacccgacgcagaagagtccaccaccggacagccaggtagccgccgcgtccctcgcacacgcagagtcgggcggcgcggggtctcccttgcgcccggcctccgccctctcctcctctcctttccccttcttctcgctgtcctctcctctctcgctgcccgcgtttgcgcagccccgggccatgtccgacgcgtccctccgcagcacatccacgatggagcgtcttgtcgcccgtgggaccttcccagtactagtgcgcaccagcgcctgccgcagcctcttcgggccggtggaccacgaggagctgagccgcgagctgcaggcccgcctggccgagctgaacgccgaggaccagaaccgctgggattacgacttccagcaggacatgccgctgcggggccctggacgcctgcagtggaccgaagtggacagcgactcggtgcccgcgttctaccgcgagacggtgcaggtggggcgctgccgcctgctgctggcgccgcggcccgtcgcggtcgcggtggctgtcagcccgcccctcgagccggccgctgagtccctcgacggcctcgaggaggcgccggagcagctgcctagtgtcccggtcccggccccggcgtccaccccgcccccagtcccggtcctggctccagccccggccccggctccggctccggtcgcggctccggtcgcggctccggtcgcggtcgcggtcctggccccggccccggccccggctccggctccggctccggccccggctccagtcgcggccccggccccagccccggccccggccccggccccggcccccgccccggccccggccccggacgcggcgcctcaagagagcgccgagcagggcgcgaaccaggggcagcgcggccaggagcctctcgctgaccagctgcactcggggatttcgggacgtcccgcggccggcaccgcggccgccagcgccaacggcgcggcgatcaagaagctgtccgggcctctgatctccgatttcttcgccaagcgcaagagatcagcgcctgagaagtcgtcgggcgatgtccccgcgccgtgtccctctccaagcgccgcccctggcgtgggctcggtggagcagaccccgcgcaagaggctgcggtgagccaatttagagcccaaagagccccgagggaacctgccggggcagcggacgttggaagggcgctgggcctcggctgggaccgttcatgtagcagcaaccggcggcggctgccgcagagcagcgttcggttttgtttttaaattttgaaaactgtgcaatgtattaataacgtctttttatatctaaatgtattctgcacgagaaggtacactggtcccaaggtgtaaagctttaagagtcatttatataaaatgtttaatctctgctgaaactcagtgcaaaaaaaagaaaaaagaaaaaaaaaaggaaaaaataaaaaaaccatgtatatttgtacaaaaagtttttaaagttatactaacttatattttctatttatgtccaggcgtggaccgctctgccacgcactagctcggttattggttatgccaaaggcactctccatctcccacatctggttattgacaagtgtaactttattttcatcgcggactctggggaagggggtcactcacaagctgtagctgccatacatgcccatctagcttgcagtctcttcgcgctttcgctgtctctcttattatgactgtgtttatctgaaacttgaagacaagtctgttaaaatggttcctgagccgtctgtaccactgccccggcccctcgtccgccgggttctaaataaagaggccgaaaaatgctgcaactcca

SEQ ID NO: 1260 - DNA, 1570 bp, Homo sapiens
aggccaagtgcgctgtgctcgaggggtgccggccaggcctgagcgagcgagctagccagcaggcatcgagggggcgcggctgccgtccggacgagacaggcgaacccgacgcagaagagtccaccaccggacagccaggtagccgccgcgtccctcgcacacgcagagtcgggcggcgcggggtctcccttgcgcccggcctccgccctctcctcctctcctttccccttcttctcgctgtcctctcctctctcgctgcccgcgtttgcgcagccccgggccatgtccgacgcgtccctccgcagcacatccacgatggagcgtcttgtcgcccgtgggaccttcccagtactagtgcgcaccagcgcctgccgcagcctcttcgggccggtggaccacgaggagctgagccgcgagctgcaggcccgcctggccgagctgaacgccgaggaccagaaccgctgggattacgacttccagcaggacatgccgctgcggggccctggacgcctgcagtggaccgaagtggacagcgactcggtgcccgcgttctaccgcgagacggtgcaggtggggcgctgccgcctgctgctggcgccgcggcccgtcgcggtcgcggtggctgtcagcccgcccctcgagccggccgctgagtccctcgacggcctcgaggaggcgccggagcagctgcctagtgtcccggtcccggccccggcgtccaccccgcccccagtcccggtcctggctccagccccggccccggctccggctccggtcgcggctccggtcgcggctccggtcgcggtcgcggtcctggccccggccccggccccggctccggctccggctccggccccggctccagtcgcggccccggccccagccccggccccggccccggccccggcccccgccccggccccggccccggacgcggcgcctcaagagagcgccgagcagggcgcgaaccaggggcagcgcggccaggagcctctcgctgaccagctgcactcggggatttcgggacgtcccgcggccggcaccgcggccgccagcgccaacggcgcggcgatcaagaagctgtccgggcctctgatctccgatttcttcgccaagcgcaagagatcagcgcctgagaagtcgtcgggcgatgtccccgcgccgtgtccctctccaagcgccgcccctggcgtgggctcggtggagcagaccccgcgcaagaggctgcggtgagccaaagcccaaagagccccgagggaacctgccggggcagcggacgttggaagggcgctgggcctcggctgggaccgttcatgtagcagcaaccggcggcggctgccgcagagcagcgttcggttttgtttttaaattttgaaaactgtgcaatgtattaataacgtctttttatatctaaatgtattctgcacgagaaggtacactggtcccaaggtgtaaagctttaagagtcatttatataaaatgtttaatctctgctgaaactcagtgcaaaaaaaagaaaaaagaaaaaaaaaaggaaaaaataaaaaaaccatgtatatttgtacaaaaa

SEQ ID NO: 1261 - DNA, 1811 bp, Homo sapiens
cccgcgcgtataaagggggcgcaggcgggctgggcgttccacaggccaagtgcgctgtgctcgaggggtgccggccaggcctgagcgagcgagctagccagcaggcatcgagggggcgcggctgccgtccggacgagacaggcgaacccgacgcagaagagtccaccaccggacagccagcacatccacgatggagcgtcttgtcgcccgtgggaccttcccagtactagtgcgcaccagcgcctgccgcagcctcttcgggccggtggaccacgaggagctgagccgcgagctgcaggcccgcctggccgagctgaacgccgaggaccagaaccgctgggattacgacttccagcaggacatgccgctgcggggccctggacgcctgcagtggaccgaagtggacagcgactcggtgcccgcgttctaccgcgagacggtgcaggtggggcgctgccgcctgctgctggcgccgcggcccgtcgcggtcgcggtggctgtcagcccgcccctcgagccggccgctgagtccctcgacggcctcgaggaggcgccggagcagctgcctagtgtcccggtcccggccccggcgtccaccccgcccccagtcccggtcctggctccagccccggccccggctccggctccggtcgcggctccggtcgcggctccggtcgcggtcgcggtcctggccccggccccggccccggctccggctccggctccggccccggctccagtcgcggccccggccccagccccggccccggccccggccccggcccccgccccggccccggccccggacgcggcgcctcaagagagcgccgagcagggcgcgaaccaggggcagcgcggccaggagcctctcgctgaccagctgcactcggggatttcgggacgtcccgcggccggcaccgcggccgccagcgccaacggcgcggcgatcaagaagctgtccgggcctctgatctccgatttcttcgccaagcgcaagagatcagcgcctgagaagtcgtcgggcgatgtccccgcgccgtgtccctctccaagcgccgcccctggcgtgggctcggtggagcagaccccgcgcaagaggctgcggtgagccaatttagagcccaaagagccccgagggaacctgccggggcagcggacgttggaagggcgctgggcctcggctgggaccgttcatgtagcagcaaccggcggcggctgccgcagagcagcgttcggttttgtttttaaattttgaaaactgtgcaatgtattaataacgtctttttatatctaaatgtattctgcacgagaaggtacactggtcccaaggtgtaaagctttaagagtcatttatataaaatgtttaatctctgctgaaactcagtgcaaaaaaaagaaaaaagaaaaaaaaaaggaaaaaataaaaaaaccatgtatatttgtacaaaaagtttttaaagttatactaacttatattttctatttatgtccaggcgtggaccgctctgccacgcactagctcggttattggttatgccaaaggcactctccatctcccacatctggttattgacaagtgtaactttattttcatcgcggactctggggaagggggtcactcacaagctgtagctgccatacatgcccatctagcttgcagtctcttcgcgctttcgctgtctctcttattatgactgtgtttatctgaaacttgaagacaagtctgttaaaatggttcctgagccgtctgtaccactgccccggcccctcgtccgccgggttctaaataaagaggccgaaaaatgctgcaa

SEQ ID NO: 1262 - DNA, 880 bp, Homo sapiens
ggagagggggagagcaggcagcgggcggcggggagcagcatggagccggcggcggggagcagcatggagccttcggctgactggctggccacggccgcggcccggggtcgggtagaggaggtgcgggcgctgctggaggcgggggcgctgcccaacgcaccgaatagttacggtcggaggccgatccaggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagaaatgatcggaaaccatttgtgggtttgtagaagcaggcatgcgtagggaagctacgggattccgccgaggagcgccagagcctgaggcgccctttggttatcgcaagctggctggctcactccgcaccaggtgcaaaagatgcctggggatgcgggaagggaaaggccacatcttcacgccttcgcgcctggcattacatccccgattgaaagaaccagagaggctctgagaaacctcgggaaacttagatcatcagtcaccgaaggtcctacagggccacaactgcccccgccacaacccaccccgctttcgtagttttcatttagaaaatagagcttttaaaaatgtcctgccttttaacgtagatatatgccttccccca

SEQ ID NO: 1263 - DNA, 1218 bp, Homo sapiens
cccaacctggggcgacttcaggggtgccacattcgctaagtgctcggagttaatagcacctcctccgagcactcgctcacggcgtccccttgcctggaaagataccgcggtccctccagaggatttgagggacagggtcggagggggctcttccgccagcaccggaggaagaaagaggaggggctggctggtcaccagagggtggggcggaccgcgtgcgctcggcggctgcggagagggggagagcaggcagcgggcggcggggagcagcatggagccggcggcggggagcagcatggagccttcggctgactggctggccacggccgcggcccggggtcgggtagaggaggtgcgggcgctgctggaggcgggggcgctgcccaacgcaccgaatagttacggtcggaggccgatccaggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagacatccccgattgaaagaaccagagaggctctgagaaacctcgggaaacttagatcatcagtcaccgaaggtcctacagggccacaactgcccccgccacaacccaccccgctttcgtagttttcatttagaaaatagagcttttaaaaatgtcctgccttttaacgtagatatatgccttcccccactaccgtaaatgtccatttatatcattttttatatattcttataaaaatgtaaaaaagaaaaacaccgcttctgccttttcactgtgttggagttttctggagtgagcactcacgccctaagcgcacattcatgtgggcatttcttgcgagcctcgcagcctccggaagctgtcgacttcatgacaagcattttgtgaactagggaagctcaggggggttactggcttctcttgagtcacactgctagcaaatggcagaaccaaagctcaaataaaaataaaataattttcattcattcactc

SEQ ID NO: 1264 - DNA, 1151 bp, Homo sapiens
cgctcagggaaggcgggtgcgcgcctgcggggcggagatgggcagggggcggtgcgtgggtcccagtctgcagttaagggggcaggagtggcgctgctcacctctggtgccaaagggcggcgcagcggctgccgagctcggccctggaggcggcgagaacatggtgcgcaggttcttggtgaccctccggattcggcgcgcgtgcggcccgccgcgagtgagggttttcgtggttcacatcccgcggctcacgggggagtgggcagcgccaggggcgcccgccgctgtggccctcgtgctgatgctactgaggagccagcgtctagggcagcagccgcttcctagaagaccaggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagacatccccgattgaaagaaccagagaggctctgagaaacctcgggaaacttagatcatcagtcaccgaaggtcctacagggccacaactgcccccgccacaacccaccccgctttcgtagttttcatttagaaaatagagcttttaaaaatgtcctgccttttaacgtagatatatgccttcccccactaccgtaaatgtccatttatatcattttttatatattcttataaaaatgtaaaaaagaaaaacaccgcttctgccttttcactgtgttggagttttctggagtgagcactcacgccctaagcgcacattcatgtgggcatttcttgcgagcctcgcagcctccggaagctgtcgacttcatgacaagcattttgtgaactagggaagctcaggggggttactggcttctcttgagtcacactgctagcaaatggcagaaccaaagctcaaataaaaataaaataattttcattcattcactca

SEQ ID NO: 1265 - DNA, 716 bp, Homo sapiens
ctcctccgagcactcgctcacggcgtccccttgcctggaaagataccgcggtccctccagaggatttgagggacagggtcggagggggctcttccgccagcaccggaggaagaaagaggaggggctggctggtcaccagagggtggggcggaccgcgtgcgctcggcggctgcggagagggggagagcaggcagcgggcggcggggagcagcatggagccggcggcggggagcagcatggagccttcggctgactggctggccacggccgcggcccggggtcgggtagaggaggtgcgggcgctgctggaggcgggggcgctgcccaacgcaccgaatagttacggtcggaggccgatccaggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagaaatgatcggaaaccatttgtgggtttgtagaagcaggcatgcgtag

SEQ ID NO: 1266 - DNA, 905 bp, Homo sapiens
cgctcagggaaggcgggtgcgcgcctgcggggcggagatgggcagggggcggtgcgtgggtcccagtctgcagttaagggggcaggagtggcgctgctcacctctggtgccaaagggcggcgcagcggctgccgagctcggccctggaggcggcgagaacatggtgcgcaggttcttggtgaccctccggattcggcgcgcgtgcggcccgccgcgagtgagggttttcgtggttcacatcccgcggctcacgggggagtgggcagcgccaggggcgcccgccgctgtggccctcgtgctgatgctactgaggagccagcgtctagggcagcagccgcttcctagaagaccaggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagacatccccgattgaaagaaccagagaggctctgagaaacctcgggaaacttagatcatcagtcaccgaaggtcctacagggccacaactgcccccgccacaacccaccccgctttcgtagttttcatttagaaaatagagcttttaaaaatgtcctgccttttaacgtagatatatgccttcccccactaccgtaaatgtccatttatatcattttttatatattcttataaaaatgtaaaaaag

SEQ ID NO: 1267 - DNA, 3829 bp, Homo sapiens
gtgaggactccgcgacgcgtccgcaccctgcggccagagcggctttgagctcggctgcgtccgcgctaggcgctttttcccagaagcaatccaggcgcgcccgctggttcttgagcgccaggaaaagcccggagctaacgaccggccgctcggccactgcacggggccccaagccgcagaaggacgacgggagggtaatgaagctgagcccaggtctcctaggaaggagagagtgcgccggagcagcgtgggaaagaagggaagagtgtcgttaagtttacggccaacggtggattatccgggccgctgcgcgtctgggggctgcggaatgcgcgaggagaacaagggcatgcccagtgggggcggcagcgatgagggtctggccagcgccgcggcgcggggactagtggagaaggtgcgacagctcctggaagccggcgcggatcccaacggagtcaaccgtttcgggaggcgcgcgatccaggtcatgatgatgggcagcgcccgcgtggcggagctgctgctgctccacggcgcggagcccaactgcgcagaccctgccactctcacccgaccggtgcatgatgctgcccgggagggcttcctggacacgctggtggtgctgcaccgggccggggcgcggctggacgtgcgcgatgcctggggtcgtctgcccgtggacttggccgaggagcggggccaccgcgacgttgcagggtacctgcgcacagccacgggggactgacgccaggttccccagccgcccacaacgactttattttcttacccaatttcccacccccacccacctaattcgatgaaggctgccaacggggagcggcggaaagcctgtaagcctgcaagcctgtctgagactcacaggaaggaggagccgaccgggaataaccttccatacatttttttctttgtcttatctggccctcgacactcaccatgaagcgaaacacagagaagcggatttccagggatatttaggagtgtgtgacattccaggggtcgtttgcttttcagggttttctgagggaaagtgcatatgaaatccttgactggacctggtggctacgaatcttccgatggatgaatctcccactccagcgctgagtgggagaaggcagtgattagcacttgggtgacggcagtcgatgcgttcactccaatgtctgctgaggagttatggtgaacccacaacttaggccctagcggcagaaaggaaaacctgaagactgaggacaaagtggaggagggccgaggtgggcttcagtaagtccccggcggcgctttagtttgagcgcatggcaagtcacatgcgtaaacgacactctctggaagccctggagaccctcgcccaactccaccagatagcagaggggtaagagaggatgtgcaagcgacgacagatgctaaaatccctggatcacgacgctgcagagcacctttgcacaggatgctggcctttgctcttactacactgaggagagattcccgcgggttccgcaggcagactacacaggatgaggtggtggagtggagtgagagcaattgtaacggttaactgtaacgttttctttcacacacacacacacacacacacacacacatgctaggatgcggaaatccccttatgacttgctactttttgattttgtgatattttgtactttttagttgttcagcaactgtcttatttaatggggagattttaagtaacataactagtggctctcagttaaaatgtgaggaagaactacagctcttaaatgtagcaatggcactgttgcaaactcagtgcaaacgcctagattgctttcttcttaacctatttatttctttgttaaatttttctgattgtttcctttatagagtgtctcagggtgcagaggtcagactaagaaatattccaaatgtcttttagaagatagatgcacttatgcagtaaattatcttgggatagttcccaaaagattgctgaaaaagtagattgagtataaaaacttgaaaatatatgatggctcgtgggatgtcctactatcactgaacaaactaaaggtgcactgctttgggatttaatttccagggttgcttgatcattatatcattggaacaactgatacttcactactttaataaagaattaacagagattgaactccaagaggtgggtaatttggtttaaaaatacatgttcatgggtttaccactaactcctgagaaatgttaaaggttcacaggggttcccttctctcaatgtttgtaataattgctcataagcaataccagcaattcataaaaactgcttacttatgccatagaaaattaaacacaaagtgtatacatgtattatgcttctaaatgctcattctaccagatacacatttaaaagagaaaaaaggaacagaaacaagtcatttgagagtggagacttataagaaggagtacatttgagttgaatacacaaatctttacttctctaccaattcctattcccaaaatgaacatattactggggaaagttagttgagaatcagagcatatgttattggggaaaggatatgtttattgacacataatctgtaccaggtatgcattaaaatatatttgttaatttaatatttaaacctgagagataggtattgtttcccagatgaggacaatgaggcaaagaaatatcaagtaacttgccaaaggttacaagatattcattccatggatgcacaaagaagtgcatctagttccacagctgattatggttgtcttgcttttcttcccattgcaccagcttgtcctccaaaatcatgaatgatacacatgaagataactttttttaaaaaaaagcagaaatacacaatgatctcccttgtaagctcctaaggtggcttttctttctctaacttctagtaaatataaacggtttgtttgaaaactattttaaaatgtcaacaatatggagaataaccccccccaacacacctataaaaacccaaatttttggaacaaagataatggaacctccattttcaaactgaagcacagggacagaaaatatatttctagttatcacttaagcactcaatcattagaggctacaagaataatatttttaaagttacagtattttacaattattagaaaacattctatataaaagaagtcagttgatactttaaaatctcccatttggtttataaaatcccttaatttgacctctatatcttaaattccaagatgtttaaatttgctagttgcattatactgggtcatgaaaaattatcccttgaaatagatatgaaacatgttacttcatttctggtttaaataacttgtggaatctttcctaatgacaacctgatattaagggaaactaaagaaaatgttattgtggatcccacagtactatattacactgttttttttgtttgttttgttagttttttttatttaaagcaaacctcaaacattattgggtatcaattaccacctggttgtattgaaatagtaacttatcaatgccatgtaaaaattaattccattttcgaagccacctggcagacaggtttagctgtttcatcagcagcctaatatatactgttaaatttgttaaggatttcactttgaaggatacatgcaaaacatatagttactattttcatgagtcctgcttctagctccattgtggaatacagaaaattaaatatacctgttaagttcgtatctaaacctaagacattaccaaggtttgtacaaattctactacctgacatttattccaagaagatctggaaagttaaataaatttataaatttaataaca

SEQ ID NO: 1268 - DNA, 859 bp, Homo sapiens
ccgcgacgcgtccgcaccctgcggccagagcggctttgagctcggctgcgtccgcgctaggcgctttttcccagaagcaatccaggcgcgcccgctggttcttgagcgccaggaaaagcccggagctaacgaccggccgctcggccactgcacggggccccaagccgcagaaggacgacgggagggtaatgaagctgagcccaggtctcctaggaaggagagagtgcgccggagcagcgtgggaaagaagggaagagtgtcgttaagtttacggccaacggtggattatccgggccgctgcgcgtctgggggctgcggaatgcgcgaggagaacaagggcatgcccagtgggggcggcagcgatgagggtctggccagcgccgcggcgcggggactagtggagaaggtgcgacagctcctggaagccggcgcggatcccaacggagtcaaccgtttcgggaggcgcgcgatccaggtagctggggccccagggcctcgccggcagggggcgcgcgaacgcggggcgcggcctcggcggatcggggctggaacctagatcgccgatgtagatttgtacaggagtctccgttggccggaggtcatgatgatgggcagcgcccgcgtggcggagctgctgctgctccacggcgcggagcccaactgcgcagaccctgccactctcacccgaccggtgcatgatgctgcccgggagggcttcctggacacgctggtggtgctgcaccgggccggggcgcggctggacgtgcgcgatgcctggggtcgtctgcccgtggacttggccgaggagcggggccaccgcgacgttgcagggtacctgcgcacagccacgggggactga

SEQ ID NO: 1269 - DNA, 237 bp, Homo sapiens
atgcgcgaggagaacaagggcatgcccagtgggggcggcagcgatgagggtctggccagcgccgcggcgcggggactagtggagaaggtgcgacagctcctggaagccggcgcggatcccaacggagtcaaccgtttcgggaggcgcgcgatccaggtagctggggccccagggcctcgccggcagggggcgcgcgaacgcggggcgcggcctcggcggatcggggctggaacctag

SEQ ID NO: 1270 - DNA, 2904 bp, Homo sapiens
aacacagaagtaaccagactgccatggtagacatgggagagacgaggaagctgagaaaggactatttcgcagtttccagtccttgattaattaaggcttcagagttcgttcttacatatgccatgtcttaagttttcataaaattcagtctacacaagacttgctttttgtgagcactgtgcttagtggcagtccggatttttccctccacccccgcggccacccctgcccaccgcgccgtcgggcatggatctggcaggtgcgaggccgaggccagggctcagcgaaggacgccgagtttacagagcgcgcgcgcctagaggaggcagcagcagccgcagcctggccgcccgaactttgcgagcctggcgggggagcacagaggcgggccgacctgccccgctagcgctgaggaacgactccctttatgccagctcgctgtccgccttcccgcagcgtacgctgcggagcctcaaagaccctgcggccctccacaaccgtcttaaataacaaacccctgtcctcgcccccgtaggaattggggcagctgggggttcgcgtcacagactcaagcccgccagcagaagggcaggccggacttcgcggggccgaaccccgctccagctggggacaggccgcctagccggcaggagggagccggcgcgagagacttgacgggaggaggtggagagcgggaggcgggaatgagggcgcgggaccgggcgggcggagcgtgcgagactgcgagcgcgagcgccagcagggcggagggcggggcgtgggcggcgcccggccttcccgctcccgcggcgctgcaactctgccgagcctccttaaaactctgccgttaaaatgggggcgggtttttcaactcaaaaagcgctcaatttttttcttttcaaaaaaagctgatgaggtcggaaaaaagggagaagaaaccggcaccctctctgagaggcaacagaagcagcaattgtttcagcgaaaaaagcagcaagggagggagtgaaggaaaaaagcaaaaaagggggcgacacgcaagtgcctgtaggggtgaaaggagcagggaccggcgatctagggggggatcagctacaaaagaaactgtcactgggagcggtgcggccaaggaggaagcagtgctgccaggctctgctccagggcacagctggctggcggctgccctgtccgcagcaaaggggcacaggccggggaccgcgagaggtggcaaagtggcaccgggcgccgaggctgctgagcgctcgccgagacggcgaccggactggctgccccggaactgcggcgactctccctactcagaacttggcctacgtttcccaggactctccccatctccagaggcccccacaaaaccgggaaaggaaggaaaggacagcggcggcagcagctcaatgagtgcctacagcagaaagcctgaacgagctcggtcgtaggcgggaagttcccgggggggctgcccagtgcagccgcaatgctgccgcgagctgccccagcagtccgggctccgtagacgctttccgcatcactctccttcctcgggctgccgggagtcccgggacctggcggggccggcatgacgggcttctcgggggcccgccgcacgcccggcagcctccggagacgcgcgccgagcccggctcccacggcctctgaggctcggcggggctgcggctgcctggcgggcgggctccggagctttcctgagcggcattagcccacggcttggcccggacgcgaccaaaggctcttctggagaagcccagagcactgggcaatcgttacgacctgtaacttgagggccaccgaactgctactcccgttcgcctttggcgatcatcttttaaccctccggagcacgtcagcatccagccaccgcggcgctctcccagcagcggaggacccaggactatcccttcggcgagacggatggaaaccgagccccctggaggacctgcccctgcagttctgcctcacacggctcaagtcaccaccgtgaacaagggaccctaaagaatggccgagccttgggggaacgagttggcgtccgcagctgccaggggggacctagagcaacttactagtttgttgcaaaataatgtaaacgtcaatgcacaaaatggatttggaaggactgcgctgcaggttatgaaacttggaaatcccgagattgccaggagactgctacttagaggtgctaatcccgatttgaaagaccgaactggtttcgctgtcattcatgatgcggccagagcaggtttcctggacactttacagactttgctggagtttcaagctgatgttaacatcgaggataatgaagggaacctgcccttgcacttggctgccaaagaaggccacctccgggtggtggagttcctggtgaagcacacggccagcaatgtggggcatcggaaccataagggggacaccgcctgtgatttggccaggctctatgggaggaatgaggttgttagcctgatgcaggcaaacggggctgggggagccacaaatcttcaataaacgtggggagggctcccccacgttgcctctactttatcaattaactgagtagctctcctgacttttaatgtcatttgttaaaatacagttctgtcatatgttaagcagctaaattttctgaaactgcataagtgaaaatcttacaacaggcttatgaatatatttaagcaacatctttttaacctgcaaaatctgttctaacatgtaattgcagataactttgactttcttctgaatattttatctttccttggcttttcccttgcttccccttttgccaatctcaacacccaagttgaagactttgtttttaaaatggtttgtcctgatgcttttgtctaattaaaacactttcaaaacagg

SEQ ID NO: 1271 - DNA, 1220 bp, Homo sapiens
ggtattttctgccccgatctatagtcccttgagtctccacacacactcctcacagagatctgtagcgtaggtacgtgacagctctgcctacatctgacgtccggagtcattaaccaggaatgtatgtgtgtctgtgtgtctctctgtggagtcgtcagaattcttcataggggttaagctaaaaaagcgaggcgaggagcccctctccaatggctcagttttgctgaataatcacgtgtgaatcgaggggcgggcttttggcaggcagatcttactagtatttactaccaagctctactccagattaaccatcccagtccttctgtcagtctccgatgccatcatgcagcctggttaggagcaaaggaaaggggaaaaagaaaaacgactaattcatcttttcctgatcgtcaggaccctaaagaatggccgagccttgggggaacgagttggcgtccgcagctgccaggggggacctagagcaacttactagtttgttgcaaaataatgtaaacgtcaatgcacaaaatggatttggaaggactgcgctgcaggttatgaaacttggaaatcccgagattgccaggagactgctacttagaggtgctaatcccgatttgaaagaccgaactggtttcgctgtcattcatgatgcggccagagcaggtttcctggacactttacagactttgctggagtttcaagctgatgttaacatcgaggataatgaagggaacctgcccttgcacttggctgccaaagaaggccacctccgggtggtggagttcctggtgaagcacacggccagcaatgtggggcatcggaaccataagggggacaccgcctgtgatttggccaggctctatgggaggaatgaggttgttagcctgatgcaggcaaacggggctgggggagccacaaatcttcaataaacgtggggagggctcccccacgttgcctctactttatcaattaactgagtagctctcctgacttttaatgtcatttgttaaaatacagttctgtcatatgttaagcagctaaattttctgaaactgcataagtgaaaatcttacaacaggcttatgaatatatttaagcaacatctttttaacctgcaaaatctgttctaacatgtaattgcagataactttgactttcttctgaatattttatctttccttggcttttcccttgcttccccttttgccaatctcaac

SEQ ID NO: 1272 - DNA, 2086 bp, Homo sapiens
ctctgccgagcctccttaaaactctgccgttaaaatgggggcgggtttttcaactcaaaaagcgctcaatttttttcttttcaaaaaaagctgatgaggtcggaaaaaagggagaagaaaccggcaccctctctgagaggcaacagaagcagcaattgtttcagcgaaaaaagcagcaagggagggagtgaaggaaaaaagcaaaaaagggggcgacacgcaagtgcctgtaggggtgaaaggagcagggaccggcgatctagggggggatcagctacaaaagaaactgtcactgggagcggtgcggccaaggaggaagcagtgctgccaggctctgctccagggcacagctggctggcggctgccctgtccgcagcaaaggggcacaggccggggaccgcgagaggtggcaaagtggcaccgggcgccgaggctgctgagcgctcgccgagacggcgaccggactggctgccccggaactgcggcgactctccctactcagaacttggcctacgtttcccaggactctccccatctccagaggcccccacaaaaccgggaaaggaaggaaaggacagcggcggcagcagctcaatgagtgcctacagcagaaagcctgaacgagctcggtcgtaggcgggaagttcccgggggggctgcccagtgcagccgcaatgctgccgcgagctgccccagcagtccgggctccgtagacgctttccgcatcactctccttcctcgggctgccgggagtcccgggacctggcggggccggcatgacgggcttctcgggggcccgccgcacgcccggcagcctccggagacgcgcgccgagcccggctcccacggcctctgaggctcggcggggctgcggctgcctggcgggcgggctccggagctttcctgagcggcattagcccacggcttggcccggacgcgaccaaaggctcttctggagaagcccagagcactgggcaatcgttacgacctgtaacttgagggccaccgaactgctactcccgttcgcctttggcgatcatcttttaaccctccggagcacgtcagcatccagccaccgcggcgctctcccagcagcggaggacccaggactatcccttcggcgagacggatggaaaccgagccccctggaggacctgcccctgcagttctgcctcacacggctcaagtcaccaccgtgaacaagggaccctaaagaatggccgagccttgggggaacgagttggcgtccgcagctgccaggggggacctagagcaacttactagtttgttgcaaaataatgtaaacgtcaatgcacaaaatggatttggaaggactgcgctgcaggttatgaaacttggaaatcccgagattgccaggagactgctacttagaggtgctaatcccgatttgaaagaccgaactggtttcgctgtcattcatgatgcggccagagcaggtttcctggacactttacagactttgctggagtttcaagctgatgttaacatcgaggataatgaagggaacctgcccttgcacttggctgccaaagaaggccacctccgggtggtggagttcctggtgaagcacacggccagcaatgtggggcatcggaaccataagggggacaccgcctgtgatttggccaggctctatgggaggaatgaggttgttagcctgatgcaggcaaacggggctgggggagccacaaatcttcaataaacgtggggagggctcccccacgttgcctctactttatcaattaactgagtagctctcctgacttttaatgtcatttgttaaaatacagttctgtcatatgttaagcagctaaattttctgaaactgcataagtgaaaatcttacaacaggcttatgaatatatttaagcaacatctttttaacctgcaaaatctgttctaacatgtaattgcagataactttgactttcttctgaatattttatctttccttggcttttcccttgcttccccttttgccaatctcaacacccaagttgaagactttgtttttaaaatggtttgtcctgatgcttttgtctaattaaaacactttcaaaacagg

SEQ ID NO: 1273 - DNA, 1144 bp, Homo sapiens
agagcagaccccgcccggcgaggaggagggagggccgccagtgtcgacatgctgctggaggaggttcgcgccggcgaccggctgagtggggcggcggcccggggcgacgtgcaggaggtgcgccgccttctgcaccgggagctggtgcatcccgacgccctcaaccgcttcggcaagacggcgctgcaggtcatgatgtttggcagcaccgccatcgccctggagctgctgaagcaaggtgccagccccaatgtccaggacacctccggtaccagtccagtccatgacgcagcccgcactggattcctggacaccctgaaggtcctagtggagcacggggctgatgtcaacgtgcctgatggcaccggggcacttccaatccatctggcagttcaagagggtcacactgctgtggtcagctttctggcagctgaatctgatctccatcgcagggacgccaggggtctcacacccttggagctggcactgcagagaggggctcaggacctcgtggacatcctgcagggccacatggtggccccgctgtgatctggggtcaccctctccagcaagagaaccccgtggggttatgtatcagaagagaggggaagaaacactttctcttcttgtttctcctgcccactgctgcagtaggggaggagcacagtttgtggcttataggtgttggttttgggggtgtgagtgtttgggggacgtttctcatttgtttttctcactccttttggtgtgttggacagagaagggctcctgcaggccacagccacctaaacggttcagtttcttctgcgcctcaggctgctggggcctcagacgagacccaagggcagagcatttaagagtgaagtcatgacctccagggagcctagaagctggtggccttggccggctgtgctcagagacctgaagtgtgcacgttgcttcaggcatggggggtggggggagcgtcccaaatcaataagaaggtagaatgagttatgagttattcatattctgttggaagcttgttttccagtctcttgtacagcgttttaaaagaaatggattctatttattatgctttattggaaaaaatgttgtaataatttaatgtttttacccattaaattaagacttgtgcatgatc

SEQ ID NO: 1274 - DNA, 1398 bp, Homo sapiens
ggagggagggtgagttagggggagacccggcccccaaggggcgggcgccgggcagggccccgcgggcggccgagggttgggcccggctcccagcccctcgccgtcctccggctgacagggggaggagcccgccgggagggccggggtctcgggctggggagccgggacgggagagcagcgcagccgggtgcaccgcggccgcgccccgggagggctgttcgggccagcgcccgccggctgctccgcgctgacagcgccgggctggggcggggcggggggctttgcaggccgccagtgtcgacatgctgctggaggaggttcgcgccggcgaccggctgagtggggcggcggcccggggcgacgtgcaggaggtgcgccgccttctgcaccgggagctggtgcatcccgacgccctcaaccgcttcggcaagacggcgctgcaggtcatgatgtttggcagcaccgccatcgccctggagctgctgaagcaaggtgccagccccaatgtccaggacacctccggtaccagtccagtccatgacgcagcccgcactggattcctggacaccctgaaggtcctagtggagcacggggctgatgtcaacgtgcctgatggcaccggggcacttccaatccatctggcagttcaagagggtcacactgctgtggtcagctttctggcagctgaatctgatctccatcgcagggacgccaggggtctcacacccttggagctggcactgcagagaggggctcaggacctcgtggacatcctgcagggccacatggtggccccgctgtgatctggggtcaccctctccagcaagagaaccccgtggggttatgtatcagaagagaggggaagaaacactttctcttcttgtttctcctgcccactgctgcagtaggggaggagcacagtttgtggcttataggtgttggttttgggggtgtgagtgtttgggggacgtttctcatttgtttttctcactccttttggtgtgttggacagagaagggctcctgcaggccacagccacctaaacggttcagtttcttctgcgcctcaggctgctggggcctcagacgagacccaagggcagagcatttaagagtgaagtcatgacctccagggagcctagaagctggtggccttggccggctgtgctcagagacctgaagtgtgcacgttgcttcaggcatggggggtggggggagcgtcccaaatcaataagaaggtagaatgagttatgagttattcatattctgttggaagcttgttttccagtctcttgtacagcgttttaaaagaaatggattctatttattatgctttattggaaaaaatgttgtaataatttaatgtttttacccattaaattaagacttgtgcatgatc

SEQ ID NO: 1275 - DNA, 893 bp, Homo sapiens
acagaaggacgaaccagtgagctaagctgcggggcgcgggctcggccggggcaccggtgagtcgccggcgctgcagagggaggcggcactggtctcgacgtggggcggccagcgatgaagccgcccagttcaatacaaacaagtgagtttgactcatcagatgaagagcctattgaagatgaacagactccaattcatatatcatggctatctttgtcacgagtgaattgttctcagtttctcggtttatgtgctcttccaggttgtaaatttaaagatgttagaagaaatgtccaaaaagatacagaagaactaaagagctgtggtatacaagacatatttgttttctgcaccagaggggaactgtcaaaatatagagtcccaaaccttctggatctctaccagcaatgtggaattatcacccatcatcatccaatcgcagatggagggactcctgacatagccagctgctgtgaaataatggaagagcttacaacctgccttaaaaattaccgaaaaaccttaatacactgctatggaggacttgggagatcttgtcttgtagctgcttgtctcctactatacctgtctgacacaatatcaccagagcaagccatagacagcctgcgagacctaagaggatccggggcaatacagaccatcaagcaatacaattatcttcatgagtttcgggacaaattagctgcacatctatcatcaagagattcacaatcaagatctgtatcaagataaaggaattcaaatagcatatatatgaccatgtctgaaatgtcagttctctagcataatttgtattgaaatgaaaccaccagtgttatcaacttgaatgtaaatgtacatgtgcagatattcctaaagttttattgacaaaa

SEQ ID NO: 1276 - DNA, 637 bp, Homo sapiens
atgaatccctgttgtaaatttaaagatgttagaagaaatgtccaaaaagatacagaagaactaaagagctgtggtatacaagacatatttgttttctgcaccagaggggaactgtcaaaatatagagtcccaaaccttctggatctctaccagcaatgtggaattatcacccatcatcatccaatcgcagatggagggactcctgacatagccagctgctgtgaaataatggaagagcttacaacctgccttaaaaattaccgaaaaaccttaatacactgctatggaggacttgggagatcttgtcttgtagctgcttgtctcctactatacctgtctgacacaatatcaccagagcaagccatagacagcctgcgagacctaagaggatccggggcaatacagaccatcaagcaatacaattatcttcatgagtttcgggacaaattagctgcacatctatcatcaagagattcacaatcaagatctgtatcaagataaaggaattcaaatagcatatatatgaccatgtctgaaatgtcagttctctagcataatttgtattgaaatgaaaccaccagtgttatcaacttgaatgtaaatgtacatgtgcagatattcctaaagttttattgac

SEQ ID NO: 1277 - DNA, 238 bp, Homo sapiens
cggcactggtctcgacgtggggcggccagcgatgaagccgcccagttcaatacaaacaagtgagtttgactcatcagatgaagagcctattgaagatgaacagactccaattcatatatcatggctatctttgtcacgagtgaattgttctcagtttctcggtttatgtgctcttccaggttgtaaatttaaagatgttagaagaaatgtccaaaaagaaaaaaaaaaaaaaaaaaag

SEQ ID NO: 1278 - DNA, 791 bp, Homo sapiens
cggcactggtctcgacgtggggcggccagcgatgaagccgcccagttcaatacaaacaagtgagtttgactcatcagatgaagagcctattgaagatgaacagactccaattcatatatcatggctatctttgtcacgagtgaattgttctcagtttctcggtttatgtgctcttccaggttgtaaatttaaagatgttagaagaaatgtccaaaaagatacagaagaactaaagagctgtggtatacaagacatatttgttttctgcaccagaggggaactgtcaaaatatagagtcccaaaccttctggatctctaccagcaatgtggaattatcacccatcatcatccaatcgcagatggagggactcctgacatagccagctgctgtgaaataatggaagagcttacaacctgccttaaaaatttgttctgctatggaggacttgggagatcttgtcttgtagctgcttgtctcctactatacctgtctgacacaatatcaccagagcaagccatagacagcctgcgagacctaagaggatccggggcaatacagaccatcaagcaatacaattatcttcatgagtttcgggacaaattagctgcacatctatcatcaagagattcacaatcaagatctgtatcaagataaaggaattcaaatagcatatatatgaccatgtctgaaatgtcagttctctagcataatttgtattgaaatgaaaccaccagtgttatcaacttgaatgtaaatgtacatgtgcagatattcctaaagttttattgac

SEQ ID NO: 1279 - DNA, 727 bp, Homo sapiens
ctcggccggggcaccggtgagtcgccggcgctgcagagggaggcggcactggtctcgacgtggggcggccagcgatgaagccgcccagttcaatacaaacaagttgtaaatttaaagatgttagaagaaatgtccaaaaagatacagaagaactaaagagctgtggtatacaagacatatttgttttctgcaccagaggggaactgtcaaaatatagagtcccaaaccttctggatctctaccagcaatgtggaattatcacccatcatcatccaatcgcagatggagggactcctgacatagccagctgctgtgaaataatggaagagcttacaacctgccttaaaaattaccgaaaaaccttaatacactgctatggaggacttgggagatcttgtcttgtagctgcttgtctcctactatacctgtctgacacaatatcaccagagcaagccatagacagcctgcgagacctaagaggatccggggcaatacagaccatcaagcaatacaattatcttcatgagtttcgggacaaattagctgcacatctatcatcaagagattcacaatcaagatctgtatcaagataaaggaattcaaatagcatatatatgaccatgtctgaaatgtcagttctctagcataatttgtattgaaatgaaaccaccagtgttatcaacttgaatgtaaatgtacatgtgcagatattcctaaagttttattg

SEQ ID NO: 1280 - DNA, 8713 bp, Homo sapiens
gtgcggttcggaggcggggcaggtgggggcgggcccaggtagcaggtttggctgcgcgggggccgcgcgtcggagtttccccctttctagggtgaggatggttctacacagccacccggagttccttagttgaaaggtgcgccctgctgtgacagaatgtggtaattgtaatctttaacattttcatgtaaaacatatttcctgatcatctttccattgtcttcatggaaaattgataaatatttgtgccttccaactctcgtcttggttgaatgacttcatcttaatacaacatggacaccacgttgctgaaaacatgctttgggactgccactgaatttatcttttgcggttttatgacaaagttattagtagtttcccttttttgaattagtattttgaagttaatatcacaatgagttcaggcttatggagccaagaaaaagtcacttcaccctactgggaagagcggattttttacttgcttcttcaagaatgcagcgttacagacaaacaaacacaaaagctccttaaagtaccgaagggaagtataggacagtatattcaagatcgttctgtggggcattcaaggattccttctgcaaaaggcaagaaaaatcagattggattaaaaattctagagcaacctcatgcagttctctttgttgatgaaaaggatgttgtagagataaatgaaaagttcacagagttacttttggcaattaccaattgtgaggagaggttcagcctgtttaaaaacagaaacagactaagtaaaggcctccaaatagacgtgggctgtcctgtgaaagtacagctgagatctggggaagaaaaatttcctggagttgtacgcttcagaggacccctgttagcagagaggacagtctccggaatattctttggagttgaattgctggaagaaggtcgtggtcaaggtttcactgacggggtgtaccaagggaaacagctttttcagtgtgatgaagattgtggcgtgtttgttgcattggacaagctagaactcatagaagatgatgacactgcattggaaagtgattacgcaggtcctggggacacaatgcaggtcgaacttcctcctttggaaataaactccagagtttctttgaaggttggagaaacaatagaatctggaacagttatattctgtgatgttttgccaggaaaagaaagcttaggatattttgttggtgtggacatggataaccctattggcaactgggatggaagatttgatggagtgcagctttgtagttttgcgtgtgttgaaagtacaattctattgcacatcaatgatatcatcccagctttatcagagagtgtgacgcaggaaaggaggcctcccaaacttgcctttatgtcaagaggtgttggggacaaaggttcatccagtcataataaaccaaaggctacaggatctacctcagaccctggaaatagaaacagatctgaattattttataccttaaatgggtcttctgttgactcacaaccacaatccaaatcaaaaaatacatggtacattgatgaagttgcagaagaccctgcaaaatctcttacagagatatctacagactttgaccgttcttcaccaccactccagcctcctcctgtgaactcactgaccaccgagaacagattccactctttaccattcagtctcaccaagatgcccaataccaatggaagtattggccacagtccactttctctgtcagcccagtctgtaatggaagagctaaacactgcacccgtccaagagagtccacccttggccatgcctcctgggaactcacatggtctagaagtgggctcattggctgaagttaaggagaaccctcctttctatggggtaatccgttggatcggtcagccaccaggactgaatgaagtgctcgctggactggaactggaagatgagtgtgcaggctgtacggatggaaccttcagaggcactcggtatttcacctgtgccctgaagaaggcgctgtttgtgaaactgaagagctgcaggcctgactctaggtttgcatcattgcagccggtttccaatcagattgagcgctgtaactctttagcatttggaggctacttaagtgaagtagtagaagaaaatactccaccaaaaatggaaaaagaaggcttggagataatgattgggaagaagaaaggcatccagggtcattacaattcttgttacttagactcaaccttattctgcttatttgcttttagttctgttctggacactgtgttacttagacccaaagaaaagaacgatgtagaatattatagtgaaacccaagagctactgaggacagaaattgttaatcctctgagaatatatggatatgtgtgtgccacaaaaattatgaaactgaggaaaatacttgaaaaggtggaggctgcatcaggatttacctctgaagaaaaagatcctgaggaattcttgaatattctgtttcatcatattttaagggtagaacctttgctaaaaataagatcagcaggtcaaaaggtacaagattgttacttctatcaaatttttatggaaaaaaatgagaaagttggcgttcccacaattcagcagttgttagaatggtcttttatcaacagtaacctgaaatttgcagaggcaccatcatgtctgattattcagatgcctcgatttggaaaagactttaaactatttaaaaaaatttttccttctctggaattaaatataacagatttacttgaagacactcccagacagtgccggatatgtggagggcttgcaatgtatgagtgtagagaatgctacgacgatccggacatctcagctggaaaaatcaagcagttttgtaaaacctgcaacactcaagtccaccttcatccgaagaggctgaatcataaatataacccagtgtcacttcccaaagacttacccgactgggactggagacacggctgcatcccttgccagaatatggagttatttgctgttctctgcatagaaacaagccactatgttgcttttgtgaagtatgggaaggacgattctgcctggctcttctttgacagcatggccgatcgggatggtggtcagaatggcttcaacattcctcaagtcaccccatgcccagaagtaggagagtacttgaagatgtctctggaagacctgcattccttggactccaggagaatccaaggctgtgcacgaagactgctttgtgatgcatatatgtgcatgtaccagagtccaacaatgagtttgtacaaataactggggtcatcgggaaaggcaaagaaactgaaggcagagtcctaacgttgcatcttattcgagctggcagttctgttcacgtccattgccggcaatggatgtctttgtggtgatgatccttcagaaaaggatgcctctgtttaaaaacaaattgcttttgtgtccctgaagtatttaataagaagcattttgcactctagaaagtatgtttgtgttggttttttaagaagtctaaatgaagttattaatacctgaagctttaagttaagtgcattgatcatatgatatttttggaagcatacaattttaattgtggaagtttaaagcctcttttagtccattgagaatgtaaataaatgtgtcttctttatggaccaaggatatgaaatcatttttcttttgtagctaacggttgccttgaggaagaaataatttggttttattaagagtctactctcaatccagttattagagatgtactgagtttgatttgttaatcctttctatatactgctgatcttgcatgtctacaatctgctcagtttttctgtgtttctgcaatagtggtcagaaaaatacttaaattcccttaatggtgttgttttctatttgttctggttttgagataaatgagtgattctgtccccaaatgtccatttttgaagtgattttcctggaggattagggtatttagcagttgaagctcttcattcatagtagttactgtcagctaacaggttttttaaggcttttaactattaatattttatggaatggggcaaagtaaattgatgaaagaattggagtgataatagtcctttacaaacatacagtccataagaaaatgaatttggcatatagaattattacaatttcctgggagagatggatatttaaacctctattattttagacaagactgtctagaacttaagtttgatctgtcagccagtactcccattaaattcagtgtagtttcacttgatagaatcagatatgttatcgaaatgttagcagcagcttcatcctccttctgattaaagtaagtagaaatgggatgttttgtttaataacagccatagtgtgtgtttagaccacagcggatgttgtagaccaggaccatagatgatacatgtcagtgctgtggaatgtgcattctctgagtgttgttttgtggtatcattgtctttcctgaatgactttctaactgtgcagaaaggcagaaaagtcatcatatgtatatgtcatatgactttataaaatatttaatgtgacaaaaagtggaaagaatctttacaaaccctgcaattacttttttaaaggcacttttactctttggttttatcattccattttgctaatatttactagctttataaattacagtaaggtacaaaaactcatcttgtaatattttcatttttgaagtgaaaaagtacatatattttgcacaaggttttatactgctaagtgcttggttggggtggtgagatgatgattagatcaggggtgaggctgagagactctgggtttagggctagccctgcctccatctcccttgggtaaaatgaagggtgtggggtaaaagatgcataaggccttttctagctctgacagcctagaagtccaatcaccctgtaataaatatgtgttgaatgaagaaatgggtgaatgagcttgtcaatgtgattttaaaaaattgactacctggaggaatgattaggaatctaaatgaagccagccctcggtatctgcaggtttctcatccatggattcaaccaactgcaaatggaaaatacgattttttttaaaaaaaggatggttacatccgtattgaacatgtacagacttttttcttgtcattattctctgaacaatacaagaactctttatgtagcatttacatttattaggtattataagtaatctagagattatttaattaaaatatacaggaggatgtgtgtcagttatatgcaaattctgtaccattttgtatcagggaattgagcatcttcagatgttggtatctgcagggatcctggaaccaaacccctgcagatactaagggctgacgatctaggtaagactggatttaacagttggaaaaaaaaaaaaaaaaggagagagaagacagttcctttcctgtagaaattaaaacaaaatacaaattgaggaagctctgctacccaggctgtcatggtagagaacttgaagaagacctgtttggatggacacctggtttcaaaagtcaggtgtggagactgttaaatgggagggcctcatccataaatgatttctggcaacgtcttcttcaggtggagcttgacgtctttttaatgttacttggggagggagtgctcattaagggatgccagggccagctctggtggttcctggggaggctgcgtccttccctgcttctgcatgtcatgaggcagcaggaaggtttcccctgcacctgtctgtcctggctccctctgggtagccccctactgttctgtgcttcagcacagcctggtttgtcaagaggcacatagttggggctgggctgcatggcacaggggcttatgtgcctgctggttatttaattttcagccttaagttttctttaatattttcctgttggctatttaaaggttttggttatcttttattccttatctacaatcaagatgacaatgtaattgaattatcttatttataacacggttcgtgattcatgattcatgattacaagtagaaaatatgtcatgttcctcacctccaaataaatatgtgtgtgtctgtgtgtgtgtatatatgtatgtggcggagagggagagagtggggaaggagagcagtgttatcatacatagagaggctaaatgtgtcccatccctcactgtcagctttataaaggagtttgactccatccacagaagaatgttttataagactaggaaaacacgttgaaaactaggataaacagcaacaaaaatcaactaaatatgttgttactgttgctaaggattttctccttagaataatttaggatttttaaaaatttctgtttgccaaatgctgtagataaatggccagattcttcctatccctaggattcctttattattttttttcacagattttgagaacaagggggagagatagtatggaagattaagattccattaatcttatagaactgtgttgtcacccaaattcctgcttgtttgaacatggcatcttcatagattcaggattcactaccctctatagctggatcttgaaaattatctggccagataattttgcatctgcttggatgattgtagactgagatgtgagtggaggataaagtattagacttttgctgagtaactgccaaccaagaagtatttatcggacacttactaggtgcctaggattgtatcagagggaatatgaaatgtgtccctgccctacctagttttaacgacagaatatctattaaaggctacttagctgaagggtaagggtgacaggtctaggggaagctttgggaggtggtgtgctgtgacagaaaaagtggcagagtagggacgagagacctgcattctagccctgtttctgtcacttgctctgtacacttagacaacagcttgacctcttgagctttagtttcctcctctgcataatgagagggttagactactgaattgtatgggaaaaaaatacaaattcctgggtcctaggccatgcctgctgaatccgactgttcaggaagaggcctaggaaatctgtgagggaatccccaggggaatctcgtgaccagccaggtgtgaaatctgctaactggaagatctcaaagcttccttcactttttgtgattttgtggtcatgtaacgttactgtattattctacgtaaatgtgggtacttggatgtttatcatactgtttctctgtgtttacatactaatttgtgtaagaaatgcattttagtctgtgtacctcaacctgctgtttgtttcctagaggtgttagtagtctttaaatacaagtaagacttaagaggatatttgatgttatttacctggatattttcttccccttttatttatttagaggaaattgagattctaggagccaaaaaaatgaaaacaaaattctaaggcaaagttaaagaaaaaaattacattatttcttaccatttgctactttataatgaaaatttaaaaattatatgggaagatttttctctgggataacaaatccttgtcataaagtaagaggtctttttaaagtaggtaggctataaggcctgtaatttaaaataatactcctttctctagggtttggtgcaattctccattaatgaagataacatttgaattccccaaagcaggtgaggagtcggggaggagaaagcgatgttaaaatgaaaactcactgcaaaagaggaggcagaggaagaaggaatgtaaaccccttaaagcagatgtgtgtggggccttatgaagaccaggattctgcgggtgtcaggggattgcccctcttgacagagactagggttttagactgaggcttcctgcagggtgttcgcattgcccttctccgttccccttcagacctttctggggagaagaggtgggaggaggggagaaagactgttcatcttattctgaatcctggagcagctgaaggttttctcttgagtcaggatgcagtggtaatgcattaaccagcaagtgtggccaaggataatgaaaaagtgggaaaggaaggtcctcctcctccctgattgtagcatccagcagtctctgtagccaggttactcaagaaccacatttgatttcctggccctttgccttggcagtgatggcatttttatttcactgtgttttaaagtcttcatttatttttataacatgggttagggagaagggccacaaatggagggattgtcctttcaagcaccacagcttcagataaaattagtactttcaaatattgtccactttaacttaaaaaattctagagggattatattggagactcaactgcccttggttttagtttataaaatggcctagtactgtggaattttaattttagaaagtcttagcatcagatcataaacattcattaaaagaactcacatcccatctgaaacttcccaggggagttgggattcttagtagattggtagaaaggggctcattttctactgcatttcccatttttggtatcttgttcagcatgttttatttttatttcttgtctgcagaacatcctatatttatgagaacattctttaagaagaccaccacatagaataccccttcctatcagctcgctctgatttagccttaattttgttaaattttttagagatgaatgaagtgctgctgtggaaagaaatgtacatatactatttctgtatcattaaaattacatttttatggttc

SEQ ID NO: 1281 - DNA, 8591 bp, Homo sapiens
gtcggaggtaaatactagggcggtgggtgtggggagccggggccggcccgggacgcgggctggggagccggggcgaggggcgacgccccgccgcccgagtttccccctttctagggtgaggatggttctacacagccacccggagttccttagttgaaaggtgcgccctgctgtgacagcatggacaccacgttgctgaaaacatgctttgggactgccactgaatttatcttttgcggttttatgacaaagttattagtagtttcccttttttgaattagtattttgaagttaatatcacaatgagttcaggcttatggagccaagaaaaagtcacttcaccctactgggaagagcggattttttacttgcttcttcaagaatgcagcgttacagacaaacaaacacaaaagctccttaaagtaccgaagggaagtataggacagtatattcaagatcgttctgtggggcattcaaggattccttctgcaaaaggcaagaaaaatcagattggattaaaaattctagagcaacctcatgcagttctctttgttgatgaaaaggatgttgtagagataaatgaaaagttcacagagttacttttggcaattaccaattgtgaggagaggttcagcctgtttaaaaacagaaacagactaagtaaaggcctccaaatagacgtgggctgtcctgtgaaagtacagctgagatctggggaagaaaaatttcctggagttgtacgcttcagaggacccctgttagcagagaggacagtctccggaatattctttggagttgaattgctggaagaaggtcgtggtcaaggtttcactgacggggtgtaccaagggaaacagctttttcagtgtgatgaagattgtggcgtgtttgttgcattggacaagctagaactcatagaagatgatgacactgcattggaaagtgattacgcaggtcctggggacacaatgcaggtcgaacttcctcctttggaaataaactccagagtttctttgaaggttggagaaacaatagaatctggaacagttatattctgtgatgttttgccaggaaaagaaagcttaggatattttgttggtgtggacatggataaccctattggcaactgggatggaagatttgatggagtgcagctttgtagttttgcgtgtgttgaaagtacaattctattgcacatcaatgatatcatcccagagagtgtgacgcaggaaaggaggcctcccaaacttgcctttatgtcaagaggtgttggggacaaaggttcatccagtcataataaaccaaaggctacaggatctacctcagaccctggaaatagaaacagatctgaattattttataccttaaatgggtcttctgttgactcacaaccacaatccaaatcaaaaaatacatggtacattgatgaagttgcagaagaccctgcaaaatctcttacagagatatctacagactttgaccgttcttcaccaccactccagcctcctcctgtgaactcactgaccaccgagaacagattccactctttaccattcagtctcaccaagatgcccaataccaatggaagtattggccacagtccactttctctgtcagcccagtctgtaatggaagagctaaacactgcacccgtccaagagagtccacccttggccatgcctcctgggaactcacatggtctagaagtgggctcattggctgaagttaaggagaaccctcctttctatggggtaatccgttggatcggtcagccaccaggactgaatgaagtgctcgctggactggaactggaagatgagtgtgcaggctgtacggatggaaccttcagaggcactcggtatttcacctgtgccctgaagaaggcgctgtttgtgaaactgaagagctgcaggcctgactctaggtttgcatcattgcagccggtttccaatcagattgagcgctgtaactctttagcatttggaggctacttaagtgaagtagtagaagaaaatactccaccaaaaatggaaaaagaaggcttggagataatgattgggaagaagaaaggcatccagggtcattacaattcttgttacttagactcaaccttattctgcttatttgcttttagttctgttctggacactgtgttacttagacccaaagaaaagaacgatgtagaatattatagtgaaacccaagagctactgaggacagaaattgttaatcctctgagaatatatggatatgtgtgtgccacaaaaattatgaaactgaggaaaatacttgaaaaggtggaggctgcatcaggatttacctctgaagaaaaagatcctgaggaattcttgaatattctgtttcatcatattttaagggtagaacctttgctaaaaataagatcagcaggtcaaaaggtacaagattgttacttctatcaaatttttatggaaaaaaatgagaaagttggcgttcccacaattcagcagttgttagaatggtcttttatcaacagtaacctgaaatttgcagaggcaccatcatgtctgattattcagatgcctcgatttggaaaagactttaaactatttaaaaaaatttttccttctctggaattaaatataacagatttacttgaagacactcccagacagtgccggatatgtggagggcttgcaatgtatgagtgtagagaatgctacgacgatccggacatctcagctggaaaaatcaagcagttttgtaaaacctgcaacactcaagtccaccttcatccgaagaggctgaatcataaatataacccagtgtcacttcccaaagacttacccgactgggactggagacacggctgcatcccttgccagaatatggagttatttgctgttctctgcatagaaacaagccactatgttgcttttgtgaagtatgggaaggacgattctgcctggctcttctttgacagcatggccgatcgggatggtggtcagaatggcttcaacattcctcaagtcaccccatgcccagaagtaggagagtacttgaagatgtctctggaagacctgcattccttggactccaggagaatccaaggctgtgcacgaagactgctttgtgatgcatatatgtgcatgtaccagagtccaacaatgagtttgtacaaataactggggtcatcgggaaaggcaaagaaactgaaggcagagtcctaacgttgcatcttattcgagctggcagttctgttcacgtccattgccggcaatggatgtctttgtggtgatgatccttcagaaaaggatgcctctgtttaaaaacaaattgcttttgtgtccctgaagtatttaataagaagcattttgcactctagaaagtatgtttgtgttggttttttaagaagtctaaatgaagttattaatacctgaagctttaagttaagtgcattgatcatatgatatttttggaagcatacaattttaattgtggaagtttaaagcctcttttagtccattgagaatgtaaataaatgtgtcttctttatggaccaaggatatgaaatcatttttcttttgtagctaacggttgccttgaggaagaaataatttggttttattaagagtctactctcaatccagttattagagatgtactgagtttgatttgttaatcctttctatatactgctgatcttgcatgtctacaatctgctcagtttttctgtgtttctgcaatagtggtcagaaaaatacttaaattcccttaatggtgttgttttctatttgttctggttttgagataaatgagtgattctgtccccaaatgtccatttttgaagtgattttcctggaggattagggtatttagcagttgaagctcttcattcatagtagttactgtcagctaacaggttttttaaggcttttaactattaatattttatggaatggggcaaagtaaattgatgaaagaattggagtgataatagtcctttacaaacatacagtccataagaaaatgaatttggcatatagaattattacaatttcctgggagagatggatatttaaacctctattattttagacaagactgtctagaacttaagtttgatctgtcagccagtactcccattaaattcagtgtagtttcacttgatagaatcagatatgttatcgaaatgttagcagcagcttcatcctccttctgattaaagtaagtagaaatgggatgttttgtttaataacagccatagtgtgtgtttagaccacagcggatgttgtagaccaggaccatagatgatacatgtcagtgctgtggaatgtgcattctctgagtgttgttttgtggtatcattgtctttcctgaatgactttctaactgtgcagaaaggcagaaaagtcatcatatgtatatgtcatatgactttataaaatatttaatgtgacaaaaagtggaaagaatctttacaaaccctgcaattacttttttaaaggcacttttactctttggttttatcattccattttgctaatatttactagctttataaattacagtaaggtacaaaaactcatcttgtaatattttcatttttgaagtgaaaaagtacatatattttgcacaaggttttatactgctaagtgcttggttggggtggtgagatgatgattagatcaggggtgaggctgagagactctgggtttagggctagccctgcctccatctcccttgggtaaaatgaagggtgtggggtaaaagatgcataaggccttttctagctctgacagcctagaagtccaatcaccctgtaataaatatgtgttgaatgaagaaatgggtgaatgagcttgtcaatgtgattttaaaaaattgactacctggaggaatgattaggaatctaaatgaagccagccctcggtatctgcaggtttctcatccatggattcaaccaactgcaaatggaaaatacgattttttttaaaaaaaggatggttacatccgtattgaacatgtacagacttttttcttgtcattattctctgaacaatacaagaactctttatgtagcatttacatttattaggtattataagtaatctagagattatttaattaaaatatacaggaggatgtgtgtcagttatatgcaaattctgtaccattttgtatcagggaattgagcatcttcagatgttggtatctgcagggatcctggaaccaaacccctgcagatactaagggctgacgatctaggtaagactggatttaacagttggaaaaaaaaaaaaaaaaggagagagaagacagttcctttcctgtagaaattaaaacaaaatacaaattgaggaagctctgctacccaggctgtcatggtagagaacttgaagaagacctgtttggatggacacctggtttcaaaagtcaggtgtggagactgttaaatgggagggcctcatccataaatgatttctggcaacgtcttcttcaggtggagcttgacgtctttttaatgttacttggggagggagtgctcattaagggatgccagggccagctctggtggttcctggggaggctgcgtccttccctgcttctgcatgtcatgaggcagcaggaaggtttcccctgcacctgtctgtcctggctccctctgggtagccccctactgttctgtgcttcagcacagcctggtttgtcaagaggcacatagttggggctgggctgcatggcacaggggcttatgtgcctgctggttatttaattttcagccttaagttttctttaatattttcctgttggctatttaaaggttttggttatcttttattccttatctacaatcaagatgacaatgtaattgaattatcttatttataacacggttcgtgattcatgattcatgattacaagtagaaaatatgtcatgttcctcacctccaaataaatatgtgtgtgtctgtgtgtgtgtatatatgtatgtggcggagagggagagagtggggaaggagagcagtgttatcatacatagagaggctaaatgtgtcccatccctcactgtcagctttataaaggagtttgactccatccacagaagaatgttttataagactaggaaaacacgttgaaaactaggataaacagcaacaaaaatcaactaaatatgttgttactgttgctaaggattttctccttagaataatttaggatttttaaaaatttctgtttgccaaatgctgtagataaatggccagattcttcctatccctaggattcctttattattttttttcacagattttgagaacaagggggagagatagtatggaagattaagattccattaatcttatagaactgtgttgtcacccaaattcctgcttgtttgaacatggcatcttcatagattcaggattcactaccctctatagctggatcttgaaaattatctggccagataattttgcatctgcttggatgattgtagactgagatgtgagtggaggataaagtattagacttttgctgagtaactgccaaccaagaagtatttatcggacacttactaggtgcctaggattgtatcagagggaatatgaaatgtgtccctgccctacctagttttaacgacagaatatctattaaaggctacttagctgaagggtaagggtgacaggtctaggggaagctttgggaggtggtgtgctgtgacagaaaaagtggcagagtagggacgagagacctgcattctagccctgtttctgtcacttgctctgtacacttagacaacagcttgacctcttgagctttagtttcctcctctgcataatgagagggttagactactgaattgtatgggaaaaaaatacaaattcctgggtcctaggccatgcctgctgaatccgactgttcaggaagaggcctaggaaatctgtgagggaatccccaggggaatctcgtgaccagccaggtgtgaaatctgctaactggaagatctcaaagcttccttcactttttgtgattttgtggtcatgtaacgttactgtattattctacgtaaatgtgggtacttggatgtttatcatactgtttctctgtgtttacatactaatttgtgtaagaaatgcattttagtctgtgtacctcaacctgctgtttgtttcctagaggtgttagtagtctttaaatacaagtaagacttaagaggatatttgatgttatttacctggatattttcttccccttttatttatttagaggaaattgagattctaggagccaaaaaaatgaaaacaaaattctaaggcaaagttaaagaaaaaaattacattatttcttaccatttgctactttataatgaaaatttaaaaattatatgggaagatttttctctgggataacaaatccttgtcataaagtaagaggtctttttaaagtaggtaggctataaggcctgtaatttaaaataatactcctttctctagggtttggtgcaattctccattaatgaagataacatttgaattccccaaagcaggtgaggagtcggggaggagaaagcgatgttaaaatgaaaactcactgcaaaagaggaggcagaggaagaaggaatgtaaaccccttaaagcagatgtgtgtggggccttatgaagaccaggattctgcgggtgtcaggggattgcccctcttgacagagactagggttttagactgaggcttcctgcagggtgttcgcattgcccttctccgttccccttcagacctttctggggagaagaggtgggaggaggggagaaagactgttcatcttattctgaatcctggagcagctgaaggttttctcttgagtcaggatgcagtggtaatgcattaaccagcaagtgtggccaaggataatgaaaaagtgggaaaggaaggtcctcctcctccctgattgtagcatccagcagtctctgtagccaggttactcaagaaccacatttgatttcctggccctttgccttggcagtgatggcatttttatttcactgtgttttaaagtcttcatttatttttataacatgggttagggagaagggccacaaatggagggattgtcctttcaagcaccacagcttcagataaaattagtactttcaaatattgtccactttaacttaaaaaattctagagggattatattggagactcaactgcccttggttttagtttataaaatggcctagtactgtggaattttaattttagaaagtcttagcatcagatcataaacattcattaaaagaactcacatcccatctgaaacttcccaggggagttgggattcttagtagattggtagaaaggggctcattttctactgcatttcccatttttggtatcttgttcagcatgttttatttttatttcttgtctgcagaacatcctatatttatgagaacattctttaagaagaccaccacatagaataccccttcctatcagctcgctctgatttagccttaattttgttaaattttttagagatgaatgaagtgctgctgtggaaagaaatgtacatatactatttctgtatcattaaaattacatttttatggttc

SEQ ID NO: 1282 - DNA, 8567 bp, Homo sapiens
gtgcggttcggaggcggggcaggtgggggcgggcccaggtagcaggtttggctgcgcgggggccgcgcgtcggagtttccccctttctagggtgaggatggttctacacagccacccggagttccttagttgaaaggtgcgccctgctgtgacagcatggacaccacgttgctgaaaacatgctttgggactgccactgaatttatcttttgcggttttatgacaaagttattagtagtttcccttttttgaattagtattttgaagttaatatcacaatgagttcaggcttatggagccaagaaaaagtcacttcaccctactgggaagagcggattttttacttgcttcttcaagaatgcagcgttacagacaaacaaacacaaaagctccttaaagtaccgaagggaagtataggacagtatattcaagatcgttctgtggggcattcaaggattccttctgcaaaaggcaagaaaaatcagattggattaaaaattctagagcaacctcatgcagttctctttgttgatgaaaaggatgttgtagagataaatgaaaagttcacagagttacttttggcaattaccaattgtgaggagaggttcagcctgtttaaaaacagaaacagactaagtaaaggcctccaaatagacgtgggctgtcctgtgaaagtacagctgagatctggggaagaaaaatttcctggagttgtacgcttcagaggacccctgttagcagagaggacagtctccggaatattctttggagttgaattgctggaagaaggtcgtggtcaaggtttcactgacggggtgtaccaagggaaacagctttttcagtgtgatgaagattgtggcgtgtttgttgcattggacaagctagaactcatagaagatgatgacactgcattggaaagtgattacgcaggtcctggggacacaatgcaggtcgaacttcctcctttggaaataaactccagagtttctttgaaggttggagaaacaatagaatctggaacagttatattctgtgatgttttgccaggaaaagaaagcttaggatattttgttggtgtggacatggataaccctattggcaactgggatggaagatttgatggagtgcagctttgtagttttgcgtgtgttgaaagtacaattctattgcacatcaatgatatcatcccagagagtgtgacgcaggaaaggaggcctcccaaacttgcctttatgtcaagaggtgttggggacaaaggttcatccagtcataataaaccaaaggctacaggatctacctcagaccctggaaatagaaacagatctgaattattttataccttaaatgggtcttctgttgactcacaaccacaatccaaatcaaaaaatacatggtacattgatgaagttgcagaagaccctgcaaaatctcttacagagatatctacagactttgaccgttcttcaccaccactccagcctcctcctgtgaactcactgaccaccgagaacagattccactctttaccattcagtctcaccaagatgcccaataccaatggaagtattggccacagtccactttctctgtcagcccagtctgtaatggaagagctaaacactgcacccgtccaagagagtccacccttggccatgcctcctgggaactcacatggtctagaagtgggctcattggctgaagttaaggagaaccctcctttctatggggtaatccgttggatcggtcagccaccaggactgaatgaagtgctcgctggactggaactggaagatgagtgtgcaggctgtacggatggaaccttcagaggcactcggtatttcacctgtgccctgaagaaggcgctgtttgtgaaactgaagagctgcaggcctgactctaggtttgcatcattgcagccggtttccaatcagattgagcgctgtaactctttagcatttggaggctacttaagtgaagtagtagaagaaaatactccaccaaaaatggaaaaagaaggcttggagataatgattgggaagaagaaaggcatccagggtcattacaattcttgttacttagactcaaccttattctgcttatttgcttttagttctgttctggacactgtgttacttagacccaaagaaaagaacgatgtagaatattatagtgaaacccaagagctactgaggacagaaattgttaatcctctgagaatatatggatatgtgtgtgccacaaaaattatgaaactgaggaaaatacttgaaaaggtggaggctgcatcaggatttacctctgaagaaaaagatcctgaggaattcttgaatattctgtttcatcatattttaagggtagaacctttgctaaaaataagatcagcaggtcaaaaggtacaagattgttacttctatcaaatttttatggaaaaaaatgagaaagttggcgttcccacaattcagcagttgttagaatggtcttttatcaacagtaacctgaaatttgcagaggcaccatcatgtctgattattcagatgcctcgatttggaaaagactttaaactatttaaaaaaatttttccttctctggaattaaatataacagatttacttgaagacactcccagacagtgccggatatgtggagggcttgcaatgtatgagtgtagagaatgctacgacgatccggacatctcagctggaaaaatcaagcagttttgtaaaacctgcaacactcaagtccaccttcatccgaagaggctgaatcataaatataacccagtgtcacttcccaaagacttacccgactgggactggagacacggctgcatcccttgccagaatatggagttatttgctgttctctgcatagaaacaagccactatgttgcttttgtgaagtatgggaaggacgattctgcctggctcttctttgacagcatggccgatcgggatggtggtcagaatggcttcaacattcctcaagtcaccccatgcccagaagtaggagagtacttgaagatgtctctggaagacctgcattccttggactccaggagaatccaaggctgtgcacgaagactgctttgtgatgcatatatgtgcatgtaccagagtccaacaatgagtttgtacaaataactggggtcatcgggaaaggcaaagaaactgaaggcagagtcctaacgttgcatcttattcgagctggcagttctgttcacgtccattgccggcaatggatgtctttgtggtgatgatccttcagaaaaggatgcctctgtttaaaaacaaattgcttttgtgtccctgaagtatttaataagaagcattttgcactctagaaagtatgtttgtgttggttttttaagaagtctaaatgaagttattaatacctgaagctttaagttaagtgcattgatcatatgatatttttggaagcatacaattttaattgtggaagtttaaagcctcttttagtccattgagaatgtaaataaatgtgtcttctttatggaccaaggatatgaaatcatttttcttttgtagctaacggttgccttgaggaagaaataatttggttttattaagagtctactctcaatccagttattagagatgtactgagtttgatttgttaatcctttctatatactgctgatcttgcatgtctacaatctgctcagtttttctgtgtttctgcaatagtggtcagaaaaatacttaaattcccttaatggtgttgttttctatttgttctggttttgagataaatgagtgattctgtccccaaatgtccatttttgaagtgattttcctggaggattagggtatttagcagttgaagctcttcattcatagtagttactgtcagctaacaggttttttaaggcttttaactattaatattttatggaatggggcaaagtaaattgatgaaagaattggagtgataatagtcctttacaaacatacagtccataagaaaatgaatttggcatatagaattattacaatttcctgggagagatggatatttaaacctctattattttagacaagactgtctagaacttaagtttgatctgtcagccagtactcccattaaattcagtgtagtttcacttgatagaatcagatatgttatcgaaatgttagcagcagcttcatcctccttctgattaaagtaagtagaaatgggatgttttgtttaataacagccatagtgtgtgtttagaccacagcggatgttgtagaccaggaccatagatgatacatgtcagtgctgtggaatgtgcattctctgagtgttgttttgtggtatcattgtctttcctgaatgactttctaactgtgcagaaaggcagaaaagtcatcatatgtatatgtcatatgactttataaaatatttaatgtgacaaaaagtggaaagaatctttacaaaccctgcaattacttttttaaaggcacttttactctttggttttatcattccattttgctaatatttactagctttataaattacagtaaggtacaaaaactcatcttgtaatattttcatttttgaagtgaaaaagtacatatattttgcacaaggttttatactgctaagtgcttggttggggtggtgagatgatgattagatcaggggtgaggctgagagactctgggtttagggctagccctgcctccatctcccttgggtaaaatgaagggtgtggggtaaaagatgcataaggccttttctagctctgacagcctagaagtccaatcaccctgtaataaatatgtgttgaatgaagaaatgggtgaatgagcttgtcaatgtgattttaaaaaattgactacctggaggaatgattaggaatctaaatgaagccagccctcggtatctgcaggtttctcatccatggattcaaccaactgcaaatggaaaatacgattttttttaaaaaaaggatggttacatccgtattgaacatgtacagacttttttcttgtcattattctctgaacaatacaagaactctttatgtagcatttacatttattaggtattataagtaatctagagattatttaattaaaatatacaggaggatgtgtgtcagttatatgcaaattctgtaccattttgtatcagggaattgagcatcttcagatgttggtatctgcagggatcctggaaccaaacccctgcagatactaagggctgacgatctaggtaagactggatttaacagttggaaaaaaaaaaaaaaaaggagagagaagacagttcctttcctgtagaaattaaaacaaaatacaaattgaggaagctctgctacccaggctgtcatggtagagaacttgaagaagacctgtttggatggacacctggtttcaaaagtcaggtgtggagactgttaaatgggagggcctcatccataaatgatttctggcaacgtcttcttcaggtggagcttgacgtctttttaatgttacttggggagggagtgctcattaagggatgccagggccagctctggtggttcctggggaggctgcgtccttccctgcttctgcatgtcatgaggcagcaggaaggtttcccctgcacctgtctgtcctggctccctctgggtagccccctactgttctgtgcttcagcacagcctggtttgtcaagaggcacatagttggggctgggctgcatggcacaggggcttatgtgcctgctggttatttaattttcagccttaagttttctttaatattttcctgttggctatttaaaggttttggttatcttttattccttatctacaatcaagatgacaatgtaattgaattatcttatttataacacggttcgtgattcatgattcatgattacaagtagaaaatatgtcatgttcctcacctccaaataaatatgtgtgtgtctgtgtgtgtgtatatatgtatgtggcggagagggagagagtggggaaggagagcagtgttatcatacatagagaggctaaatgtgtcccatccctcactgtcagctttataaaggagtttgactccatccacagaagaatgttttataagactaggaaaacacgttgaaaactaggataaacagcaacaaaaatcaactaaatatgttgttactgttgctaaggattttctccttagaataatttaggatttttaaaaatttctgtttgccaaatgctgtagataaatggccagattcttcctatccctaggattcctttattattttttttcacagattttgagaacaagggggagagatagtatggaagattaagattccattaatcttatagaactgtgttgtcacccaaattcctgcttgtttgaacatggcatcttcatagattcaggattcactaccctctatagctggatcttgaaaattatctggccagataattttgcatctgcttggatgattgtagactgagatgtgagtggaggataaagtattagacttttgctgagtaactgccaaccaagaagtatttatcggacacttactaggtgcctaggattgtatcagagggaatatgaaatgtgtccctgccctacctagttttaacgacagaatatctattaaaggctacttagctgaagggtaagggtgacaggtctaggggaagctttgggaggtggtgtgctgtgacagaaaaagtggcagagtagggacgagagacctgcattctagccctgtttctgtcacttgctctgtacacttagacaacagcttgacctcttgagctttagtttcctcctctgcataatgagagggttagactactgaattgtatgggaaaaaaatacaaattcctgggtcctaggccatgcctgctgaatccgactgttcaggaagaggcctaggaaatctgtgagggaatccccaggggaatctcgtgaccagccaggtgtgaaatctgctaactggaagatctcaaagcttccttcactttttgtgattttgtggtcatgtaacgttactgtattattctacgtaaatgtgggtacttggatgtttatcatactgtttctctgtgtttacatactaatttgtgtaagaaatgcattttagtctgtgtacctcaacctgctgtttgtttcctagaggtgttagtagtctttaaatacaagtaagacttaagaggatatttgatgttatttacctggatattttcttccccttttatttatttagaggaaattgagattctaggagccaaaaaaatgaaaacaaaattctaaggcaaagttaaagaaaaaaattacattatttcttaccatttgctactttataatgaaaatttaaaaattatatgggaagatttttctctgggataacaaatccttgtcataaagtaagaggtctttttaaagtaggtaggctataaggcctgtaatttaaaataatactcctttctctagggtttggtgcaattctccattaatgaagataacatttgaattccccaaagcaggtgaggagtcggggaggagaaagcgatgttaaaatgaaaactcactgcaaaagaggaggcagaggaagaaggaatgtaaaccccttaaagcagatgtgtgtggggccttatgaagaccaggattctgcgggtgtcaggggattgcccctcttgacagagactagggttttagactgaggcttcctgcagggtgttcgcattgcccttctccgttccccttcagacctttctggggagaagaggtgggaggaggggagaaagactgttcatcttattctgaatcctggagcagctgaaggttttctcttgagtcaggatgcagtggtaatgcattaaccagcaagtgtggccaaggataatgaaaaagtgggaaaggaaggtcctcctcctccctgattgtagcatccagcagtctctgtagccaggttactcaagaaccacatttgatttcctggccctttgccttggcagtgatggcatttttatttcactgtgttttaaagtcttcatttatttttataacatgggttagggagaagggccacaaatggagggattgtcctttcaagcaccacagcttcagataaaattagtactttcaaatattgtccactttaacttaaaaaattctagagggattatattggagactcaactgcccttggttttagtttataaaatggcctagtactgtggaattttaattttagaaagtcttagcatcagatcataaacattcattaaaagaactcacatcccatctgaaacttcccaggggagttgggattcttagtagattggtagaaaggggctcattttctactgcatttcccatttttggtatcttgttcagcatgttttatttttatttcttgtctgcagaacatcctatatttatgagaacattctttaagaagaccaccacatagaataccccttcctatcagctcgctctgatttagccttaattttgttaaattttttagagatgaatgaagtgctgctgtggaaagaaatgtacatatactatttctgtatcattaaaattacatttttatggttc

SEQ ID NO: 1283 - DNA, 8713 bp, Homo sapiens
gtgcggttcggaggcggggcaggtgggggcgggcccaggtagcaggtttggctgcgcgggggccgcgcgtcggagtttccccctttctagggtgaggatggttctacacagccacccggagttccttagttgaaaggtgcgccctgctgtgacagaatgtggtaattgtaatctttaacattttcatgtaaaacatatttcctgatcatctttccattgtcttcatggaaaattgataaatatttgtgccttccaactctcgtcttggttgaatgacttcatcttaatacaacatggacaccacgttgctgaaaacatgctttgggactgccactgaatttatcttttgcggttttatgacaaagttattagtagtttcccttttttgaattagtattttgaagttaatatcacaatgagttcaggcttatggagccaagaaaaagtcacttcaccctactgggaagagcggattttttacttgcttcttcaagaatgcagcgttacagacaaacaaacacaaaagctccttaaagtaccgaagggaagtataggacagtatattcaagatcgttctgtggggcattcaaggattccttctgcaaaaggcaagaaaaatcagattggattaaaaattctagagcaacctcatgcagttctctttgttgatgaaaaggatgttgtagagataaatgaaaagttcacagagttacttttggcaattaccaattgtgaggagaggttcagcctgtttaaaaacagaaacagactaagtaaaggcctccaaatagacgtgggctgtcctgtgaaagtacagctgagatctggggaagaaaaatttcctggagttgtacgcttcagaggacccctgttagcagagaggacagtctccggaatattctttggagttgaattgctggaagaaggtcgtggtcaaggtttcactgacggggtgtaccaagggaaacagctttttcagtgtgatgaagattgtggcgtgtttgttgcattggacaagctagaactcatagaagatgatgacactgcattggaaagtgattacgcaggtcctggggacacaatgcaggtcgaacttcctcctttggaaataaactccagagtttctttgaaggttggagaaacaatagaatctggaacagttatattctgtgatgttttgccaggaaaagaaagcttaggatattttgttggtgtggacatggataaccctattggcaactgggatggaagatttgatggagtgcagctttgtagttttgcgtgtgttgaaagtacaattctattgcacatcaatgatatcatcccagctgtttcagagagtgtgacgcaggaaaggaggcctcccaaacttgcctttatgtcaagaggtgttggggacaaaggttcatccagtcataataaaccaaaggctacaggatctacctcagaccctggaaatagaaacagatctgaattattttataccttaaatgggtcttctgttgactcacaaccacaatccaaatcaaaaaatacatggtacattgatgaagttgcagaagaccctgcaaaatctcttacagagatatctacagactttgaccgttcttcaccaccactccagcctcctcctgtgaactcactgaccaccgagaacagattccactctttaccattcagtctcaccaagatgcccaataccaatggaagtattggccacagtccactttctctgtcagcccagtctgtaatggaagagctaaacactgcacccgtccaagagagtccacccttggccatgcctcctgggaactcacatggtctagaagtgggctcattggctgaagttaaggagaaccctcctttctatggggtaatccgttggatcggtcagccaccaggactgaatgaagtgctcgctggactggaactggaagatgagtgtgcaggctgtacggatggaaccttcagaggcactcggtatttcacctgtgccctgaagaaggcgctgtttgtgaaactgaagagctgcaggcctgactctaggtttgcatcattgcagccggtttccaatcagattgagcgctgtaactctttagcatttggaggctacttaagtgaagtagtagaagaaaatactccaccaaaaatggaaaaagaaggcttggagataatgattgggaagaagaaaggcatccagggtcattacaattcttgttacttagactcaaccttattctgcttatttgcttttagttctgttctggacactgtgttacttagacccaaagaaaagaacgatgtagaatattatagtgaaacccaagagctactgaggacagaaattgttaatcctctgagaatatatggatatgtgtgtgccacaaaaattatgaaactgaggaaaatacttgaaaaggtggaggctgcatcaggatttacctctgaagaaaaagatcctgaggaattcttgaatattctgtttcatcatattttaagggtagaacctttgctaaaaataagatcagcaggtcaaaaggtacaagattgttacttctatcaaatttttatggaaaaaaatgagaaagttggcgttcccacaattcagcagttgttagaatggtcttttatcaacagtaacctgaaatttgcagaggcaccatcatgtctgattattcagatgcctcgatttggaaaagactttaaactatttaaaaaaatttttccttctctggaattaaatataacagatttacttgaagacactcccagacagtgccggatatgtggagggcttgcaatgtatgagtgtagagaatgctacgacgatccggacatctcagctggaaaaatcaagcagttttgtaaaacctgcaacactcaagtccaccttcatccgaagaggctgaatcataaatataacccagtgtcacttcccaaagacttacccgactgggactggagacacggctgcatcccttgccagaatatggagttatttgctgttctctgcatagaaacaagccactatgttgcttttgtgaagtatgggaaggacgattctgcctggctcttctttgacagcatggccgatcgggatggtggtcagaatggcttcaacattcctcaagtcaccccatgcccagaagtaggagagtacttgaagatgtctctggaagacctgcattccttggactccaggagaatccaaggctgtgcacgaagactgctttgtgatgcatatatgtgcatgtaccagagtccaacaatgagtttgtacaaataactggggtcatcgggaaaggcaaagaaactgaaggcagagtcctaacgttgcatcttattcgagctggcagttctgttcacgtccattgccggcaatggatgtctttgtggtgatgatccttcagaaaaggatgcctctgtttaaaaacaaattgcttttgtgtccctgaagtatttaataagaagcattttgcactctagaaagtatgtttgtgttggttttttaagaagtctaaatgaagttattaatacctgaagctttaagttaagtgcattgatcatatgatatttttggaagcatacaattttaattgtggaagtttaaagcctcttttagtccattgagaatgtaaataaatgtgtcttctttatggaccaaggatatgaaatcatttttcttttgtagctaacggttgccttgaggaagaaataatttggttttattaagagtctactctcaatccagttattagagatgtactgagtttgatttgttaatcctttctatatactgctgatcttgcatgtctacaatctgctcagtttttctgtgtttctgcaatagtggtcagaaaaatacttaaattcccttaatggtgttgttttctatttgttctggttttgagataaatgagtgattctgtccccaaatgtccatttttgaagtgattttcctggaggattagggtatttagcagttgaagctcttcattcatagtagttactgtcagctaacaggttttttaaggcttttaactattaatattttatggaatggggcaaagtaaattgatgaaagaattggagtgataatagtcctttacaaacatacagtccataagaaaatgaatttggcatatagaattattacaatttcctgggagagatggatatttaaacctctattattttagacaagactgtctagaacttaagtttgatctgtcagccagtactcccattaaattcagtgtagtttcacttgatagaatcagatatgttatcgaaatgttagcagcagcttcatcctccttctgattaaagtaagtagaaatgggatgttttgtttaataacagccatagtgtgtgtttagaccacagcggatgttgtagaccaggaccatagatgatacatgtcagtgctgtggaatgtgcattctctgagtgttgttttgtggtatcattgtctttcctgaatgactttctaactgtgcagaaaggcagaaaagtcatcatatgtatatgtcatatgactttataaaatatttaatgtgacaaaaagtggaaagaatctttacaaaccctgcaattacttttttaaaggcacttttactctttggttttatcattccattttgctaatatttactagctttataaattacagtaaggtacaaaaactcatcttgtaatattttcatttttgaagtgaaaaagtacatatattttgcacaaggttttatactgctaagtgcttggttggggtggtgagatgatgattagatcaggggtgaggctgagagactctgggtttagggctagccctgcctccatctcccttgggtaaaatgaagggtgtggggtaaaagatgcataaggccttttctagctctgacagcctagaagtccaatcaccctgtaataaatatgtgttgaatgaagaaatgggtgaatgagcttgtcaatgtgattttaaaaaattgactacctggaggaatgattaggaatctaaatgaagccagccctcggtatctgcaggtttctcatccatggattcaaccaactgcaaatggaaaatacgattttttttaaaaaaaggatggttacatccgtattgaacatgtacagacttttttcttgtcattattctctgaacaatacaagaactctttatgtagcatttacatttattaggtattataagtaatctagagattatttaattaaaatatacaggaggatgtgtgtcagttatatgcaaattctgtaccattttgtatcagggaattgagcatcttcagatgttggtatctgcagggatcctggaaccaaacccctgcagatactaagggctgacgatctaggtaagactggatttaacagttggaaaaaaaaaaaaaaaaggagagagaagacagttcctttcctgtagaaattaaaacaaaatacaaattgaggaagctctgctacccaggctgtcatggtagagaacttgaagaagacctgtttggatggacacctggtttcaaaagtcaggtgtggagactgttaaatgggagggcctcatccataaatgatttctggcaacgtcttcttcaggtggagcttgacgtctttttaatgttacttggggagggagtgctcattaagggatgccagggccagctctggtggttcctggggaggctgcgtccttccctgcttctgcatgtcatgaggcagcaggaaggtttcccctgcacctgtctgtcctggctccctctgggtagccccctactgttctgtgcttcagcacagcctggtttgtcaagaggcacatagttggggctgggctgcatggcacaggggcttatgtgcctgctggttatttaattttcagccttaagttttctttaatattttcctgttggctatttaaaggttttggttatcttttattccttatctacaatcaagatgacaatgtaattgaattatcttatttataacacggttcgtgattcatgattcatgattacaagtagaaaatatgtcatgttcctcacctccaaataaatatgtgtgtgtctgtgtgtgtgtatatatgtatgtggcggagagggagagagtggggaaggagagcagtgttatcatacatagagaggctaaatgtgtcccatccctcactgtcagctttataaaggagtttgactccatccacagaagaatgttttataagactaggaaaacacgttgaaaactaggataaacagcaacaaaaatcaactaaatatgttgttactgttgctaaggattttctccttagaataatttaggatttttaaaaatttctgtttgccaaatgctgtagataaatggccagattcttcctatccctaggattcctttattattttttttcacagattttgagaacaagggggagagatagtatggaagattaagattccattaatcttatagaactgtgttgtcacccaaattcctgcttgtttgaacatggcatcttcatagattcaggattcactaccctctatagctggatcttgaaaattatctggccagataattttgcatctgcttggatgattgtagactgagatgtgagtggaggataaagtattagacttttgctgagtaactgccaaccaagaagtatttatcggacacttactaggtgcctaggattgtatcagagggaatatgaaatgtgtccctgccctacctagttttaacgacagaatatctattaaaggctacttagctgaagggtaagggtgacaggtctaggggaagctttgggaggtggtgtgctgtgacagaaaaagtggcagagtagggacgagagacctgcattctagccctgtttctgtcacttgctctgtacacttagacaacagcttgacctcttgagctttagtttcctcctctgcataatgagagggttagactactgaattgtatgggaaaaaaatacaaattcctgggtcctaggccatgcctgctgaatccgactgttcaggaagaggcctaggaaatctgtgagggaatccccaggggaatctcgtgaccagccaggtgtgaaatctgctaactggaagatctcaaagcttccttcactttttgtgattttgtggtcatgtaacgttactgtattattctacgtaaatgtgggtacttggatgtttatcatactgtttctctgtgtttacatactaatttgtgtaagaaatgcattttagtctgtgtacctcaacctgctgtttgtttcctagaggtgttagtagtctttaaatacaagtaagacttaagaggatatttgatgttatttacctggatattttcttccccttttatttatttagaggaaattgagattctaggagccaaaaaaatgaaaacaaaattctaaggcaaagttaaagaaaaaaattacattatttcttaccatttgctactttataatgaaaatttaaaaattatatgggaagatttttctctgggataacaaatccttgtcataaagtaagaggtctttttaaagtaggtaggctataaggcctgtaatttaaaataatactcctttctctagggtttggtgcaattctccattaatgaagataacatttgaattccccaaagcaggtgaggagtcggggaggagaaagcgatgttaaaatgaaaactcactgcaaaagaggaggcagaggaagaaggaatgtaaaccccttaaagcagatgtgtgtggggccttatgaagaccaggattctgcgggtgtcaggggattgcccctcttgacagagactagggttttagactgaggcttcctgcagggtgttcgcattgcccttctccgttccccttcagacctttctggggagaagaggtgggaggaggggagaaagactgttcatcttattctgaatcctggagcagctgaaggttttctcttgagtcaggatgcagtggtaatgcattaaccagcaagtgtggccaaggataatgaaaaagtgggaaaggaaggtcctcctcctccctgattgtagcatccagcagtctctgtagccaggttactcaagaaccacatttgatttcctggccctttgccttggcagtgatggcatttttatttcactgtgttttaaagtcttcatttatttttataacatgggttagggagaagggccacaaatggagggattgtcctttcaagcaccacagcttcagataaaattagtactttcaaatattgtccactttaacttaaaaaattctagagggattatattggagactcaactgcccttggttttagtttataaaatggcctagtactgtggaattttaattttagaaagtcttagcatcagatcataaacattcattaaaagaactcacatcccatctgaaacttcccaggggagttgggattcttagtagattggtagaaaggggctcattttctactgcatttcccatttttggtatcttgttcagcatgttttatttttatttcttgtctgcagaacatcctatatttatgagaacattctttaagaagaccaccacatagaataccccttcctatcagctcgctctgatttagccttaattttgttaaattttttagagatgaatgaagtgctgctgtggaaagaaatgtacatatactatttctgtatcattaaaattacatttttatggttc

SEQ ID NO: 1284 - DNA, 759 bp, Homo sapiens
cgtcttggcacgcgggtgcgcgccgccccctcggcctcctgggctccctgaacctcgcaggaccccggcaacttcgagccccgccccagctccaggccgcgggggcgcatcgcgggcgtcgggcggggcggcccagcgggtaaaagctgcgcggccgcaagctcggcactcacggctctgagggctccgacggcactgacggccatggcgcgttcgaacctcccgctggcgctgggcctggccctggtcgcattctgcctcctggcgctgccacgcgacgcccgggcccggccgcaggagcgcatggtcggagaactccgggacctgtcgcccgacgacccgcaggtgcagaaggcggcgcaggcggccgtggccagctacaacatgggcagcaacagcatctactacttccgagacacgcacatcatcaaggcgcagagccagctggtggccggcatcaagtacttcctgacgatggagatggggagcacagactgccgcaagaccagggtcactggagaccacgtcgacctcaccacttgccccctggcagcaggggcgcagcaggagaagctgcgctgtgactttgaggtccttgtggttccctggcagaactcctctcagctcctaaagcacaactgtgtgcagatgtgataagtccccgagggcgaaggccattgggtttggggccatggtggagggcacttcaggtccgtgggccgtatctgtcacaataaatggccagtgctgcttcttgca

SEQ ID NO: 1285 - DNA, 928 bp, Homo sapiens
gctgtggccctggcacctgcccctgggctgggacagcccactgttccatgctgcccaagaaggctcagcacaggcacaaaccattgcccggcactggcccgtgctgcctgagaaggattggcacgggcacagaccactgcccccacctgccctgcgccatctacccaagaaggctcggcacgggcaccaaccactgcctccaactgccccatgctgcctgagaaggcactgcacggccacccccaactgccccgcactgtccctacccgggcagccatgcgagcggctggaactctgctggccttctgctgcctggtcttgagcaccactgggggcccttccccagatacttgttcccaggaccttaactcacgtgtgaagccaggatttcctaaaacaataaagaccaatgacccaggagtcctccaagcagccagatacagtgttgaaaagttcaacaactgcacgaacgacatgttcttgttcaaggagtcccgcatcacaagggccctagttcagatagtgaaaggcctgaaatatatgctggaggtggaaattggcagaactacctgcaagaaaaaccagcacctgcgtctggatgactgtgacttccaaaccaaccacaccttgaagcagactctgagctgctactctgaagtctgggtcgtgccctggctccagcacttcgaggtgcctgttctccgttgtcactgacccccgcctcttcagcaagaccacagccatgacaaacaccaggatgcatgctccttgtcccctcccacccgcctcatgacccagcctcacagaccctctcaggcctctgacgagtgagcgggtgaagtgccactgggtcaccgcagggcagctggaatggcagcatggtagcacctcctaacagattaaatagatcacatttgcttctaaaatt

SEQ ID NO: 1286 - DNA, 930 bp, Homo sapiens
gctgtggccctggcacctgcccctgggctgggacagcccactgttccatgctgcccaagaaggctcagcacaggcacaaaccattgcccggcactggcccgtgctgcctgagaaggattggcacgggcacagaccactgcccccacctgccctgcgccatctacccaagaaggctcggcacgggcaccaaccactgcctccaactgccccatgctgcctgagaaggcactgcacggccacccccaactgccccgcactgtccctacccgggcagccatgcgagcggctggaactctgctggccttctgctgcctggtcttgagcaccactgggggcccttccccagatacttgttcccaggaccttaactcacgtgtgaagccaggatttcctaaaacaataaagaccaatgacccaggagtcctccaagcagccagatacagtgttgaaaagttcaacaactgcacgaacgacatgttcttgttcaaggagtcccgcatcacaagggccctagttcagatagtgaaaggcctgaaatatatgctggaggtggaaattggcagaactacctgcaagaaaaaccagcacctgcgtctggatgactgtgacttccaaaccaaccacaccttgaagcagactctgagctgctactctgaagtctgggtcgtgccctggctccagcacttcgaggtgcctgttctccgttgtcactgacccccgcctcttcagcaagaccacagccatgacaaacaccaggatgcatgctccttgtcccctcccacccgcctcatgacccagcctcacagaccctctcaggcctctgacgagtgagcgggtgaagtgccactgggtcaccgcagggcagctggaatggcagcatggtagcacctcctaacagattaaatagatcacatttgcttctaaaattaa

SEQ ID NO: 1287 - DNA, 1268 bp, Homo sapiens
cggtggctcctcccgcccacgcgccagagtcgcagtgggcgggcctacgtgctccgcccgctgtgagcctgtccggcccccgcccgctccggagcaacccgcgagcttacaccggcttctctctgtcctcagcccgcgcgccgccatcgccgtcatgctgggcgccgctctccgccgctgcgctgtggccgcaaccacccgggccgaccctcgaggcctcctgcactccgcccggacccccggccccgccgtggctatccagtcagttcgctgctattcccatgggtcacaggagacagatgaggagtttgatgctcgctgggtaacatacttcaacaagccagatatagatgcctgggaattgcgtaaagggataaacacacttgttacctatgatatggttccagagcccaaaatcattgatgctgctttgcgggcatgcagacggttaaatgattttgctagtacagttcgtatcctagaggttgttaaggacaaagcaggacctcataaggaaatctacccctatgtcatccaggaacttagaccaactttaaatgaactgggaatctccactccggaggaactgggccttgacaaagtgtaaaccgcatggatgggcttccccaaggatttattgacattgctacttgagtgtgaacagttacctggaaatactgatgataacatattaccttatttgaacaagttttcctttattgagtaccaagccatgtaatggtaacttggactttaataaaagggaaatgagtttgaactgaaattaggtatttgtttcatgtgtttgcattaataagcagaaaattaagtgctgtattggtttcatggttttgctgccctcttacatgctgagagaactgtgttaattctctggaaaccatctgacatgaaaatcagcttcattaatatgtttgggtgccctagcttgtaaattagctgaaggctagaagtcatttatatagaattttcttgttgacaccctaggcttaggggactggttgtctgtggggatagatcaaattgtgtacctttccaaaacaggttttaatgatgtttaaaagtggtcactgagatagtcttgaggatgtgctatgcagtagccaagccctcttacggtgtgttcctctcttagtgcccctttcctttcctacctgttcttcccttgcagtggtgtattagccttggacattaaaacatttgctttgtaaatttggaggcattctgattaaacagctgagtaaaacaaa

SEQ ID NO: 1288 - DNA, 4098 bp, Homo sapiens
gtagccgccagctcggccgcacgtcagggcgcgggagcgcggagcgagtttggttgcacttacaccggtacttaagcgcggaccggcgtgtccttggacttagagagtggggacgtccggcttcggagcgggagtgttcgttgtgccagcgactaaaaagagaattaaatatgggtgatgttgagaaaggcaagaagatttttattatgaagtgttcccagtgccacaccgttgaaaagggaggcaagcacaagactgggccaaatctccatggtctctttgggcggaagacaggtcaggcccctggatactcttacacagccgccaataagaacaaaggcatcatctggggagaggatacactgatggagtatttggagaatcccaagaagtacatccctggaacaaaaatgatctttgtcggcattaagaagaaggaagaaagggcagacttaatagcttatctcaaaaaagctactaatgagtaataattggccactgccttatttattacaaaacagaaatgtctcatgacttttttatgtgtaccatcctttaatagatctcatacaccagaattcagatcatgaatgactgacagaatattttgttgggcagtcctgatttaaaactaagactggcttgtggttaaatgaatatgttcagtttttgaattttaatagtaactccaattcagtaaatggtatcactgtttaccccttttaaagatatgattagacttcgttagtaatgttcaacttttcacaaagatggtgagtgccatcttaaaacttactggagattggttttatatttagatttatataactggttatgtgaatatatttaaatactggggaaattgcttcactgtcttagaaccaagcaagattcacctgtgttttgtgttcatgttcatttgcctcttaaaggcaagggttgaagataaataaggtagcaatgtctatagttttggccttaactatgccaatctaattataattccctgtatttaaaatggtttcttttacttattgaaaggcattttagtgtggtttatgtgtaatattaaagattattcaacacctctcacatcttacagatctataaggtcacatgcttttaaaatagtagcaagttaaacttcactcttgaattctttacaatctaagtcaaactaagttataatttaggattgtctttaaacagccattcagaaacaaaactgtagaactgtgtatttgattgggaatggtgcttttgccaacttaaaaggattaaagtaacggagatatacacaaattttaaaattatgtgtgatcacaagactaaagataattaaaaagaaaaccacagatcatgactttttgactgtgcttgatttcatgactgatgcacaaattttaatgattaaaaagtgcaggagccctaaatgtcagtgcagcagccctaaatgtcagtgcagcagtgttaaccagtcatggtgctagattgtttacttggttttctaggactgcctcaactagaataacacttcactaattgactcttagtttctttgctcagattgagaactgcagcatttatgccagacatggacagaggaatgcctgtggtcatagttttgtgatgtgtaacagtgtataattacatactgaattatttcatgcatagtctgtgccatacacatttagagtagtccttggagattttatggagatggtgagcacaaggtaagtcataaagaataatgagaaaataaatctatgctggtgcagctgagaactgtatctttgtgggacagtgagaagactgagaagatgtgaatccatggtctcaaaggtgatagggacgattagataggtgttttaaggcctgaaagcaatttataacatatgagtcttatttttatttatagaaatgtggaaagcttgctgtaattcatatttgaagtcctagtctgagttctggtggggaatttaaaaatgcatcctggaaatcctttaaagatttcagactttgaaaggccttgtagcagaggacttggtgactgtataaagttagtggtattcagggacagtgtagcaagtagcttacaaggggacaattctggactaatgagaaagacctgaagtgaaggctagagagttgattttttttttttttggcatcctggaaatgatacaggaaacatattaagatagatacagaaatgtgttcaaccttccatcttggctagttgtggcgtttagtttgttttttgagacatggtcacgctgtgtcgccaaggctggagtgcagtggtgcgatctcggctggctgcaacctctatttcccaggctcaagcgattctctcacttcagcttcccaagtagctgggactacaggtgttcgccaccatgcccagctaatttttttgtagagatggagttttgccatgtggtcccaggctggtctcaaactcctgagctcaagcaatccgtccacttgccttggctccccaaagtgctgggattacaggcgtgagccaccaggccctgcctggttttcaaattcagaaatcttattatttaacccagaagtaatcagcccagtagtaacttaggtttaattttttttcaggtttaaaatttttctcatttattttttctgagacggagtttcgcccttttcgcccaggctgagtacagtggtgcaatctcactgcaacctccgccttccagttgcaagtgattctcctgcctcagcctcctgagtagctgggattacaggcacccgccaccacgcctggctaatttttgtatttttagtggagatggtgtttcaccatgttggccagactggtcttggactcctgacctcgtgatccacccaccttggcctcccaaagttctaggattacaggtgtgagccaccacgtccggccaatttttctcatttctatgcctcctatattaaggtctgtgttggcacagatgagtaactgccatgttctaggtcagttatacccaagcacttctggtggtttaaaatgtgattctgtaacttttttatttttatttttttgagataatttcactcttgttgcccaggctggagtgcaatggcgtgatcgctgctcaccgcaacctccgccttccaggttcaagcgattctcctgactcagcctctcaagtagctgggattacaagcatgcgccaccatgcccagcttattttgtgtttttagtagagacagggtttctccatgctggacaggctggtcttgaactcccgacgtcaggtgatctacctgcctcggcctcccaaagtgctgggattacaggcgtgagccaccacgcctggccaattatgtaattttttaaaaaggacatttctatcagggatatataccttcagaaataaggaaataggggaaaaaaagagcactataaaccacatgttttcatttctagtgcttcgctgtaagtggctaggttggtagaatcaaaaacaagggccagatgtatttaaggggtattcagatgccacctacatgcttattttgtctagaacagtgctgtctaatagaactttctgtgacgatggatattttgtagacttttgctgtccagtgtggtagccactaaccacatgtggctgttaagcccttgaaatatagctagtgtgactagaaagtattttattttaaatttacataggcacaagtggctagtggctactgtattgacattctgggtctaggactagaaccagtggtctgtaacaaaagtactttctctttactctattaaatctagaattagccgggcatggtcgctcatgcctgtaatcccagcactttgggaggccaaggcaggcagatcacttgaggtcaggcgtttgagaccagcctggtcaacatggcgaaaccctgtctctacaaaaaacataaaaattagccaggtgtggtggtgggcacctgtaatctcagctacttgggaggctgaggcacaagaatcacttgaacttgggaggtggaggttgcagtgagccaagattgtgccactgcactcaagcctgggtgacgagtgaaactgtctccaaaaaaaaaaaaaaa

SEQ ID NO: 1289 - DNA, 974 bp, Homo sapiens
acgtccggcttcggagcgggagtgttcgttgtgccagcgactaaaaagaggtgagagcgggtcgcggaggccgcacctggttagaggcagagctgtgggaggcgcgcacttgcgagcgaccgaaacccaagcggggagcattcgagtggagcccgcgctgggtgggagggcggggagtgaagaccctggactgtggtcagaccgagctgggcgagtaacggcttgaggtgcggcggagccctaactagggacagaattaaatatgggtgatgttgagaaaggcaagaagatttttattatgaagtgttcccagtgccacaccgttgaaaagggaggcaagcacaagactgggccaaatctccatggtctctttgggcggaagacaggtcaggcccctggatactcttacacagccgccaataagaacaaaggcatcatctggggagaggatacactgatggagtatttggagaatcccaagaagtacatccctggaacaaaaatgatctttgtcggcattaagaagaaggaagaaagggcagacttaatagcttatctcaaaaaagctactaatgagtaataattggccactgccttatttattacaaaacagaaatgtctcatgacttttttatgtgtaccatcctttaatagatctcatacaccagaattcagatcatgaatgactgacagaatattttgttgggcagtcctgatttaaaactaagactggcttgtggttaaatgaatatgttcagtttttgaattttaatagtaactccaattcagtaaatggtatcactgtttaccccttttaaagatatgattagacttcgttagtaatgttcaacttttcacaaagatggtgagtgccatcttaaaacttactggagattggttttatatttagatttatataactggttatgtgaatatatttaaatactggggaaattgcttcactgtcttagaac

SEQ ID NO: 1290 - DNA, 799 bp, Homo sapiens
agagagtggggacgtccggcttcggagcgggagtgttcgttgtgccagcgactaaaaagagagggcaaaagctgttgctcttctaataaggggccagttcttttcgtgggcacatgtttcttccgtcagtcgttctgacatcctagaaggagtttcatcaatcaccttgaaaccgacctggacgggtgacctcgtggtcgccccaggagatcacagaattaaatatgggtgatgttgagaaaggcaagaagatttttattatgaagtgttcccagtgccacaccgttgaaaagggaggcaagcacaagactgggccaaatctccatggtctctttgggcggaagacaggtcaggcccctggatactcttacacagccgccaataagaacaaaggcatcatctggggagaggatacactgatggagtatttggagaatcccaagaagtacatccctggaacaaaaatgatctttgtcggcattaagaagaaggaagaaagggcagacttaatagcttatctcaaaaaagctactaatgagtaataattggccactgccttatttattacaaaacagaaatgtctcatgacttttttatgtgtaccatcctttaatagatctcatacaccagaattcagatcatgaatgactgacagaatattttgttgggcagtcctgatttaaaactaagactggcttgtggttaaatgaatatgttcagtttttgaattttaatagtaactccaattcagtaaatggtatcactgtttaccccttttaaagatatgattagacttcgt

SEQ ID NO: 1291 - DNA, 498 bp, Homo sapiens
agagagtggggacgtccggcttcggagcgggagtgttcgttgtgccagcgactaaaaagaggggccagttcttttcgtgggcacatgtttcttccgtcagtcgttctgacatcctagaaggagtttcatcaatcaccttgaaaccgacctggacgggtgacctcgtggtcgccccaggagatcacagaattaaatatgggtgatgttgagaaaggcaagaagatttttattatgaagtgttcccagtgccacaccgttgaaaagggaggcaagcacaagactgggccaaatctccatggtctctttgggcggaagacaggtcaggcccctggatactcttacacagccgccaataagaacaaaggcatcatctggggagaggatacactgatggagtatttggagaatcccaagaagtacatccctggaacaaaaatgatctttgtcggcattaagaagaaggaagaaagggcagacttaatagcttatctcaaaaaa

SEQ ID NO: 1292 - DNA, 5247 bp, Homo sapiens
aaaacccggaggagcgggatggcgcgctttgactctggagtgggagtgggagcgagcgcttctgcgactccagttgtgagagccgcaagggcatgggaattgacgccactcaccgacccccagtctcaatctcaacgctgtgaggaaacctcgactttgccaggtccccaagggcagcggggctcggcgagcgaggcacccttctccgtccccatcccaatccaagcgctcctggcactgacgacgccaagagactcgagtgggagttaaagcttccagtgagggcagcaggtgtccaggccgggctgcgggttcctgttgacgtcttgccctaggcaaaggtcccagttccttctcggagccggctgtcccgcgccactggaaaccgcacctccccgcagcatgggcaccagcctcagcccgaacgacccttggccgctaaacccgctgtccatccagcagaccacgctcctgctactcctgtcggtgctggccactgtgcatgtgggccagcggctgctgaggcaacggaggcggcagctccggtccgcgcccccgggcccgtttgcgtggccactgatcggaaacgcggcggcggtgggccaggcggctcacctctcgttcgctcgcctggcgcggcgctacggcgacgttttccagatccgcctgggcagctgccccatagtggtgctgaatggcgagcgcgccatccaccaggccctggtgcagcagggctcggccttcgccgaccggccggccttcgcctccttccgtgtggtgtccggcggccgcagcatggctttcggccactactcggagcactggaaggtgcagcggcgcgcagcccacagcatgatgcgcaacttcttcacgcgccagccgcgcagccgccaagtcctcgagggccacgtgctgagcgaggcgcgcgagctggtggcgctgctggtgcgcggcagcgcggacggcgccttcctcgacccgaggccgctgaccgtcgtggccgtggccaacgtcatgagtgccgtgtgtttcggctgccgctacagccacgacgaccccgagttccgtgagctgctcagccacaacgaagagttcgggcgcacggtgggcgcgggcagcctggtggacgtgatgccctggctgcagtacttccccaacccggtgcgcaccgttttccgcgaattcgagcagctcaaccgcaacttcagcaacttcatcctggacaagttcttgaggcactgcgaaagccttcggcccggggccgccccccgcgacatgatggacgcctttatcctctctgcggaaaagaaggcggccggggactcgcacggtggtggcgcgcggctggatttggagaacgtaccggccactatcactgacatcttcggcgccagccaggacaccctgtccaccgcgctgcagtggctgctcctcctcttcaccaggtatcctgatgtgcagactcgagtgcaggcagaattggatcaggtcgtggggagggaccgtctgccttgtatgggtgaccagcccaacctgccctatgtcctggccttcctttatgaagccatgcgcttctccagctttgtgcctgtcactattcctcatgccaccactgccaacacctctgtcttgggctaccacattcccaaggacactgtggtttttgtcaaccagtggtctgtgaatcatgacccagtgaagtggcctaacccggagaactttgatccagctcgattcttggacaaggatggcctcatcaacaaggacctgaccagcagagtgatgattttttcagtgggcaaaaggcggtgcattggcgaagaactttctaagatgcagctttttctcttcatctccatcctggctcaccagtgcgatttcagggccaacccaaatgagcctgcgaaaatgaatttcagttatggtctaaccattaaacccaagtcatttaaagtcaatgtcactctcagagagtccatggagctccttgatagtgctgtccaaaatttacaagccaaggaaacttgccaataagaagcaagaggcaagctgaaattttagaaatattcacatcttcggagatgaggagtaaaattcagtttttttccagttcctcttttgtgctgcttctcaattagcgtttaaggtgagcataaatcaactgtccatcaggtgaggtgtgctccatacccagcggttcttcatgagtagtgggctatgcaggagcttctgggagatttttttgagtcaaagacttaaagggcccaatgaattattatatacatactgcatcttggttatttctgaaggtagcattctttggagttaaaatgcacatatagacacatacacccaaacacttacaccaaactactgaatgaagcagtattttggtaaccaggccatttttggtgggaatccaagattggtctcccatatgcagaaatagacaaaaagtatattaaacaaagtttcagagtatattgttgaagagacagagacaagtaatttcagtgtaaagtgtgtgattgaaggtgataagggaaaagataaagaccagaaattcccttttcaccttttcaggaaaataacttagactctagtatttatgggtggatttatccttttgccttctggtatacttccttacttttaaggataaatcataaagtcagttgctcaaaaagaaatcaatagttgaattagtgagtatagtggggttccatgagttatcatgaattttaaagtatgcattattaaattgtaaaactccaaggtgatgttgtacctcttttgcttgccaaagtacagaatttgaattatcagcaaagaaaaaaaaaaaagccagccaagctttaaattatgtgaccataatgtactgatttcagtaagtctcataggttaaaaaaaaaagtcaccaaatagtgtgaaatatattacttaactgtccgtaagcagtatattagtattatcttgttcaggaaaaggttgaataatatatgccttgtataatattgaaaattgaaaagtacaactaacgcaaccaagtgtgctaaaaatgagcttgattaaatcaaccacctatttttgacatggaaatgaagcagggtttcttttcttcactcaaattttggcgaatctcaaaattagatcctaagatgtgttcttatttttataacatctttattgaaattctatttataatacagaatcttgttttgaaaataacctaattaatatattaaaattccaaattcatggcatgcttaaattttaactaaattttaaagccattctgattattgagttccagttgaagttagtggaaatctgaacattctcctgtggaaggcagagaaatctaagctgtgtctgcccaatgaataatggaaaatgccatgaattacctggatgttctttttacgaggtgacaagagttggggacagaactcccattacaactgaccaagtttctcttctagatgattttttgaaagttaacattaatgcctgctttttggaaagtcagaatcagaagatagtcttggaagctgtttggaaaagacagtggagatgaggtcagttgtgttttttaagatggcaattactttggtagctgggaaagcataaagctcaaatgaaatgtatgcattcacatttagaaaagtgaattgaagtttcaagttttaaagttcattgcaattaaacttccaaagaaagttctacagtgtcctaagtgctaagtgcttattacattttattaagctttttggaatctttgtaccaaaattttaaaaaagggagtttttgatagttgtgtgtatgtgtgtgtggggtggggggatggtaagagaaaagagagaaacactgaaaagaaggaaagatggttaaacattttcccactcattctgaattaattaatttggagcacaaaattcaaagcatggacatttagaagaaagatgtttggcgtagcagagttaaatctcaaataggctattaaaaaagtctacaacatagcagatctgttttgtggtttggaatattaaaaaacttcatgtaattttattttaaaatttcatagctgtacttcttgaatataaaaaatcatgccagtatttttaaaggcattagagtcaactacacaaagcaggcttgcccagtacatttaaattttttggcacttgccattccaaaatattatgccccaccaaggctgagacagtgaatttgggctgctgtagcctatttttttagattgagaaatgtgtagctgcaaaaataatcatgaaccaatctggatgcctcattatgtcaaccaggtccagatgtgctataatctgtttttacgtatgtaggcccagtcgtcatcagatgcttgcggcaaaaggaaagctgtgtttatatggaagaaagtaaggtgcttggagtttacctggcttatttaatatgcttataacctagttaaagaaaggaaaagaaaacaaaaaacgaatgaaaataactgaatttggaggctggagtaatcagattactgctttaatcagaaaccctcattgtgtttctaccggagagagaatgtatttgctgacaaccattaaagtcagaagttttactccaggttattgcaataaagtataatgtttattaaatgcttcatttgtatgtcaaagctttgactctataagcaaattgcttttttccaaaacaaaaagatgtctcaggtttgttttgtgaattttctaaaagctttcatgtcccagaacttagcctttacctgtgaagtgttactacagccttaatattttcctagtagatctatattagatcaaatagttgcatagcagtatatgttaatttgtgtgtttttagctgtgacacaactgtgtgattaaaaggtatactttagtagacatttataactcaaggataccttcttatttaatcttttcttatttttgtactttatcatgaatgcttttagtgtgtgcataatagctacagtgcatagttgtagacaaagtacattctggggaaacaacatttatatgtagcctttactgtttgatataccaaattaaaaaaaaattgtatctcattacttatactgggacaccattaccaaaataataaaaatcactttcataatcttgttatgaagttttatgttgtagcaaatatagtctaatgtatcactttatttcaactattactatggattattcaattaaaatattgcactgtaaa

SEQ ID NO: 1293 - DNA, 2173 bp, Homo sapiens
ccactcaccgacccccagtctcaatctcaacgctgtgaggaaacctcgactttgccaggtccccaagggcagcggggctcggcgagcgaggcacccttctccgtccccatcccaatccaagcgctcctggcactgacgacgccaagagactcgagtgggagttaaagcttccagtgagggcagcaggtgtccaggccgggctgcgggttcctgttgacgtcttgccctaggcaaaggtcccagttccttctcggagccggctgtcccgcgccactggaaaccgcacctccccgcaggtcacatgggcaccagcctcagcccgaacgacccttggccgctaaacccgctgtccatccagcagaccacgctcctgctactcctgtcggtgctggccactgtgcatgtgggccagcggctgctgaggcaacggaggcggcagctccggtccgcgcccccgggcccgtttgcgtggccactgatcggaaacgcggcggcggtgggccaggcggctcacctctcgttcgctcgcctggcgcggcgctacggcgacgttttccagatccgcctgggcagctgccccatagtggtgctgaatggcgagcgcgccatccaccaggccctggtgcagcagggctcggccttcgccgaccggccggccttcgcctccttccgtgtggtgtccggcggccgcagcatggctttcggccactactcggagcactggaaggtgcagcggcgcgcagcccacagcatgatgcgcaacttcttcacgcgccagccgcgcagccgccaagtcctcgagggccacgtgctgagcgaggcgcgcgagctggtggcgctgctggtgcgcggcagcgcggacggcgccttcctcgacccgaggccgctgaccgtcgtggccgtggccaacgtcatgagtgccgtgtgtttcggctgccgctacagccacgacgaccccgagttccgtgagctgctcagccacaacgaagagttcgggcgcacggtgggcgcgggcagcctggtggacgtgatgccctggctgcagtacttccccaacccggtgcgcaccgttttccgcgaattcgagcagctcaaccgcaacttcagcaacttcatcctggacaagttcttgaggcactgcgaaagccttcggcccggggccgccccccgcgacatgatggacgcctttatcctctctgcggaaaagaaggcggccggggactcgcacggtggtggcgcgcggctggatttggagaacgtaccggccactatcactgacatcttcggcgccagccaggacaccctgtccaccgcgctgcagtggctgctcctcctcttcaccaggtatcctgatgtgcagactcgagtgcaggcagaattggatcaggtcgtggggagggaccgtctgccttgtatgggtgaccagcccaacctgccctatgtcctggccttcctttatgaagccatgcgcttctccagctttgtgcctgtcactattcctcatgccaccactgccaacacctctgtcttgggctaccacattcccaaggacactgtggtttttgtcaaccagtggtctgtgaatcatgacccagtgaagtggcctaacccggagaactttgatccagctcgattcttggacaaggatggcctcatcaacaaggacctgaccagcagagtgatgattttttcagtgggcaaaaggcggtgcattggcgaagaactttctaagatgcagctttttctcttcatctccatcctggctcaccagtgcgatttcagggccaacccaaatgagcctgcgaaaatgaatttcagttatggtctaaccattaaacccaagtcatttaaagtcaatgtcactctcagagagtccatggagctccttgatagtgctgtccaaaatttacaagccaaggaaacttgccaataagaagcaagaggcaagctgaaattttagaaatattcacatcttcggagatgaggagtaaaattcagtttttttccagttcctcttttgtgctgcttctcaattagcgtttaaggtgagcataaatcaactgtccatcaggtgaggtgtgctccatacccagcggttcttcatgagtagtgggctatgcaggagcttctgggagatttttttgagtcaaagacttaaagggcccaatgaatt

SEQ ID NO: 1294 - DNA, 5451 bp, Homo sapiens
cccagacgctcatggagacagcctcggttcataaatcaggtggggccaggggctgggggcccacacgccatggagcccgactcccttctggaccaagacgactcctacgagtcgcctcaagaaaggccgggctctcggcgcagcctgcctggcagcctttccgagaagagccccagcatggagccctcggccgccacgccgttccgggtcacgggcttcctcagccgccgcctcaagggctccatcaagcgcaccaagagccagcccaagctggaccgcaaccacagcttccgccacatcctgccggggttccggagcgccgccgccgccgccgcggacaatgagaggtcccatctgatgccgaggctgaaggagtctcgctcccacgagtccctgctcagccccagcagtgcggtggaggcgctggacctcagcatggaggaagaggtggtcatcaagcccgtgcacagcagcatccttggccaggactactgcttcgaggtgacgacgtcatcaggaagcaagtgcttttcctgccggtctgcagctgagcgggataagtggatggagaacctccggcgagcggtgcatcccaacaaggacaacagccggcgtgtggagcacatcctgaagctgtgggtgatcgaggccaaggacctgccagccaagaagaagtacctgtgcgagctgtgcctggacgatgtgctctatgcccgcaccacgggcaagctcaagacggacaatgttttctggggcgagcacttcgagttccacaacttgccgcctctgcgcacggtcactgtccacctgtaccgggagaccgacaagaagaagaagaaggagcgcaacagttacctgggcctggtgagcctacctgctgcctcggtggccgggcggcagttcgtggagaagtggtacccggtggtgacgcccaaccccaagggcggcaagggccctggacccatgatccgcatcaaggcgcgctaccaaaccatcaccatcctgcccatggagatgtacaaagagttcgctgagcacatcaccaaccactacctggggctgtgtgcagccctcgagcccatcctcagtgccaagaccaaggaggagatggcatctgccctggtgcacatcctgcagagcacgggcaaggtgaaggacttcctgacagacctgatgatgtcagaggtggaccgctgcggggacaacgagcacctcatcttccgggagaacacactggccaccaaggccattgaggagtacctcaagctagtgggccagaagtacctgcaggacgccctaggtgagttcatcaaagcgctgtatgagtcagatgagaactgcgaagtggatcccagcaagtgctcggccgctgacctcccagagcaccagggcaacctcaagatgtgctgcgagctggccttctgcaagatcatcaactcctactgtgtcttcccacgggagttgaaagaggtgtttgcctcgtggaggcaggagtgcagcagtcgcggccgcccggacatcagtgagcggctcatcagcgcctccctcttcctgcgcttcctctgcccagccatcatgtcgccctcactcttcaacctgctgcaggagtaccctgatgaccgcactgcccgcaccctcaccctcatcgccaaggtcacccagaacctggccaactttgccaaatttggcagcaaggaggaatacatgtccttcatgaaccagttcctagagcatgagtggaccaacatgcagcgcttcctgctggagatctccaaccccgagaccctctccaatacagccggcttcgagggctacatcgacctgggccgcgagctctccagcctgcactcactgctctgggaggccgtcagccagctggagcagagcatagtatccaaactgggacccctgcctcggatcctgagggacgtccacacagcactgagcaccccaggtagcgggcagctcccagggaccaatgacctggcctccacaccgggctctggcagcagcagcatctcagctgggctgcagaagatggtgattgagaacgatctttccggtctgatagatttcacccggttaccgtctccaacccccgaaaacaaggacttgttttttgtcacaaggtcctccggggtccagccctcacctgcccgcagctcgagttactcggaagccaacgagcctgatcttcagatggccaacggtggcaagagcctctccatggtggacctccaggacgcccgcacgctggatggggaggcaggctccccggcgggccccgacgtcctccccacagatgggcaggccgctgcagctcagctggtggccgggtggccggcccgggcaaccccagtgaacctggcagggctggccacggtgcggcgggcaggccagacaccaaccacaccaggcacctccgagggcgcgccaggccggccccagctgttggcaccgctctccttccagaaccctgtgtaccagatggcggctggcctgccgctgtcaccccgtggccttggcgactcaggctctgagggccacagctccctgagctcacacagcaacagcgaggagttggcggctgctgccaagctgggaagtttcagcactgccgcggaggagctggctcggcggcccggtgagctggcacggcgacagatgtcactgactgaaaaaggcgggcagcccacggtgccacggcagaacagtgctggcccccagaggaggatcgaccagcctccgcccccacccccgccgccacctcctgccccccgcggccggacgccccccaacctgctgagcaccctgcagtacccaagaccctcaagcggaaccctggcgtcggcctcacctgattgggtgggccccagtacccgcctgaggcagcagtcctcttcctccaagggggacagcccagaactgaagccacgggcagtgcacaagcagggcccttcacctgtgagccccaatgccctggaccgcacagccgcttggctcttgaccatgaacgcgcagttgttagaagacgagggcctgggcccagaccccccccacagggataggctaaggagtaaggacgagctcagccaagcagaaaaggacctggcggtgctgcaggacaagctgcgaatctccaccaagaagctggaggagtatgagaccctgttcaagtgccaggaggagacgacgcagaagctggtgctggagtaccaggcacggctggaggagggcgaggagcggctgcggcggcagcaggaggacaaggacatccagatgaagggcatcatcagcaggttgatgtccgtggaggaagaactgaagaaggaccacgcagagatgcaagcggctgtggactccaaacagaagatcattgatgcccaggagaagcgcattgcctcgttggatgccgccaatgcccgcctcatgagtgccctgacccagctgaaagagagtatgcattagaaacaaaagcccgcttgctcgcttgctggaacacaggggccttttaagttgagcgtgcgcactgcatgggaaatagcggccctggaggatgttagacttgctccctctccaagacagcagcagcctgcacctgccccgtgtgtgtggccggcctcctcctcacccttcccggcccccggccaaggacccaggcgctgcatacaggggaggggcgcaccccacagctggggccggttttcctcagctctaggctgttctgtagcttatctgcccctcccccactttcaagacagatgagcaggagcttgggtctctctcggcccctgtctgttcccagcccctgcagattctgagcaaaggccctgggtaagaagggtgggagtggggcctttgccagcagagccagggcagggcgagctgcaggaatcacccctctgcccctgcagctggaatgtgccacagaggccccacctgaagggtggatgtgctggaggggtggcccagagccatactgcgtccaccctgagctcggggacaggtgacagtggctgctctgggaaggggcttttagatgtaacctacaattcagttaggctagagacagatgctggtggaggaagggctgggccaccagggatcacagaccacaggaagatgggaggtggaagcagaggccctgcccccaccccttcctgtctcactcttctgtcttgtccccacccatgcgccttcgtgcctgagaccagggtggccacacaggcagggcctggctccagtctcatcctcccattgcccagtgagccctgctcttctctccccagccccctcccaccgctgcctcgtagagtgacctcggacagagcccccctagcaatacagggaggctcccggggcctggacaggcgggctcggaggctacccgctgtggccggtgccagctgcccttgcagggtgggtgagctctcaggccgagagccttatttacctagtgcaaaaactgtaaaagtgtacagactcttcacagatttttatcttaattgcaagtctgccgattttgtaaatgttcttggtgtttgactgtaatgtaactatctcacctaatggttgtacatatcctttggtcctggtgctgccgagggctggccgggactgctgctctcccaagggttttattttatttctgaatctagagaacagtattgggcaggaggaaaaggcttggtgtctgcggggggtgtcttccctgcctgtggcatttgtgtgttggctttgcagctgctgtctgagtagtggccactggggtgccttcactgggccagtcaacggggggctcctgcccaggccacagagaacctgagttcccgggagctgggccctgcctgcagccagggctggggttgccagaggccctggagggaaggacagtccctgctggggaagaacagccccggggccccctggtcaccgagactcagcctctgctggagaaagccacgccctccctgctagcacagaggcctgactgacttttttgcttaacttccatgttctgggtgatggaaactgccaaacctcctgtcagtgaggactctttccgactgcccagaaagtgggggtggaggaccgaggctacagctccacacgccccggtcccccagagcatctgccccaggtacacctccccctgcgccccgcacgactgcgggagccagactgtccagggaaacagcctctctcttttctacacactcagccacaaagccccccagctcccacaccgcgtcccagctcccctcttttgtaagtatgtgaaaaggaaaaaatgcaaacgttggagtttgggctggagctcctccctccagctgcgacttttaactatgtaataatgtacagaggaagctgttggtgttctaagactctgtgtggctgtgcaatttctgtacatttgcaattagaaatattaaagatttatttagctatttt

SEQ ID NO: 1295 - DNA, 3500 bp, Homo sapiens
tgttcctcttctttcgtgttgtgtcagaagccatgatttccagtcttctcatctggaagatgaaggaaaagatagacccgaccccacagggttctgaggctcaaactgaaagcctggtggtggggcacctgtgacaggtcccatctgatgccgaggctgaaggagtctcgctcccacgagtccctgctcagccccagcagtgcggtggaggcgctggacctcagcatggaggaagaggtggtcatcaagcccgtgcacagcagcatccttggccaggactactgcttcgaggtgacgacgtcatcaggaagcaagtgcttttcctgccggtctgcagctgagcgggataagtggatggagaacctccggcgagcggtgcatcccaacaaggacaacagccggcgtgtggagcacatcctgaagctgtgggtgatcgaggccaaggacctgccagccaagaagaagtacctgtgcgagctgtgcctggacgatgtgctctatgcccgcaccacgggcaagctcaagacggacaatgttttctggggcgagcacttcgagttccacaacttgccgcctctgcgcacggtcactgtccacctgtaccgggagaccgacaagaagaagaagaaggagcgcaacagttacctgggcctggtgagcctacctgctgcctcggtggccgggcggcagttcgtggagaagtggtacccggtggtgacgcccaaccccaagggcggcaagggccctggacccatgatccgcatcaaggcgcgctaccaaaccatcaccatcctgcccatggagatgtacaaagagttcgctgagcacatcaccaaccactacctggggctgtgtgcagccctcgagcccatcctcagtgccaagaccaaggaggagatggcatctgccctggtgcacatcctgcagagcacgggcaaggtgaaggacttcctgacagacctgatgatgtcagaggtggaccgctgcggggacaacgagcacctcatcttccgggagaacacactggccaccaaggccattgaggagtacctcaagctagtgggccagaagtacctgcaggacgccctaggtgagttcatcaaagcgctgtatgagtcagatgagaactgcgaagtggatcccagcaagtgctcggccgctgacctcccagagcaccagggcaacctcaagatgtgctgcgagctggccttctgcaagatcatcaactcctactgtgtcttcccacgggagttgaaagaggtgtttgcctcgtggaggcaggagtgcagcagtcgcggccgcccggacatcagtgagcggctcatcagcgcctccctcttcctgcgcttcctctgcccagccatcatgtcgccctcactcttcaacctgctgcaggagtaccctgatgaccgcactgcccgcaccctcaccctcatcgccaaggtcacccagaacctggccaactttgccaaatttggcagcaaggaggaatacatgtccttcatgaaccagttcctagagcatgagtggaccaacatgcagcgcttcctgctggagatctccaaccccgagaccctctccaatacagccggcttcgagggctacatcgacctgggccgcgagctctccagcctgcactcactgctctgggaggccgtcagccagctggagcagagcatagtatccaaactgggacccctgcctcggatcctgagggacgtccacacagcactgagcaccccaggtagcgggcagctcccagggaccaatgacctggcctccacaccgggctctggcagcagcagcatctcagctgggctgcagaagatggtgattgagaacgatctttccggtctgatagatttcacccggttaccgtctccaacccccgaaaacaaggacttgttttttgtcacaaggtcctccggggtccagccctcacctgcccgcagctcgagttactcggaagccaacgagcctgatcttcagatggccaacggtggcaagagcctctccatggtggacctccaggacgcccgcacgctggatggggaggcaggctccccggcgggccccgacgtcctccccacagatgggcaggccgctgcagctcagctggtggccgggtggccggcccgggcaaccccagtgaacctggcagggctggccacggtgcggcgggcaggccagacaccaaccacaccaggcacctccgagggcgcgccaggccggccccagctgttggcaccgctctccttccagaaccctgtgtaccagatggcggctggcctgccgctgtcaccccgtggccttggcgactcaggctctgagggccacagctccctgagctcacacagcaacagcgaggagttggcggctgctgccaagctgggaagtttcagcactgccgcggaggagctggctcggcggcccggtgagctggcacggcgacagatgtcactgactgaaaaaggcgggcagcccacggtgccacggcagaacagtgctggcccccagaggaggatcgaccagcctccgcccccacccccgccgccacctcctgccccccgcggccggacgccccccaacctgctgagcaccctgcagtacccaagaccctcaagcggaaccctggcgtcggcctcacctgattgggtgggccccagtacccgcctgaggcagcagtcctcttcctccaagggggacagcccagaactgaagccacgggcagtgcacaagcagggcccttcacctgtgagccccaatgccctggaccgcacagccgcttggctcttgaccatgaacgcgcagttgttagaagacgagggcctgggcccagaccccccccacagggataggctaaggagtaaggacgagctcagccaagcagaaaaggacctggcggtgctgcaggacaagctgcgaatctccaccaagaagctggaggagtatgagaccctgttcaagtgccaggaggagacgacgcagaagctggtgctggagtaccaggcacggctggaggagggcgaggagcggctgcggcggcagcaggaggacaaggacatccagatgaagggcatcatcagcaggttgatgtccgtggaggaagaactgaagaaggaccacgcagagatgcaagcggctgtggactccaaacagaagatcattgatgcccaggagaagcgcattgcctcgttggatgccgccaatgcccgcctcatgagtgccctgacccagctgaaagagaggtacagcatgcaagcccgtaacggcatctcccccaccaaccccaccaaattgcagattactgagaacggcgagttcagaaacagcagcaattgttaacctgcctgaggagggaggaagctacccaaggagagggggactatggtggccaagggcagggtctcggcctggggaggcacccacggttgcagccccagcgcgggtgtcaggaggccgagcctcccctccctgccgctgtccaggaggcggccgca

SEQ ID NO: 1296 - DNA, 5193 bp, Homo sapiens
agccagcccaagctggaccgcaaccacagcttccgccacatcctgccggggttccggagcgccgccgccgccgccgcggacaatgagaggtcccatctgatgccgaggctgaaggagtctcgctcccacgagtccctgctcagccccagcagtgcggtggaggcgctggacctcagcatggaggaagaggtggtcatcaagcccgtgcacagcagcatccttggccaggactactgcttcgaggtgacgacgtcatcaggaagcaagtgcttttcctgccggtctgcagctgagcgggataagtggatggagaacctccggcgagcggtgcatcccaacaaggacaacagccggcgtgtggagcacatcctgaagctgtgggtgatcgaggccaaggacctgccagccaagaagaagtacctgtgcgagctgtgcctggacgatgtgctctatgcccgcaccacgggcaagctcaagacggacaatgttttctggggcgagcacttcgagttccacaacttgccgcctctgcgcacggtcactgtccacctgtaccgggagaccgacaagaagaagaagaaggagcgcaacagttacctgggcctggtgagcctacctgctgcctcggtggccgggcggcagttcgtggagaagtggtacccggtggtgacgcccaaccccaagggcggcaagggccctggacccatgatccgcatcaaggcgcgctaccaaaccatcaccatcctgcccatggagatgtacaaagagttcgctgagcacatcaccaaccactacctggggctgtgtgcagccctcgagcccatcctcagtgccaagaccaaggaggagatggcatctgccctggtgcacatcctgcagagcacgggcaaggtgaaggacttcctgacagacctgatgatgtcagaggtggaccgctgcggggacaacgagcacctcatcttccgggagaacacactggccaccaaggccattgaggagtacctcaagctagtgggccagaagtacctgcaggacgccctaggtgagttcatcaaagcgctgtatgagtcagatgagaactgcgaagtggatcccagcaagtgctcggccgctgacctcccagagcaccagggcaacctcaagatgtgctgcgagctggccttctgcaagatcatcaactcctactgtgtcttcccacgggagttgaaagaggtgtttgcctcgtggaggcaggagtgcagcagtcgcggccgcccggacatcagtgagcggctcatcagcgcctccctcttcctgcgcttcctctgcccagccatcatgtcgccctcactcttcaacctgctgcaggagtaccctgatgaccgcactgcccgcaccctcaccctcatcgccaaggtcacccagaacctggccaactttgccaaatttggcagcaaggaggaatacatgtccttcatgaaccagttcctagagcatgagtggaccaacatgcagcgcttcctgctggagatctccaaccccgagaccctctccaatacagccggcttcgagggctacatcgacctgggccgcgagctctccagcctgcactcactgctctgggaggccgtcagccagctggagcagagcatagtatccaaactgggacccctgcctcggatcctgagggacgtccacacagcactgagcaccccaggtagcgggcagctcccagggaccaatgacctggcctccacaccgggctctggcagcagcagcatctcagctgggctgcagaagatggtgattgagaacgatctttccggtctgatagatttcacccggttaccgtctccaacccccgaaaacaaggacttgttttttgtcacaaggtcctccggggtccagccctcacctgcccgcagctcgagttactcggaagccaacgagcctgatcttcagatggccaacggtggcaagagcctctccatggtggacctccaggacgcccgcacgctggatggggaggcaggctccccggcgggccccgacgtcctccccacagatgggcaggccgctgcagctcagctggtggccgggtggccggcccgggcaaccccagtgaacctggcagggctggccacggtgcggcgggcaggccagacaccaaccacaccaggcacctccgagggcgcgccaggccggccccagctgttggcaccgctctccttccagaaccctgtgtaccagatggcggctggcctgccgctgtcaccccgtggccttggcgactcaggctctgagggccacagctccctgagctcacacagcaacagcgaggagttggcggctgctgccaagctgggaagtttcagcactgccgcggaggagctggctcggcggcccggtgagctggcacggcgacagatgtcactgactgaaaaaggcgggcagcccacggtgccacggcagaacagtgctggcccccagaggaggatcgaccagcctccgcccccacccccgccgccacctcctgccccccgcggccggacgccccccaacctgctgagcaccctgcagtacccaagaccctcaagcggaaccctggcgtcggcctcacctgattgggtgggccccagtacccgcctgaggcagcagtcctcttcctccaagggggacagcccagaactgaagccacgggcagtgcacaagcagggcccttcacctgtgagccccaatgccctggaccgcacagccgcttggctcttgaccatgaacgcgcagttgttagaagacgagggcctgggcccagaccccccccacagggataggctaaggagtaaggacgagctcagccaagcagaaaaggacctggcggtgctgcaggacaagctgcgaatctccaccaagaagctggaggagtatgagaccctgttcaagtgccaggaggagacgacgcagaagctggtgctggagtaccaggcacggctggaggagggcgaggagcggctgcggcggcagcaggaggacaaggacatccagatgaagggcatcatcagcaggttgatgtccgtggaggaagaactgaagaaggaccacgcagagatgcaagcggctgtggactccaaacagaagatcattgatgcccaggagaagcgcattgcctcgttggatgccgccaatgcccgcctcatgagtgccctgacccagctgaaagagagtatgcattagaaacaaaagcccgcttgctcgcttgctggaacacaggggccttttaagttgagcgtgcgcactgcatgggaaatagcggccctggaggatgttagacttgctccctctccaagacagcagcagcctgcacctgccccgtgtgtgtggccggcctcctcctcacccttcccggcccccggccaaggacccaggcgctgcatacaggggaggggcgcaccccacagctggggccggttttcctcagctctaggctgttctgtagcttatctgcccctcccccactttcaagacagatgagcaggagcttgggtctctctcggcccctgtctgttcccagcccctgcagattctgagcaaaggccctgggtaagaagggtgggagtggggcctttgccagcagagccagggcagggcgagctgcaggaatcacccctctgcccctgcagctggaatgtgccacagaggccccacctgaagggtggatgtgctggaggggtggcccagagccatactgcgtccaccctgagctcggggacaggtgacagtggctgctctgggaaggggcttttagatgtaacctacaattcagttaggctagagacagatgctggtggaggaagggctgggccaccagggatcacagaccacaggaagatgggaggtggaagcagaggccctgcccccaccccttcctgtctcactcttctgtcttgtccccacccatgcgccttcgtgcctgagaccagggtggccacacaggcagggcctggctccagtctcatcctcccattgcccagtgagccctgctcttctctccccagccccctcccaccgctgcctcgtagagtgacctcggacagagcccccctagcaatacagggaggctcccggggcctggacaggcgggctcggaggctacccgctgtggccggtgccagctgcccttgcagggtgggtgagctctcaggccgagagccttatttacctagtgcaaaaactgtaaaagtgtacagactcttcacagatttttatcttaattgcaagtctgccgattttgtaaatgttcttggtgtttgactgtaatgtaactatctcacctaatggttgtacatatcctttggtcctggtgctgccgagggctggccgggactgctgctctcccaagggttttattttatttctgaatctagagaacagtattgggcaggaggaaaaggcttggtgtctgcggggggtgtcttccctgcctgtggcatttgtgtgttggctttgcagctgctgtctgagtagtggccactggggtgccttcactgggccagtcaacggggggctcctgcccaggccacagagaacctgagttcccgggagctgggccctgcctgcagccagggctggggttgccagaggccctggagggaaggacagtccctgctggggaagaacagccccggggccccctggtcaccgagactcagcctctgctggagaaagccacgccctccctgctagcacagaggcctgactgacttttttgcttaacttccatgttctgggtgatggaaactgccaaacctcctgtcagtgaggactctttccgactgcccagaaagtgggggtggaggaccgaggctacagctccacacgccccggtcccccagagcatctgccccaggtacacctccccctgcgccccgcacgactgcgggagccagactgtccagggaaacagcctctctcttttctacacactcagccacaaagccccccagctcccacaccgcgtcccagctcccctcttttgtaagtatgtgaaaaggaaaaaatgcaaacgttggagtttgggctggagctcctccctccagctgcgacttttaactatgtaataatgtacagaggaagctgttggtgttctaagactctgtgtggctgtgcaatttctgtacatttgcaattagaaatattaaagatttatttagctatttt

SEQ ID NO: 1297 - DNA, 1006 bp, Homo sapiens
tgcttgcaggaatacccagtcatctagttggaaaagccgccagatggaatacaaaaggaggaacccagacgctcatggagacagcctcggttcataaatcaggtggggccaggggctgggggcccacacgccatggagcccgactcccttctggaccaagacgactcctacgagtcgcctcaagaaaggccgggctctcggcgcagcctgcctggcagcctttccgagaagagccccagcatggagccctcggccgccacgccgttccgggtcacgggcttcctcagccgccgcctcaagggctccatcaagcgcaccaagagccagcccaagctggaccgcaaccacagcttccgccacatcctgccggggttccggagcgccgccgccgccgccgcggacaatgagaggtcccatctgatgccgaggctgaaggagtctcgctcccacgagtccctgctcagccccagcagtgcggtggaggcgctggacctcagcatggaggaagaggtggtcatcaagcccgtgcacagcagcatccttggccaggactactgcttcgaggtgacgacgtcatcaggaagcaagtgcttttcctgccggtctgcagctgagcgggataagtggatggagaacctccggcgagcggtgcatcccaacaaggacaacagccggcgtgtggagcacatcctgaagctgtgggtgatcgaggccaaggacctgccagccaagaagaagtacctgtgcgagctgtgcctggacgatgtgctctatgcccgcaccacgggcaagctcaagacggacaatgttttctggggcgagcacttcgagttccacaacttgccgcctctgcgcacggtcactgtccacctgtaccgggagaccgacaagaagaagaagaaggagcgcaacagttacctgggcctggtgagcctacctgctgcctcggtggccgggcggcagttcgtggagaagtggtacccggtggtgacgcccaaccccaagg

SEQ ID NO: 1298 - DNA, 6784 bp, Homo sapiens
gggagcgggagggggcaggaggcggaggaggagtttgagcgactttgtggggcagccagggcctcggcggccgctcgggcgagcgcgggagaacgcgtgggcgcccgccgggctgtccggagcggccgatggggcccgtgtgagcgcgcccaggcccggcccggtgcccggcgggcggcagcatgtccgcgggcggcagcgccaggaagagcaccgggaggtcctcctactactaccggctgctgaggcggccccggctgcagcgacagaggagccgctcccgcagccggacccggcctgccagggagtcgcctcaagaaaggccgggctctcggcgcagcctgcctggcagcctttccgagaagagccccagcatggagccctcggccgccacgccgttccgggtcacgggcttcctcagccgccgcctcaagggctccatcaagcgcaccaagagccagcccaagctggaccgcaaccacagcttccgccacatcctgccggggttccggagcgccgccgccgccgccgcggacaatgagaggtcccatctgatgccgaggctgaaggagtctcgctcccacgagtccctgctcagccccagcagtgcggtggaggcgctggacctcagcatggaggaagaggtggtcatcaagcccgtgcacagcagcatccttggccaggactactgcttcgaggtgacgacgtcatcaggaagcaagtgcttttcctgccggtctgcagctgagcgggataagtggatggagaacctccggcgagcggtgcatcccaacaaggacaacagccggcgtgtggagcacatcctgaagctgtgggtgatcgaggccaaggacctgccagccaagaagaagtacctgtgcgagctgtgcctggacgatgtgctctatgcccgcaccacgggcaagctcaagacggacaatgttttctggggcgagcacttcgagttccacaacttgccgcctctgcgcacggtcactgtccacctgtaccgggagaccgacaagaagaagaagaaggagcgcaacagttacctgggcctggtgagcctacctgctgcctcggtggccgggcggcagttcgtggagaagtggtacccggtggtgacgcccaaccccaagggcggcaagggccctggacccatgatccgcatcaaggcgcgctaccaaaccatcaccatcctgcccatggagatgtacaaagagttcgctgagcacatcaccaaccactacctggggctgtgtgcagccctcgagcccatcctcagtgccaagaccaaggaggagatggcatctgccctggtgcacatcctgcagagcacgggcaaggtgaaggacttcctgacagacctgatgatgtcagaggtggaccgctgcggggacaacgagcacctcatcttccgggagaacacactggccaccaaggccattgaggagtacctcaagctagtgggccagaagtacctgcaggacgccctaggtgagttcatcaaagcgctgtatgagtcagatgagaactgcgaagtggatcccagcaagtgctcggccgctgacctcccagagcaccagggcaacctcaagatgtgctgcgagctggccttctgcaagatcatcaactcctactgtgtcttcccacgggagttgaaagaggtgtttgcctcgtggaggcaggagtgcagcagtcgcggccgcccggacatcagtgagcggctcatcagcgcctccctcttcctgcgcttcctctgcccagccatcatgtcgccctcactcttcaacctgctgcaggagtaccctgatgaccgcactgcccgcaccctcaccctcatcgccaaggtcacccagaacctggccaactttgccaaatttggcagcaaggaggaatacatgtccttcatgaaccagttcctagagcatgagtggaccaacatgcagcgcttcctgctggagatctccaaccccgagaccctctccaatacagccggcttcgagggctacatcgacctgggccgcgagctctccagcctgcactcactgctctgggaggccgtcagccagctggagcagagcatagtatccaaactgggacccctgcctcggatcctgagggacgtccacacagcactgagcaccccaggtagcgggcagctcccagggaccaatgacctggcctccacaccgggctctggcagcagcagcatctcagctgggctgcagaagatggtgattgagaacgatctttccggtctgatagatttcacccggttaccgtctccaacccccgaaaacaaggacttgttttttgtcacaaggtcctccggggtccagccctcacctgcccgcagctcgagttactcggaagccaacgagcctgatcttcagatggccaacggtggcaagagcctctccatggtggacctccaggacgcccgcacgctggatggggaggcaggctccccggcgggccccgacgtcctccccacagatgggcaggccgctgcagctcagctggtggccgggtggccggcccgggcaaccccagtgaacctggcagggctggccacggtgcggcgggcaggccagacaccaaccacaccaggcacctccgagggcgcgccaggccggccccagctgttggcaccgctctccttccagaaccctgtgtaccagatggcggctggcctgccgctgtcaccccgtggccttggcgactcaggctctgagggccacagctccctgagctcacacagcaacagcgaggagttggcggctgctgccaagctgggaagtttcagcactgccgcggaggagctggctcggcggcccggtgagctggcacggcgacagatgtcactgactgaaaaaggcgggcagcccacggtgccacggcagaacagtgctggcccccagaggaggatcgaccagcctccgcccccacccccgccgccacctcctgccccccgcggccggacgccccccaacctgctgagcaccctgcagtacccaagaccctcaagcggaaccctggcgtcggcctcacctgattgggtgggccccagtacccgcctgaggcagcagtcctcttcctccaagggggacagcccagaactgaagccacgggcagtgcacaagcagggcccttcacctgtgagccccaatgccctggaccgcacagccgcttggctcttgaccatgaacgcgcagttgttagaagacgagggcctgggcccagaccccccccacagggataggctaaggagtaaggacgagctcagccaagcagaaaaggacctggcggtgctgcaggacaagctgcgaatctccaccaagaagctggaggagtatgagaccctgttcaagtgccaggaggagacgacgcagaagctggtgctggagtaccaggcacggctggaggagggcgaggagcggctgcggcggcagcaggaggacaaggacatccagatgaagggcatcatcagcaggttgatgtccgtggaggaagaactgaagaaggaccacgcagagatgcaagcggctgtggactccaaacagaagatcattgatgcccaggagaagcgcattgcctcgttggatgccgccaatgcccgcctcatgagtgccctgacccagctgaaagagaggtacagcatgcaagcccgtaacggcatctcccccaccaaccccaccaaattgcagattactgagaacggcgagttcagaaacagcagcaattgttaacctgcctgaggagggaggaagctacccaaggagagggggactatggtggccaagggcagggtctcggcctggggaggcacccacggttgcagccccagcgcgggtgtcaggaggccgagcctcccctccctgccgctgtccaggaggcggccgcagagggagccaccagagactgaagcagcgtgaggcgaggtcaccagccgctccctgtggggtgcgggcagaagagactgcacgctggggagtggggacagcctgatggggcagggggcctgccaaaaatatgtctgttggttcctgaatgtggtgtgtccttgtcctcctggatctggccgagtgcatgtgtccccccacacctgtgccagggagggggcttcctggaggggggattcaagggctaggggcctacacctgtggcttcccctcgcctccttggggggcccgggactccctggcagccaggccctgtcatgtgggacctggcacttggcagatcagttggcaggcaggaagataggaggacacagagcaggaggtcagtgtcccctgcctgtctccatccgaagcacctgccactgcatgcagcctgttgggaccttcctggctgtgaggaactgaggattcctacccacccaccccctctgaacctgtccccagagcaccacctgctaccttcttccctgccttagttgtattgccagatagacccagtgagggccatggctttttcttgtgagctcttgtccctgtggggaggacccacagcttcccacacctcccacacaggcccaggctgatgctctagggctcccagaagccagagatctgggcggatctggccagatggctctgagcactgtatctgccttctcctggggcccagcacacccagggcacagtggtcctgtagggagtgccacctggtgctcaccctgaaagaaaaggtgatccttcctctgagtgatggtttaaaaaaagattctaacgcctgcaggccctgagaaggtggataactgtgattttttttcctttcacagtatgcattagaaacaaaagcccgcttgctcgcttgctggaacacaggggccttttaagttgagcgtgcgcactgcatgggaaatagcggccctggaggatgttagacttgctccctctccaagacagcagcagcctgcacctgccccgtgtgtgtggccggcctcctcctcacccttcccggcccccggccaaggacccaggcgctgcatacaggggaggggcgcaccccacagctggggccggttttcctcagctctaggctgttctgtagcttatctgcccctcccccactttcaagacagatgagcaggagcttgggtctctctcggcccctgtctgttcccagcccctgcagattctgagcaaaggccctgggtaagaagggtgggagtggggcctttgccagcagagccagggcagggcgagctgcaggaatcacccctctgcccctgcagctggaatgtgccacagaggccccacctgaagggtggatgtgctggaggggtggcccagagccatactgcgtccaccctgagctcggggacaggtgacagtggctgctctgggaaggggcttttagatgtaacctacaattcagttaggctagagacagatgctggtggaggaagggctgggccaccagggatcacagaccacaggaagatgggaggtggaagcagaggccctgcccccaccccttcctgtctcactcttctgtcttgtccccacccatgcgccttcgtgcctgagaccagggtggccacacaggcagggcctggctccagtctcatcctcccattgcccagtgagccctgctcttctctccccagccccctcccaccgctgcctcgtagagtgacctcggacagagcccccctagcaatacagggaggctcccggggcctggacaggcgggctcggaggctacccgctgtggccggtgccagctgcccttgcagggtgggtgagctctcaggccgagagccttatttacctagtgcaaaaactgtaaaagtgtacagactcttcacagatttttatcttaattgcaagtctgccgattttgtaaatgttcttggtgtttgactgtaatgtaactatctcacctaatggttgtacatatcctttggtcctggtgctgccgagggctggccgggactgctgctctcccaagggttttattttatttctgaatctagagaacagtattgggcaggaggaaaaggcttggtgtctgcggggggtgtcttccctgcctgtggcatttgtgtgttggctttgcagctgctgtctgagtagtggccactggggtgccttcactgggccagtcaacggggggctcctgcccaggccacagagaacctgagttcccgggagctgggccctgcctgcagccagggctggggttgccagaggccctggagggaaggacagtccctgctggggaagaacagccccggggccccctggtcaccgagactcagcctctgctggagaaagccacgccctccctgctagcacagaggcctgactgacttttttgcttaacttccatgttctgggtgatggaaactgccaaacctcctgtcagtgaggactctttccgactgcccagaaagtgggggtggaggaccgaggctacagctccacacgccccggtcccccagagcatctgccccaggtacacctccccctgcgccccgcacgactgcgggagccagactgtccagggaaacagcctctctcttttctacacactcagccacaaagccccccagctcccacaccgcgtcccagctcccctcttttgtaagtatgtgaaaaggaaaaaatgcaaacgttggagtttgggctggagctcctccctccagctgcgacttttaactatgtaataatgtacagaggaagctgttggtgttctaagactctgtgtggctgtgcaatttctgtacatttgcaattagaaatattaaagatttatttagctattttaa

SEQ ID NO: 1299 - DNA, 928 bp, Homo sapiens
ggaatacaaaaggaggaacccagacgctcatggagacagcctcggttcataaatcaggtggggccaggggctgggggcccacacgccatggagcccgactcccttctggaccaagacgactcctacgagtcgcctcaagaaaggccgggctctcggcgcagcctgcctggcagcctttccgagaagagccccagcatggagccctcggccgccacgccgttccgggtcacggtcccatctgatgccgaggctgaaggagtctcgctcccacgagtccctgctcagccccagcagtgcggtggaggcgctggacctcagcatggaggaagaggtggtcatcaagcccgtgcacagcagcatccttggccaggactactgcttcgaggtgacgacgtcatcaggaagcaagtgcttttcctgccggtctgcagctgagcgggataagtggatggagaacctccggcgagcggtgcatcccaacaaggacaacagccggcgtgtggagcacatcctgaagctgtgggtgatcgaggccaaggacctgccagccaagaagaagtacctgtgcgagctgtgcctggacgatgtgctctatgcccgcaccacgggcaagctcaagacggacaatgttttctggggcgagcacttcgagttccacaacttgccgcctctgcgcacggtcactgtccacctgtaccgggagaccgacaagaagaagaagaaggagcgcaacagttacctgggcctggtgagcctacctgctgcctcggtggccgggcggcagttcgtggagaagtggtacccggtggtgacgcccaaccccaagggcggcaagggccctggacccatgatccgcatcaaggcgcgctaccaaaccatcaccatcctgcccatggagatgtacaaagagttcgctgagcacatcacc

SEQ ID NO: 1300 - DNA, 4506 bp, Homo sapiens
gggagtctgcgggcgagctcggaggacactggcgcacctcccccgccggctcacggccgcatccgccacatccgaaggcgccgcgacttcccggagaccccgaagcgtgcgctctcatccgggtcctgcgggcgctggcggaaagaggcgaggcggtgcctccgggggcggggcctccttcggttggcggcctcgggcttcgggagtcctccaagaggccaggtgaggccgtcccgtgatgccccgcgccccggccgctctggcctgcaacgtgtctctggggcggaggcagcggcagtggagttcgctgcgcgctgttgggggccacctgtcttttcgcttgtgtccctctttctagtgtcgcgctcgagtcccgacgggccgctccaagcctcgacatgtcgtacaactacgtggtaacggcccagaagcccaccgccgtgaacggctgcgtgaccggacactttacttcggccgaagacttaaacctgttgattgccaaaaacacgagattagagatctatgtggtcaccgccgaggggcttcggcccgtcaaagaggtgggcatgtatgggaagattgcggtcatggagcttttcaggcccaagggggagagcaaggacctgctgtttatcttgacagcgaagtacaatgcctgcatcctggagtataaacagagtggcgagagcattgacatcattacgcgagcccatggcaatgtccaggaccgcattggccgcccctcagagaccggcattattggcatcattgaccctgagtgccggatgattggcctgcgtctctatgatggccttttcaaggttattccactagatcgcgataataaagaactcaaggccttcaacatccgcctggaggagctgcatgtcattgatgtcaagttcctatatggttgccaagcacctactatttgctttgtctaccaggaccctcaggggcggcacgtaaaaacctatgaggtgtctctccgagaaaaggaattcaataagggcccttggaaacaggaaaatgtcgaagctgaagcttccatggtgatcgcagtcccagagccctttgggggggccatcatcattggacaggagtcaatcacctatcacaatggtgacaaatacctggctattgcccctcctatcatcaagcaaagcacgattgtgtgccacaatcgagtggaccctaatggctcaagatacctgctgggagacatggaaggccggctcttcatgctgcttttggagaaggaggaacagatggatggcaccgtcactctcaaggatctccgtgtagaactccttggagagacctctattgctgagtgcttgacataccttgataatggtgttgtgtttgtcgggtctcgcctgggtgactcccagcttgtgaagctcaacgttgacagtaatgaacaaggctcctatgtagtggccatggaaacctttaccaacttaggacccattgtcgatatgtgcgtggtggacctggagaggcaggggcaggggcagctggtcacttgctctggggctttcaaggaaggttctttgcggatcatccggaatggaattggaatccacgagcatgccagcattgacttaccaggcatcaaaggattatggccactgcggtctgaccctaatcgtgagactgatgacactttggtgctctcttttgtgggccagacaagagttctcatgttaaatggagaggaggtagaagaaaccgaactgatgggtttcgtggatgatcagcagactttcttctgtggcaacgtggctcatcagcagcttatccagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggtggagagatcattcctcgctccatcctgatgaccacctttgagagtagccattacctcctttgtgccttgggagatggagcgcttttctactttgggctcaacattgagacaggtctgttgagcgaccgtaagaaggtgactttgggcacccagcccaccgtattgaggacttttcgttctctttctaccaccaacgtctttgcttgttctgaccgccccactgtcatctatagcagcaaccacaaattggtcttctcaaatgtcaacctcaaggaagtgaactacatgtgtcccctcaattcagatggctatcctgacagcctggcgctggccaacaatagcaccctcaccattggcaccatcgatgagatccagaagctgcacattcgcacagttcccctctatgagtctccaaggaagatctgctaccaggaagtgtcccagtgtttcggggtcctctccagccgcattgaagtccaagacacgagtgggggcacgacagccttgaggcccagcgctagcacccaggctctgtccagcagtgtaagctccagcaagctgttctccagcagcactgctcctcatgagacctcctttggagaagaggtggaggtgcacaacctacttatcattgaccaacacacctttgaagtgcttcatgcccaccagtttctgcagaatgaatatgccctcagtctggtttcctgcaagctgggcaaagaccccaacacttacttcattgtgggcacagcaatggtgtatcctgaagaggcagagcccaagcagggtcgcattgtggtctttcagtattcggatggaaaactacagactgtggctgaaaaggaagtgaaaggggccgtgtactctatggtggaatttaacgggaagctgttagccagcatcaatagcacggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaattttctgggggctgaaaatgcctttaacttgtttgtgtgtcaaaaggatagcgctgccaccactgacgaggagcggcagcacctccaggaggttggtcttttccacctgggcgagtttgtcaatgtcttttgccacggctctctggtaatgcagaatctgggtgagacttccacccccacacaaggctcggtgctcttcggcacggtcaacggcatgatagggctggtgacctcactgtcagagagctggtacaacctcctgctggacatgcagaatcgactcaataaagtcatcaaaagtgtggggaagatcgagcactccttctggagatcctttcacaccgagcggaagacagaaccagccacaggtttcatcgacggtgacttgattgagagtttcctggatattagccgccccaagatgcaggaggtggtggcaaacctacagtatgacgatggcagcggtatgaagcgagaggccactgcagacgacctcatcaaggttgtggaggagctaactcggatccattagccaagggcagggggcccctttgctgaccctccccaaaggctttgccctgctgccctccccctcctctccaccatcgtcttcttggccatgggaggcctttccctaagccagctgcccccagagccacagttcccctatgtggaagtggggcgggcttcatagagacttgggaatgagctgaaggtgaaacattttctccctggatttttaccagtctcacatgattccagccatcaccttagaccaccaagccttgattggtgttgccagttgtcctccttccggggaaggattttgcagttctttggctgaaaggaagctgtgcgtgtgtgtgtgtgtatgtgtgtgtgtgtatgtgtatctcacactcatgcattgtcctctttttatttagattggcagtgtagggagttgtgggtagtggggaagagggttaggagggtttcattgtctgtgaagtgagaccttccttttacttttcttctattgcctctgagagcatcaggcctagaggcctgactgccaagccatgggtagcctgggtgtaaaacctggagatggtggatgatccccacgccacagcccttttgtctctgcaaactgccttcttcggaaagaagaaggtgggaggatgtgaattgttagtttctgagttttaccaaataaagtagaatataagaagaaa

SEQ ID NO: 1301 - DNA, 1801 bp, Homo sapiens
gctgttgggggccacctgtcttttcgcttgtgtccctctttctagtgtcgcgctcgagtcccgacgggccgctccaagcctcgacatgtcgtacaactacgtggtaacggcccagaagcccaccgccgtgaacggctgcgtgaccggacactttacttcggccgaagacttaaacctgttgattgccaaaaacacgagattagagatctatgtggtcaccgccgaggggcttcggcccgtcaaagaggtgggcatgtatgggaagattgcggtcatggagcttttcaggcccaaggctctgtccagcagtgtaagctccagcaagctgttctccagcagcactgctcctcatgagacctcctttggagaagaggtggaggtgcacaacctacttatcattgaccaacacacctttgaagtgcttcatgcccaccagtttctgcagaatgaatatgccctcagtctggtttcctgcaagctgggcaaagaccccaacacttacttcattgtgggcacagcaatggtgtatcctgaagaggcagagcccaagcagggtcgcattgtggtctttcagtattcggatggaaaactacagactgtggctgaaaaggaagtgaaaggggccgtgtactctatggtggaatttaacgggaagctgttagccagcatcaatagcacggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaattttctgggggctgaaaatgcctttaacttgtttgtgtgtcaaaaggatagcgctgccaccactgacgaggagcggcagcacctccaggaggttggtcttttccacctgggcgagtttgtcaatgtcttttgccacggctctctggtaatgcagaatctgggtgagacttccacccccacacaaggctcggtgctcttcggcacggtcaacggcatgatagggctggtgacctcactgtcagagagctggtacaacctcctgctggacatgcagaatcgactcaataaagtcatcaaaagtgtggggaagatcgagcactccttctggagatcctttcacaccgagcggaagacagaaccagccacaggtttcatcgacggtgacttgattgagagtttcctggatattagccgccccaagatgcaggaggtggtggcaaacctacagtatgacgatggcagcggtatgaagcgagaggccactgcagacgacctcatcaaggttgtggaggagctaactcggatccattagccaagggcagggggcccctttgctgaccctccccaaaggctttgccctgctgccctccccctcctctccaccatcgtcttcttggccatgggaggcctttccctaagccagctgcccccagagccacagttcccctatgtggaagtggggcgggcttcatagagacttgggaatgagctgaaggtgaaacattttctccctggatttttaccagtctcacatgattccagccatcaccttagaccaccaagccttgattggtgttgccagttgtcctccttccggggaaggattttgcagttctttggctgaaaggaagctgtgcgtgtgtgtgtgtgtatgtgtgtgtgtgtatgtgta

SEQ ID NO: 1302 - DNA, 558 bp, Homo sapiens
aagaggcgaggcggtgcctccgggggcggggcctccttcggttggcggcctcgggcttcgggagtcctccaagaggccagtgtcgcgctcgagtcccgacgggccgctccaagcctcgacatgtcgtacaactacgtggtaacggcccagaagcccaccgccgtgaacggctgcgtgaccggacactttacttcggccgaagacttaaacctgttgattgccaaaaacacgagattagagatctatgtggtcaccgccgaggggcttcggcccgtcaaagaggtgggcatgtatgggaagattgcggtcatggagcttttcaggcccaagggggagagcaaggacctgctgtttatcttgacagcgaagtacaatgcctgcatcctggagtataaacagagtggcgagagcattgacatcattacgcgagcccatggcaatgtccaggaccgcattggccgcccctcagagaccggcattattggcatcattgaccctgagtgccggatgattggcctgcgtctctatgatggccttttcaaggttattccactagat

SEQ ID NO: 1303 - DNA, 540 bp, Homo sapiens
ctggaggctgcagggctgacggctctcctggctcattaaggttccctacggagaaatactggttttgtgtttgaggttcgaatttgtagagcaataggggcactaataacgttgggcaagcagaccggtgggccctttgaagtctgaagaatcaacgcgcaaaagggaggagtgtcgcgctcgagtcccgacgggccgctccaagcctcgacatgtcgtacaactacgtggtaacggcccagaagcccaccgccgtgaacggctgcgtgaccggacactttacttcggccgaagacttaaacctgttgattgccaaaaacacgagattagagatctatgtggtcaccgccgaggggcttcggcccgtcaaagaggtgggcatgtatgggaagattgcggtcatggagcttttcaggcccaagggggagagcaaggacctgctgtttatcttgacagcgaagtacaatgcctgcatcctggagtataaacagagtggcgagagcattgacatcattacgcgagcccatggcaatgtccagg

SEQ ID NO: 1304 - DNA, 1846 bp, Homo sapiens
ctccgagacgggtggggccggagctccaagctggtttgaacaagccctgggcatgtttggcgggaagttggcttagctcggctacctgtggccccgcagttttgtagtccccgccttgtttctccccagaggcctctcaatcctccctccatgatcttcgcatagagcacagtaccccttcacacggaggacgcgatggctcccaagaaacgcccagaaacccagaagacctccgagattgtattacgccccaggaacaagaggagcaggagtcccctggagctggagcccgaggccaagaagctctgtgcgaagggctccggtcctagcagaagatgtgactcagactgcctctgggtggggctggctggcccacagatcctgccaccatgccgcagcatcgtcaggaccctccaccagcataagctgggcagagcttcctggccatctgtccagcaggggctccagcagtcctttttgcacactctggattcttaccggatattacaaaaggctgccccctttgacaggagggctacatccttggcgtggcacccaactcaccccagcactgtggctgtgggttccaaagggggagatatcatgctctggaattttggcatcaaggacaaacccaccttcatcaaagggattggagctggagggagcatcactgggctgaagtttaaccctctcaataccaaccagttttacgcctcctcaatggagggaacaactaggctgcaagactttaaaggcaacattctacgagtttttgccagctcagacaccatcaacatctggttttgtagcctggatgtgtctgctagtagccgaatggtggtcacaggagacaacgtggggaacgtgatcctgctgaacatggacggcaaagagctttggaatctcagaatgcacaaaaagaaagtgacgcatgtggccctgaacccatgctgtgattggttcctggccacagcctccgtagatcaaacagtgaaaatttgggacctgcgccaggttagagggaaagccagcttcctctactcgctgccgcacaggcatcctgtcaacgcagcttgtttcagtcccgatggagcccggctcctgaccacggaccagaagagcgagatccgagtttactctgcttcccagtgggactgccccctgggcctgatcccgcaccctcaccgtcacttccagcacctcacacccatcaaggcagcctggcatcctcgctacaacctcattgttgtgggccgatacccagatcctaatttcaaaagttgtaccccttatgaattgaggacgatcgacgtgttcgatggaaactcagggaagatgatgtgtcagctctatgacccagaatcttctggcatcagttcgcttaatgaattcaatcccatgggggacacgctggcctctgcaatgggttaccacattctcatctggagccaggaggaagccaggacacggaagtgagagacactaaagaaggtgtgggccagacaaggccttggagcccacacatgggatcaagtcctgcaagcagaggtggcgatttgttaaagggccaaaagtatccaaggttagggttggagcaggggtgctgggacctggggcactgtgggactgggacacttttatgttaatgctctggacttgcctccagagactgctccagagttggtgacacagctgtcccaagggcccctctgtatctagcctggaaccaaggttatcttggaactaaatgacttttctcctctcagtgggtggtagcagagggatcaagcagttatttgatttgtgctcacttttgatatggccaataaaaccataccgactg

SEQ ID NO: 1305 - DNA, 1279 bp, Homo sapiens
ctccgagacgggtggggccggagctccaagctggtttgaacaagccctgggcatgtttggcgggaagttggcttagctcggctacctgtggccccgcagttttgtagtccccgccttgtttctccccagaggcctctcaatcctccctccatgatcttcgcatagagcacagtaccccttcacacggaggacgcgatggctcccaagaaacgcccagaaacccagaagacctccgagattgtattacgccccaggaacaagaggagcaggagtcccctggagctggagcccgaggccaagaagctctgtgcgaagggctccggtcctagcagaagatgtgactcagactgcctctgggtggggctggctggcccacagatcctgccaccatgccgcagcatcgtcaggaccctccaccagcataagctgggcagagcttcctggccatctgtccagcaggggctccagcagtcctttttgcacactctggattcttaccggatattacaaaaggctgccccctttgacaggagggctacatccttggcgtggcacccaactcaccccagcactgtggctgtgggttccaaagggggagatatcatgctctggaattttggcatcaaggacaaacccaccttcatcaaaggggcagcctggcatcctcgctacaacctcattgttgtgggccgatacccagatcctaatttcaaaagttgtaccccttatgaattgaggacgatcgacgtgttcgatggaaactcagggaagatgatgtgtcagctctatgacccagaatcttctggcatcagttcgcttaatgaattcaatcccatgggggacacgctggcctctgcaatgggttaccacattctcatctggagccaggaggaagccaggacacggaagtgagagacactaaagaaggtgtgggccagacaaggccttggagcccacacatgggatcaagtcctgcaagcagaggtggcgatttgttaaagggccaaaagtatccaaggttagggttggagcaggggtgctgggacctggggcactgtgggactgggacacttttatgttaatgctctggacttgcctccagagactgctccagagttggtgacacagctgtcccaagggcccctctgtatctagcctggaaccaaggttatcttggaactaaatgacttttctcctctcagtgggtggtagcagagggatcaagcagttatttgatttgtgctcacttttgatatggccaataaaaccataccgactg

SEQ ID NO: 1306 - DNA, 1668 bp, Homo sapiens
ctccgagacgggtggggccggagctccaagctggtttgaacaagccctgggcatgtttggcgggaagttggcttagctcggctacctgtggccccgcagttttgtagtccccgccttgtttctccccagaggcctctcaatcctccctccatgatcttcgcatagagcacagtaccccttcacacggaggacgcgatggctcccaagaaacgcccagaaacccagaagacctccgagattgtattacgccccaggaacaagaggagcaggagtcccctggagctggagcccgaggccaagaagctctgtgcgaagggctccggtcctagcagaagatgtgactcagactgcctctgggtggggctggctggcccacagatcctgccaccatgccgcagcatcgtcaggaccctccaccagcataagctgggcagagcttcctggccatctgtccagcaggggctccagcagtcctttttgcacactctggattcttaccggatattacaaaaggctgccccctttgacaggagggctacatccttggcgtggcacccaactcaccccagcactgtggctgtgggttccaaagggggagatatcatgctctggaattttggcatcaaggacaaacccaccttcatcaaagggattggagctggagggagcatcactgggctgaagtttaaccctctcaataccaaccagttttacgcctcctcaatggagggaacaactaggctgcaagactttaaaggcaacattctacgagtttttgccagctcagacaccatcaacatctggttttgtagcctggatgtgtctgctagtagccgaatggtggtcacaggagacaacgtggggaacgtgatcctgctgaacatggacggcaaagagcttgtttcagtcccgatggagcccggctcctgaccacggaccagaagagcgagatccgagtttactctgcttcccagtgggactgccccctgggcctgatcccgcaccctcaccgtcacttccagcacctcacacccatcaaggcagcctggcatcctcgctacaacctcattgttgtgggccgatacccagatcctaatttcaaaagttgtaccccttatgaattgaggacgatcgacgtgttcgatggaaactcagggaagatgatgtgtcagctctatgacccagaatcttctggcatcagttcgcttaatgaattcaatcccatgggggacacgctggcctctgcaatgggttaccacattctcatctggagccaggaggaagccaggacacggaagtgagagacactaaagaaggtgtgggccagacaaggccttggagcccacacatgggatcaagtcctgcaagcagaggtggcgatttgttaaagggccaaaagtatccaaggttagggttggagcaggggtgctgggacctggggcactgtgggactgggacacttttatgttaatgctctggacttgcctccagagactgctccagagttggtgacacagctgtcccaagggcccctctgtatctagcctggaaccaaggttatcttggaactaaatgacttttctcctctcagtgggtggtagcagagggatcaagcagttatttgatttgtgctcacttttgatatggccaataaaaccataccgactg

SEQ ID NO: 1307 - DNA, 1654 bp, Homo sapiens
ctccgagacgggtggggccggagctccaagctggtttgaacaagccctgggcatgtttggcgggaagttggcttagctcggctacctgtggccccgcagttttgtagtccccgccttgtttctccccagaggcctctcaatcctccctccatgatcttcgcatagagcacagtaccccttcacacggaggacgcgatggctcccaagaaacgcccagaaacccagaagacctccgagattgtattacgccccaggaacaagaggagcaggagtcccctggagctggagcccgaggccaagaagctctgtgcgaagggctccggtcctagcagaagatgtgactcagactgcctctgggtggggctggctggcccacagatcctgccaccatgccgcagcatcgtcaggaccctccaccagcataagctgggcagagcttcctggccatctgtccagcagattggagctggagggagcatcactgggctgaagtttaaccctctcaataccaaccagttttacgcctcctcaatggagggaacaactaggctgcaagactttaaaggcaacattctacgagtttttgccagctcagacaccatcaacatctggttttgtagcctggatgtgtctgctagtagccgaatggtggtcacaggagacaacgtggggaacgtgatcctgctgaacatggacggcaaagagctttggaatctcagaatgcacaaaaagaaagtgacgcatgtggccctgaacccatgctgtgattggttcctggccacagcctccgtagatcaaacagtgaaaatttgggacctgcgccaggttagagggaaagccagcttcctctactcgctgccgcacaggcatcctgtcaacgcagcttgtttcagtcccgatggagcccggctcctgaccacggaccagaagagcgagatccgagtttactctgcttcccagtgggactgccccctgggcctgatcccgcaccctcaccgtcacttccagcacctcacacccatcaaggcagcctggcatcctcgctacaacctcattgttgtgggccgatacccagatcctaatttcaaaagttgtaccccttatgaattgaggacgatcgacgtgttcgatggaaactcagggaagatgatgtgtcagctctatgacccagaatcttctggcatcagttcgcttaatgaattcaatcccatgggggacacgctggcctctgcaatgggttaccacattctcatctggagccaggaggaagccaggacacggaagtgagagacactaaagaaggtgtgggccagacaaggccttggagcccacacatgggatcaagtcctgcaagcagaggtggcgatttgttaaagggccaaaagtatccaaggttagggttggagcaggggtgctgggacctggggcactgtgggactgggacacttttatgttaatgctctggacttgcctccagagactgctccagagttggtgacacagctgtcccaagggcccctctgtatctagcctggaaccaaggttatcttggaactaaatgacttttctcctctcagtgggtggtagcagagggatcaagcagttatttgatttgtgctcacttttgatatggccaataaaaccataccgactg

SEQ ID NO: 1308 - DNA, 3717 bp, Homo sapiens
gttgttccggctgcctttcactgaggggacccgccagtttctaactcagtggcgtttgccctgattcccggggcctggctttcagcgtagcaattctgccggcgaagaaggaagacttcatggcagagctgtaccgggttttggaggctggcaagattgggatatttgagagtccaactggcactgggaagtccttaagtcttatttgtggggccctctcttggctccgtgactttgaacagaagaagcgtgaagaagaggcacgactccttgaaactggaactggccccttacatgatgagaaagatgaatccctgtgtctgtcttcttcctgcgaaggggctgcaggcaccccgaggcctgctggagaaccggcctgggttactcagtttgtgcagaagaaagaagagagggacctggtggaccgactaaaggcggagcaggccaggaggaagcagcgagaagaacgcctgcagcagctgcagcacagggtgcagctcaagtatgcagccaagcgcctgaggcaggaagaagaagaaagagagaatctcctccgcctcagcagggagatgctagagacaggcccggaggctgagcggctggagcagctggagtctggggaggaggagctggtcctcgccgaatacgagagtgatgaggagaaaaaggtggcgagcagagtggatgaggatgaggatgacctggaggaagaacacataactaagatttattactgtagtcggacacactcccagctggcccagtttgtgcatgaggtgaagaagagcccctttggcaaggatgttcggctggtctcccttggctcccggcagaacctttgtgtaaatgaagacgtgaaaagcctaggttctgtgcagcttatcaacgaccgctgtgtggacatgcagagaagcaggcacgagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacgggagccgccttgccatccctgcagcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccagctctgccaggcccattcccagctgctgcagtacgtggagcgatacgggaagcgtttgaaggccaagaacctgatgtacctgaagcagatcctgtatttgctggagaaattcgtggctgtgctaggggggaacattaagcaaaatcccaatacacagagtctgtcacagacagggacggagctgaagaccatcaacgactttctcttccagagccagatcgacaacatcaacctgttcaaggtgcagcgatactgtgagaagagcatgatcagcagaaagctctttggattcactgaacggtacggagcagtgttctcatcccgggagcagcccaaactggctgggtttcagcaattcctgcagagcctgcagcccaggacgactgaagctcttgcagcccctgcagacgagagtcaggccagcaccctgcgaccagcttctccactgatgcacatccaaggcttcctggcagctctcactacggccaaccaggacggcagggtcatcctgagccgccaaggcagcctcagtcagagcaccctgaagtttttgctcctgaatccagctgtgcactttgcccaagtggtgaaggaatgccgggcagtggtcattgcggggggtaccatgcagccggtgtctgacttccggcagcagctgctggcctgtgccggggtggaagctgagcgcgtggtggagttttcctgtggtcacgtgatccctccagacaacatcctgcccctcgtcatctgcagcgggatctccaaccagccgctggaattcacgttccagaaaagagagctgcctcagatgatggacgaggtgggtcgcattctctgtaacctgtgcggtgtggttcctggaggggtggtctgtttcttcccctcctacgagtacctgcgccaggtccatgcccactgggagaagggtggcctgctgggccgtctggctgccaggaagaagatattccaggaacctaagagcgcacaccaggtggagcaggtgctgctggcatattccaggtgcatccaggcctgtggccaggagagaggccaggtgacaggggccctgctcctctctgtggttggaggaaagatgagtgaagggatcaacttctctgacaacctaggccggtgtgtggtgatggtgggcatgcccttccccaacatcaggtctgcagagctgcaggagaagatggcctacttggatcaaaccctccccagagcccccggccaggcacccccagggaaggctctggtggagaacctgtgcatgaaggccgtcaaccagtccataggcagggccatcaggcaccagaaggattttgccagcgtagtgctcctggaccagcgatatgcccggccccctgtcctggccaagctgccggcctggatccgagcccgtgtggaggtcaaagctacctttggccccgccattgctgctgtgcagaagtttcaccgggagaagtcggcctcttcctgatgggcaaccacaccactgcctggcgccgtgcccttcctttgtcctgcccgctggagacagtgtttgtcgtgggcgtggtctgcggggatcctgttacaaaggtgaaacccaggaggagagtgtggagtccagagtgctgccaggacccaggcacaggcgttagctcccgtaggagaaaatgggggaatcctgaatgaacagtgggtcctggctgtccttggggcgttccagggcagctcccctcctggaatagaatctttctttccatcctgcatggctgagagccaggcttccttcctggtctccgcaggaggctgtggcagctgtggcatccactgtggcatctccgtcctgcccaccttcttaagaggcgagatggagcaggcccatctgcctctgccctttctagccaaggttatagctgccctggactgctcactctctggtctcaatttaaaatgatccatggccacagggctcctgcccaggggcttgtcaccttcccctcctccttcctgagtcactccttcagtagaaggccctgctccctatcctgtcccacagccctgcctggatttgtatccttggcttcgtgccagttcctccaagtctatggcacctccctccctctcaaccacttgagcaaactccaagacaccttctaccccaacaccagcaattatgccaagggccgttaggctctcaacatgactatagagaccccgtgtcatcacggagacctttgttcctgtgggaaaatatccctcccacctgcaacagctgcccctgctgactgcgcctgtcttctccctctgaccccagagaaaggggctgtggtcagctgggatcttctgccaccatcagggacaaacgggggcaggaggaaagtcactgatgcccagatgtttgcatcctgcacagctataggtccttaaataaaagtgtgctgttggtt

SEQ ID NO: 1309 - DNA, 4115 bp, Homo sapiens
tgcgcagcggcgggggttgttccggctgcctttcactgaggggacccgccagtttctaactcagtggcgtttgccctgattcccggggcctggctttcagcgtagcaattctgccggcgaagaaggtgagcgcagtgctgtgtggcagcagagctccttaggacgaggagcagcgggacgaggaagggcagactggtgaaatcgcaaactgggcgtctgttccggcgccggacccctatttgcaaaggtccatggctaatgaaacacagaaggttggtgccatccattttccttttcccttcacaccctattccatccaggaagacttcatggcagagctgtaccgggttttggaggctggcaagattgggatatttgagagtccaactggcactgggaagtccttaagtcttatttgtggggccctctcttggctccgtgactttgaacagaagaagcgtgaagaagaggcacgactccttgaaactggaactggccccttacatgatgagaaagatgaatccctgtgtctgtcttcttcctgcgaaggggctgcaggcaccccgaggcctgctggagaaccggcctgggttactcagtttgtgcagaagaaagaagagagggacctggtggaccgactaaaggcggagcaggccaggaggaagcagcgagaagaacgcctgcagcagctgcagcacagggtgcagctcaagtatgcagccaagcgcctgaggcaggaagaagaagaaagagagaatctcctccgcctcagcagggagatgctagagacaggcccggaggctgagcggctggagcagctggagtctggggaggaggagctggtcctcgccgaatacgagagtgatgaggagaaaaaggtggcgagcagggcgccttctgatgccacctccagccgccatccaccagacgccagcttccccgctgccctgaacttcctccagcgcaccaggccttcctctgtcctgtctgaggatttgctcatgcaacgtgctgtggccaaacaccctgccctcctcccttggcagatgtcttcctctcctttaaggcctggctcagagtggatgaggatgaggatgacctggaggaagaacacataactaagatttattactgtagtcggacacactcccagctggcccagtttgtgcatgaggtgaagaagagcccctttggcaaggatgttcggctggtctcccttggctcccggcagaacctttgtgtaaatgaagacgtgaaaagcctaggttctgtgcagcttatcaacgaccgctgtgtggacatgcagagaagcaggcacgagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacgggagccgccttgccatccctgcagcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccagctctgccaggcccattcccagctgctgcagtacgtggagcgatacgggaagcgtttgaaggccaagaacctgatgtacctgaagcagatcctgtatttgctggagaaattcgtggctgtgctaggggggaacattaagcaaaatcccaatacacagagtctgtcacagacagggacggagctgaagaccatcaacgactttctcttccagagccagatcgacaacatcaacctgttcaaggtgcagcgatactgtgagaagagcatgatcagcagaaagctctttggattcactgaacggtacggagcagtgttctcatcccgggagcagcccaaactggctgggtttcagcaattcctgcagagcctgcagcccaggacgactgaagctcttgcagcccctgcagacgagagtcaggccagcaccctgcgaccagcttctccactgatgcacatccaaggcttcctggcagctctcactacggccaaccaggacggcagggtcatcctgagccgccaaggcagcctcagtcagagcaccctgaagtttttgctcctgaatccagctgtgcactttgcccaagtggtgaaggaatgccgggcagtggtcattgcggggggtaccatgcagccggtgtctgacttccggcagcagctgctggcctgtgccggggtggaagctgagcgcgtggtggagttttcctgtggtcacgtgatccctccagacaacatcctgcccctcgtcatctgcagcgggatctccaaccagccgctggaattcacgttccagaaaagagagctgcctcagatgatggacgaggtgggtcgcattctctgtaacctgtgcggtgtggttcctggaggggtggtctgtttcttcccctcctacgagtacctgcgccaggtccatgcccactgggagaagggtggcctgctgggccgtctggctgccaggaagaagatattccaggaacctaagagcgcacaccaggtggagcaggtgctgctggcatattccaggtgcatccaggcctgtggccaggagagaggccaggtgacaggggccctgctcctctctgtggttggaggaaagatgagtgaagggatcaacttctctgacaacctaggccggtgtgtggtgatggtgggcatgcccttccccaacatcaggtctgcagagctgcaggagaagatggcctacttggatcaaaccctccccagagcccccggccaggcacccccagggaaggctctggtggagaacctgtgcatgaaggccgtcaaccagtccataggcagggccatcaggcaccagaaggattttgccagcgtagtgctcctggaccagcgatatgcccggccccctgtcctggccaagctgccggcctggatccgagcccgtgtggaggtcaaagctacctttggccccgccattgctgctgtgcagaagtttcaccgggagaagtcggcctcttcctgatgggcaaccacaccactgcctggcgccgtgcccttcctttgtcctgcccgctggagacagtgtttgtcgtgggcgtggtctgcggggatcctgttacaaaggtgaaacccaggaggagagtgtggagtccagagtgctgccaggacccaggcacaggcgttagctcccgtaggagaaaatgggggaatcctgaatgaacagtgggtcctggctgtccttggggcgttccagggcagctcccctcctggaatagaatctttctttccatcctgcatggctgagagccaggcttccttcctggtctccgcaggaggctgtggcagctgtggcatccactgtggcatctccgtcctgcccaccttcttaagaggcgagatggagcaggcccatctgcctctgccctttctagccaaggttatagctgccctggactgctcactctctggtctcaatttaaaatgatccatggccacagggctcctgcccaggggcttgtcaccttcccctcctccttcctgagtcactccttcagtagaaggccctgctccctatcctgtcccacagccctgcctggatttgtatccttggcttcgtgccagttcctccaagtctatggcacctccctccctctcaaccacttgagcaaactccaagacaccttctaccccaacaccagcaattatgccaagggccgttaggctctcaacatgactatagagaccccgtgtcatcacggagacctttgttcctgtgggaaaatatccctcccacctgcaacagctgcccctgctgactgcgcctgtcttctccctctgaccccagagaaaggggctgtggtcagctgggatcttctgccaccatcagggacaaacgggggcaggaggaaagtcactgatgcccagatgtttgcatcctgcacagctataggtccttaaataaaagtgtgctgttggtt

SEQ ID NO: 1310 - DNA, 3724 bp, Homo sapiens
ttctaactcagtggcgtttgccctgattcccggggcctggctttcagcgtagcaattctgccggcgaagaaggtgagcgcagtgctgtgtggcagcagagctccttaggacgaggagcagcgggacgaggaagggcagactggtgaaatcgcaaactgggcgtctgttccggcgccggacccctatttgcaaaggtccatggctaatgaaacacagaaggttggtgccatccattttccttttcccttcacaccctattccatccaggaagacttcatggcagagctgtaccgggttttggaggctggcaagattgggatatttgagagtccaactggcactgggaagtccttaagtcttatttgtggggccctctcttggctccgtgactttgaacagaagaagcgtgaagaagaggcacgactccttgaaactggaactggccccttacatgatgagaaagatgaatccctgtgtctgtcttcttcctgcgaaggggctgcaggcaccccgaggcctgctggagaaccggcctgggttactcagtttgtgcagaagaaagaagagagggacctggtggaccgactaaaggcggagcaggccaggaggaagcagcgagaagaacgcctgcagcagctgcagcacagggtgcagctcaagtatgcagccaagcgcctgaggcaggaagaagaagaaagagagaatctcctccgcctcagcagggagatgctagagacaggcccggaggctgagcggctggagcagctggagtctggggaggaggagctggtcctcgccgaatacgagagtgatgaggagaaaaaggtggcgagcagagtggatgaggatgaggatgacctggaggaagaacacataactaagatttattactgtagtcggacacactcccagctggcccagtttgtgcatgaggtgaagaagagcccctttggcaaggatgttcggctggtctcccttggctcccggcagaacctttgtgtaaatgaagacgtgaaaagcctaggttctgtgcagcttatcaacgaccgctgtgtggacatgcagagaagcaggcacgagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacgggagccgccttgccatccctgcagcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccagctctgccaggcccattcccagctgctgcagtacgtggagcgatacgggaagcgtttgaaggccaagaacctgatgtacctgaagcagatcctgtatttgctggagaaattcgtggctgtgctaggggggaacattaagcaaaatcccaatacacagagtctgtcacagacagggacggagctgaagaccatcaacgactttctcttccagagccagatcgacaacatcaacctgttcaaggtgcagcgatactgtgagaagagcatgatcagcagaaagctctttggattcactgaacggtacggagcagtgttctcatcccgggagcagcccaaactggctgggtttcagcaattcctgcagagcctgcagcccaggacgactgaagctcttgcagcccctgcagacgagagtcaggccagcaccctgcgaccagcttctccactgatgcacatccaaggcttcctggcagctctcactacggccaaccaggacggcagggtcatcctgagccgccaaggcagcctcagtcagagcaccctgaagtttttgctcctgaatccagctgtgcactttgcccaagtggtgaaggaatgccgggcagtggtcattgcggggggtaccatgcagccggtgtctgacttccggcagcagctgctggcctgtgccggggtggaagctgagcgcgtggtggagttttcctgtggtcacgtgatccctccagacaacatcctgcccctcgtcatctgcagcgggatctccaaccagccgctggaattcacgttccagaaaagagagctgcctcagatgatattccaggaacctaagagcgcacaccaggtggagcaggtgctgctggcatattccaggtgcatccaggcctgtggccaggagagaggccaggtgacaggggccctgctcctctctgtggttggaggaaagatgagtgaagggatcaacttctctgacaacctaggccggtgtgtggtgatggtgggcatgcccttccccaacatcaggtctgcagagctgcaggagaagatggcctacttggatcaaaccctccccagagcccccggccaggcacccccagggaaggctctggtggagaacctgtgcatgaaggccgtcaaccagtccataggcagggccatcaggcaccagaaggattttgccagcgtagtgctcctggaccagcgatatgcccggccccctgtcctggccaagctgccggcctggatccgagcccgtgtggaggtcaaagctacctttggccccgccattgctgctgtgcagaagtttcaccgggagaagtcggcctcttcctgatgggcaaccacaccactgcctggcgccgtgcccttcctttgtcctgcccgctggagacagtgtttgtcgtgggcgtggtctgcggggatcctgttacaaaggtgaaacccaggaggagagtgtggagtccagagtgctgccaggacccaggcacaggcgttagctcccgtaggagaaaatgggggaatcctgaatgaacagtgggtcctggctgtccttggggcgttccagggcagctcccctcctggaatagaatctttctttccatcctgcatggctgagagccaggcttccttcctggtctccgcaggaggctgtggcagctgtggcatccactgtggcatctccgtcctgcccaccttcttaagaggcgagatggagcaggcccatctgcctctgccctttctagccaaggttatagctgccctggactgctcactctctggtctcaatttaaaatgatccatggccacagggctcctgcccaggggcttgtcaccttcccctcctccttcctgagtcactccttcagtagaaggccctgctccctatcctgtcccacagccctgcctggatttgtatccttggcttcgtgccagttcctccaagtctatggcacctccctccctctcaaccacttgagcaaactccaagacaccttctaccccaacaccagcaattatgccaagggccgttaggctctcaacatgactatagagaccccgtgtcatcacggagacctttgttcctgtgggaaaatatccctcccacctgcaacagctgcccctgctgactgcgcctgtcttctccctctgaccccagagaaaggggctgtggtcagctgggatcttctgccaccatcagggacaaacgggggcaggaggaaagtcactgatgcccagatgtttgcatcctgcacagctataggtccttaaataaaagtgtgctgttggtt

SEQ ID NO: 1311 - DNA, 3760 bp, Homo sapiens
tgcgcagcggcgggggttgttccggctgcctttcactgaggggacccgccagtttctaactcagtggcgtttgccctgattcccggggcctggctttcagcgtagcaattctgccggcgaagaaggtgagcgcagtgctgtgtggcagcagagctccttaggacgaggagcagcgggacgaggaagggcagactggtgaaatcgcaaactgggcgtctgttccggcgccggacccctatttgcaaaggtccatggctaatgaaacacagaaggttggtgccatccattttccttttcccttcacaccctattccatccaggaagacttcatggcagagctgtaccgggttttggaggctggcaagattgggatatttgagagtccaactggcactgggaagtccttaagtcttatttgtggggccctctcttggctccgtgactttgaacagaagaagcgtgaagaagaggcacgactccttgaaactggaactggccccttacatgatgagaaagatgaatccctgtgtctgtcttcttcctgcgaaggggctgcaggcaccccgaggcctgctggagaaccggcctgggttactcagtttgtgcagaagaaagaagagagggacctggtggaccgactaaaggcggagcaggccaggaggaagcagcgagaagaacgcctgcagcagctgcagcacagggtgcagctcaagtatgcagccaagcgcctgaggcaggaagaagaagaaagagagaatctcctccgcctcagcagggagatgctagagacaggcccggaggctgagcggctggagcagctggagtctggggaggaggagctggtcctcgccgaatacgagagtgatgaggagaaaaaggtggcgagcagagtggatgaggatgaggatgacctggaggaagaacacataactaagatttattactgtagtcggacacactcccagctggcccagtttgtgcatgaggtgaagaagagcccctttggcaaggatgttcggctggtctcccttggctcccggcagagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacgggagccgccttgccatccctgcagcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccagctctgccaggcccattcccagctgctgcagtacgtggagcgatacgggaagcgtttgaaggccaagaacctgatgtacctgaagcagatcctgtatttgctggagaaattcgtggctgtgctaggggggaacattaagcaaaatcccaatacacagagtctgtcacagacagggacggagctgaagaccatcaacgactttctcttccagagccagatcgacaacatcaacctgttcaaggtgcagcgatactgtgagaagagcatgatcagcagaaagctctttggattcactgaacggtacggagcagtgttctcatcccgggagcagcccaaactggctgggtttcagcaattcctgcagagcctgcagcccaggacgactgaagctcttgcagcccctgcagacgagagtcaggccagcaccctgcgaccagcttctccactgatgcacatccaaggcttcctggcagctctcactacggccaaccaggacggcagggtcatcctgagccgccaaggcagcctcagtcagagcaccctgaagtttttgctcctgaatccagctgtgcactttgcccaagtggtgaaggaatgccgggcagtggtcattgcggggggtaccatgcagccggtgtctgacttccggcagcagctgctggcctgtgccggggtggaagctgagcgcgtggtggagttttcctgtggtcacgtgatccctccagacaacatcctgcccctcgtcatctgcagcgggatctccaaccagccgctggaattcacgttccagaaaagagagctgcctcagatgatggacgaggtgggtcgcattctctgtaacctgtgcggtgtggttcctggaggggtggtctgtttcttcccctcctacgagtacctgcgccaggtccatgcccactgggagaagggtggcctgctgggccgtctggctgccaggaagaagatattccaggaacctaagagcgcacaccaggtggagcaggtgctgctggcatattccaggtgcatccaggcctgtggccaggagagaggccaggtgacaggggccctgctcctctctgtggttggaggaaagatgagtgaagggatcaacttctctgacaacctaggccggtgtgtggtgatggtgggcatgcccttccccaacatcaggtctgcagagctgcaggagaagatggcctacttggatcaaaccctcgcagggccatcaggcaccagaaggattttgccagcgtagtgctcctggaccagcgatatgcccggccccctgtcctggccaagctgccggcctggatccgagcccgtgtggaggtcaaagctacctttggccccgccattgctgctgtgcagaagtttcaccgggagaagtcggcctcttcctgatgggcaaccacaccactgcctggcgccgtgcccttcctttgtcctgcccgctggagacagtgtttgtcgtgggcgtggtctgcggggatcctgttacaaaggtgaaacccaggaggagagtgtggagtccagagtgctgccaggacccaggcacaggcgttagctcccgtaggagaaaatgggggaatcctgaatgaacagtgggtcctggctgtccttggggcgttccagggcagctcccctcctggaatagaatctttctttccatcctgcatggctgagagccaggcttccttcctggtctccgcaggaggctgtggcagctgtggcatccactgtggcatctccgtcctgcccaccttcttaagaggcgagatggagcaggcccatctgcctctgccctttctagccaaggttatagctgccctggactgctcactctctggtctcaatttaaaatgatccatggccacagggctcctgcccaggggcttgtcaccttcccctcctccttcctgagtcactccttcagtagaaggccctgctccctatcctgtcccacagccctgcctggatttgtatccttggcttcgtgccagttcctccaagtctatggcacctccctccctctcaaccacttgagcaaactccaagacaccttctaccccaacaccagcaattatgccaagggccgttaggctctcaacatgactatagagaccccgtgtcatcacggagacctttgttcctgtgggaaaatatccctcccacctgcaacagctgcccctgctgactgcgcctgtcttctccctctgaccccagagaaaggggctgtggtcagctgggatcttctgccaccatcagggacaaacgggggcaggaggaaagtcactgatgcccagatgtttgcatcctgcacagctataggtccttaaataaaagtgtgctgttggtt

SEQ ID NO: 1312 - DNA, 3922 bp, Homo sapiens
tgcgcagcggcgggggttgttccggctgcctttcactgaggggacccgccagtttctaactcagtggcgtttgccctgattcccggggcctggctttcagcgtagcaattctgccggcgaagaaggtgagcgcagtgctgtgtggcagcagagctccttaggacgaggagcagcgggacgaggaagggcagactggtgaaatcgcaaactgggcgtctgttccggcgccggacccctatttgcaaaggtccatggctaatgaaacacagaaggttggtgccatccattttccttttcccttcacaccctattccatccaggaagacttcatggcagagctgtaccgggttttggaggctggcaagattgggatatttgagagtccaactggcactgggaagtccttaagtcttatttgtggggccctctcttggctccgtgactttgaacagaagaagcgtgaagaagaggcacgactccttgaaactggaactggccccttacatgatgagaaagatgaatccctgtgtctgtcttcttcctgcgaaggggctgcaggcaccccgaggcctgctggagaaccggcctgggttactcagtttgtgcagaagaaagaagagagggacctggtggaccgactaaaggcggagcaggccaggaggaagcagcgagaagaacgcctgcagcagctgcagcacagggtgcagctcaagtatgcagccaagcgcctgaggcaggaagaagaagaaagagagaatctcctccgcctcagcagggagatgctagagacaggcccggaggctgagcggctggagcagctggagtctggggaggaggagctggtcctcgccgaatacgagagtgatgaggagaaaaaggtggcgagcagagtggatgaggatgaggatgacctggaggaagaacacataactaagatttattactgtagtcggacacactcccagctggcccagtttgtgcatgaggtgaagaagagcccctttggcaaggatgttcggctggtctcccttggctcccggcagaacctttgtgtaaatgaagacgtgaaaagcctaggttctgtgcagcttatcaacgaccgctgtgtggacatgcagagaagcaggcacgagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacgggagccgccttgccatccctgcagcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccagctctgccaggcccattcccagctgctgcagtacgtggagcgatacgggaagcgtttgaaggccaagaacctgatgtacctgaagcagatcctgtatttgctggagaaattcgtggctgtgctaggggggaacattaagcaaaatcccaatacacagagtctgtcacagacagggacggagctgaagaccatcaacgactttctcttccagagccagatcgacaacatcaacctgttcaaggtgcagcgatactgtgagaagagcatgatcagcagaaagctctttggattcactgaacggtacggagcagtgttctcatcccgggagcagcccaaactggctgggtttcagcaattcctgcagagcctgcagcccaggacgactgaagctcttgcagcccctgcagacgagagtcaggccagcaccctgcgaccagcttctccactgatgcacatccaaggcttcctggcagctctcactacggccaaccaggacggcagggtcatcctgagccgccaaggcagcctcagtcagagcaccctgaagtttttgctcctgaatccagctgtgcactttgcccaagtggtgaaggaatgccgggcagtggtcattgcggggggtaccatgcagccggtgtctgacttccggcagcagctgctggcctgtgccggggtggaagctgagcgcgtggtggagttttcctgtggtcacgtgatccctccagacaacatcctgcccctcgtcatctgcagcgggatctccaaccagccgctggaattcacgttccagaaaagagagctgcctcagatgatggacgaggtgggtcgcattctctgtaacctgtgcggtgtggttcctggaggggtggtctgtttcttcccctcctacgagtacctgcgccaggtccatgcccactgggagaagggtggcctgctgggccgtctggctgccaggaagaagatattccaggaacctaagagcgcacaccaggtggagcaggtgctgctggcatattccaggtgcatccaggcctgtggccaggagagaggccaggtgacaggggccctgctcctctctgtggttggaggaaagatgagtgaagggatcaacttctctgacaacctaggccggtgtgtggtgatggtgggcatgcccttccccaacatcaggtctgcagagctgcaggagaagatggcctacttggatcaaaccctcagcccccggccaggcacccccagggaaggctctggtggagaacctgtgcatgaaggccgtcaaccagtccataggcagggccatcaggcaccagaaggattttgccagcgtagtgctcctggaccagcgatatgcccggccccctgtcctggccaagctgccggcctggatccgagcccgtgtggaggtcaaagctacctttggccccgccattgctgctgtgcagaagtttcaccgggagaagtcggcctcttcctgatgggcaaccacaccactgcctggcgccgtgcccttcctttgtcctgcccgctggagacagtgtttgtcgtgggcgtggtctgcggggatcctgttacaaaggtgaaacccaggaggagagtgtggagtccagagtgctgccaggacccaggcacaggcgttagctcccgtaggagaaaatgggggaatcctgaatgaacagtgggtcctggctgtccttggggcgttccagggcagctcccctcctggaatagaatctttctttccatcctgcatggctgagagccaggcttccttcctggtctccgcaggaggctgtggcagctgtggcatccactgtggcatctccgtcctgcccaccttcttaagaggcgagatggagcaggcccatctgcctctgccctttctagccaaggttatagctgccctggactgctcactctctggtctcaatttaaaatgatccatggccacagggctcctgcccaggggcttgtcaccttcccctcctccttcctgagtcactccttcagtagaaggccctgctccctatcctgtcccacagccctgcctggatttgtatccttggcttcgtgccagttcctccaagtctatggcacctccctccctctcaaccacttgagcaaactccaagacaccttctaccccaacaccagcaattatgccaagggccgttaggctctcaacatgactatagagaccccgtgtcatcacggagacctttgttcctgtgggaaaatatccctcccacctgcaacagctgcccctgctgactgcgcctgtcttctccctctgaccccagagaaaggggctgtggtcagctgggatcttctgccaccatcagggacaaacgggggcaggaggaaagtcactgatgcccagatgtttgcatcctgcacagctataggtccttaaataaaagtgtgctgttggtt

SEQ ID NO: 1313 - DNA, 883 bp, Homo sapiens
gccagtttctaactcagtggcgtttgccctgattcccggggcctggctttcagcgtagcaattctgccggcgaagaaggtgagcgcagtgctgtgtggcagcagagctccttaggacgaggagcagcgggacgaggaagggcagactggtgaaatcgcaaactgggcgtctgttccggcgccggacccctatttgcaaaggaagacttcatggcagagctgtaccgggttttggaggctggcaagattgggatatttgagagtccaactggcactgggaagtccttaagtcttatttgtggggccctctcttggctccgtgactttgaacagaagaagcgtgaagaagaggcacgactccttgaaactggaactggccccttacatgatgagaaagatgaatccctgtgtctgtcttcttcctgcgaaggggctgcaggcaccccgaggcctgctggagaaccggcctgggttactcagtttgtgcagaagaaagaagagagggacctggtggaccgactaaaggcggagcaggccaggaggaagcagcgagaagaacgcctgcagcagctgcagcacagggtgcagctcaagtatgcagccaagcgcctgaggcaggaagaagaagaaagagagaatctcctccgcctcagcagggagatgctagagacaggcccggaggctgagcggctggagcagctggagtctggggaggaggagctggtcctcgccgaatacgagagtgatgaggagaaaaaggtggcgagcagagtggatgaggatgaggatgacctggaggaagaacacataactaagatttattactgtagtcggacacactcccagctggcccagtttgtgcatgaggtgaagaagagcccctt

SEQ ID NO: 1314 - DNA, 3079 bp, Homo sapiens
tgcgcagcggcgggggttgttccggctgcctttcactgaggggacccgccagtttctaactcagtggcgtttgccctgattcccggggcctggctttcagcgtagcaattctgccggcgaagaaggtgagcgcagtgctgtgtggcagcagagctccttaggacgaggagcagcgggacgaggaagggcagactggtgaaatcgcaaactgggcgtctgttccggcgccggacccctatttgcaaaggtccatggctaatgaaacacagaaggttggtgccatccattttccttttcccttcacaccctattccatccaggaagacttcatggcagagctgtaccgggttttggaggctggcaagattgggatatttgagagtccaactggcactgggaagtccttaagtcttatttgtggggccctctcttggctccgtgactttgaacagaagaagcgtgaagaagaggcacgactccttgaaactggaactggccccttacatgatgagaaagatgaatccctgtgtctgtcttcttcctgcgaaggggctgcaggcaccccgaggcctgctggagaaccggcctgggttactcagtttgtgcagaagaaagaagagagggacctggtggaccgactaaaggcggagcaggccaggaggaagcagcgagaagaacgcctgcagcagctgcagcacagggtgcagctcaagtatgcagccaagcgcctgaggcaggaagaagaagaaagagagaatctcctccgcctcagcagggagatgctagagacaggcccggaggctgagcggctggagcagctggagtctggggaggaggagctggtcctcgccgaatacgagagtgatgaggagaaaaaggtggcgagcagagtggatgaggatgaggatgacctggaggaagaacacataactaagatttattactgtagtcggacacactcccagctggcccagtttgtgcatgaggtgaagaagagcccctttggcaaggatgttcggctggtctcccttggctcccggcagaacctttgtgtaaatgaagacgtgaaaagcctaggttctgtgcagcttatcaacgaccgctgtgtggacatgcagagaagcaggcacgagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacgggagccgccttgccatccctgcagcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccagctctgccaggcccattcccagctgctgcagtacgtggagcgatacgggaagcgtttgaaggccaagaacctgatgtacctgaagcagatcctgtatttgctggagaaattcgtggctgtgctaggggggaacattaagcaaaatcccaatacacagagtctgtcacagacagggacggagctgaagaccatcaacgactttctcttccagagccagatcgacaacatcaacctgttcaaggtgcagcgatactgtgagaagagcatgatcagcagaaagctctttggattcactgaacggtacggagcagtgttctcatcccgggagcagcccaaactggctgggtttcagcaattcctgcagagcctgcagcccaggacgactgaagctcttgcagcccctgcagacgagagtcaggccagcaccctgcgaccagcttctccactgatgcacatccaaggcttcctggcagctctcactacggccaaccaggacggcagggtcatcctgagccgccaaggcagcctcagtcagagcaccctgaagtttttgctcctgaatccagctgtgcactttgcccaagtggtgaaggaatgccgggcagtggtcattgcggggggtaccatgcagccggtgtctgacttccggcagcagctgctggcctgtgccggggtggaagctgagcgcgtggtggagttttcctgtggtcacgtgatccctccagacaacatcctgcccctcgtcatctgcagcgggatctccaaccagccgctggaattcacgttccagaaaagagagctgcctcagatgatggacgaggtgggtcgcattctctgtaacctgtgcggtgtggttcctggaggggtggtctgtttcttcccctcctacgagtacctgcgccaggtccatgcccactgggagaagggtggcctgctgggccgtctggctgccaggaagaagatattccaggaacctaagagcgcacaccaggtggagcaggtgctgctggcatattccaggtgcatccaggcctgtggccaggagagaggccaggtgacaggggccctgctcctctctgtggttggaggaaagatgagtgaagggatcaacttctctgacaacctaggccggtgtgtggtgatggtgggcatgcccttccccaacatcaggtctgcagagctgcaggagaagatggcctacttggatcaaaccctccccagagcccccggccaggcacccccagggaaggctctggtggagaacctgtgcatgaaggccgtcaaccagtccataggcagggccatcaggcaccagaaggattttgccagcgtagtgctcctggaccagcgatatgcccggccccctgtcctggccaagctgccggcctggatccgagcccgtgtggaggtcaaagctacctttggccccgccattgctgctgtgcagaagtttcaccgggagaagtcggcctcttcctgatgggcaaccacaccactgcctggcgccgtgcccttcctttgtcctgcccgctggagacagtgtttgtcgtgggcgtggtctgcggggatcctgttacaaaggtgaaa

SEQ ID NO: 1315 - DNA, 3751 bp, Homo sapiens
cagtttctaactcagtggcgtttgccctgattcccggggcctggctttcagcgtagcaattctgccggcgaagaaggtccatggctaatgaaacacagaaggttggtgccatccattttccttttcccttcacaccctattccatccaggaagacttcatggcagagctgtaccgggttttggaggctggcaagattgggatatttgagagtccaactggcactgggaagtccttaagtcttatttgtggggccctctcttggctccgtgactttgaacagaagaagcgtgaagaagaggcacgactccttgaaactggaactggccccttacatgatgagaaagatgaatccctgtgtctgtcttcttcctgcgaaggggctgcaggcaccccgaggcctgctggagaaccggcctgggttactcagtttgtgcagaagaaagaagagagggacctggtggaccgactaaaggcggagcaggccaggaggaagcagcgagaagaacgcctgcagcagctgcagcacagggtgcagctcaagtatgcagccaagcgcctgaggcaggaagaagaagaaagagagaatctcctccgcctcagcagggagatgctagagacaggcccggaggctgagcggctggagcagctggagtctggggaggaggagctggtcctcgccgaatacgagagtgatgaggagaaaaaggtggcgagcagagtggatgaggatgaggatgacctggaggaagaacacataactaagatttattactgtagtcggacacactcccagctggcccagtttgtgcatgaggtgaagaagagcccctttggcaaggatgttcggctggtctcccttggctcccggcagaacctttgtgtaaatgaagacgtgaaaagcctaggttctgtgcagcttatcaacgaccgctgtgtggacatgcagagaagcaggcacgagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacgggagccgccttgccatccctgcagcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccagctctgccaggcccattcccagctgctgcagtacgtggagcgatacgggaagcgtttgaaggccaagaacctgatgtacctgaagcagatcctgtatttgctggagaaattcgtggctgtgctaggggggaacattaagcaaaatcccaatacacagagtctgtcacagacagggacggagctgaagaccatcaacgactttctcttccagagccagatcgacaacatcaacctgttcaaggtgcagcgatactgtgagaagagcatgatcagcagaaagctctttggattcactgaacggtacggagcagtgttctcatcccgggagcagcccaaactggctgggtttcagcaattcctgcagagcctgcagcccaggacgactgaagctcttgcagcccctgcagacgagagtcaggccagcaccctgcgaccagcttctccactgatgcacatccaaggcttcctggcagctctcactacggccaaccaggacggcagggtcatcctgagccgccaaggcagcctcagtcagagcaccctgaagtttttgctcctgaatccagctgtgcactttgcccaagtggtgaaggaatgccgggcagtggtcattgcggggggtaccatgcagccggtgtctgacttccggcagcagctgctggcctgtgccggggtggaagctgagcgcgtggtggagttttcctgtggtcacgtgatccctccagacaacatcctgcccctcgtcatctgcagcgggatctccaaccagccgctggaattcacgttccagaaaagagagctgcctcagatgatggacgaggtgggtcgcattctctgtaacctgtgcggtgtggttcctggaggggtggtctgtttcttcccctcctacgagtacctgcgccaggtccatgcccactgggagaagggtggcctgctgggccgtctggctgccaggaagaagatattccaggaacctaagagcgcacaccaggtggagcaggtgctgctggcatattccaggtgcatccaggcctgtggccaggagagaggccaggtgacaggggccctgctcctctctgtggttggaggaaagatgagtgaagggatcaacttctctgacaacctaggccggtgtgtggtgatggtgggcatgcccttccccaacatcaggtctgcagagctgcaggagaagatggcctacttggatcaaaccctcagcccccggccaggcacccccagggaaggctctggtggagaacctgtgcatgaaggccgtcaaccagtccataggcagggccatcaggcaccagaaggattttgccagcgtagtgctcctggaccagcgatatgcccggccccctgtcctggccaagctgccggcctggatccgagcccgtgtggaggtcaaagctacctttggccccgccattgctgctgtgcagaagtttcaccgggagaagtcggcctcttcctgatgggcaaccacaccactgcctggcgccgtgcccttcctttgtcctgcccgctggagacagtgtttgtcgtgggcgtggtctgcggggatcctgttacaaaggtgaaacccaggaggagagtgtggagtccagagtgctgccaggacccaggcacaggcgttagctcccgtaggagaaaatgggggaatcctgaatgaacagtgggtcctggctgtccttggggcgttccagggcagctcccctcctggaatagaatctttctttccatcctgcatggctgagagccaggcttccttcctggtctccgcaggaggctgtggcagctgtggcatccactgtggcatctccgtcctgcccaccttcttaagaggcgagatggagcaggcccatctgcctctgccctttctagccaaggttatagctgccctggactgctcactctctggtctcaatttaaaatgatccatggccacagggctcctgcccaggggcttgtcaccttcccctcctccttcctgagtcactccttcagtagaaggccctgctccctatcctgtcccacagccctgcctggatttgtatccttggcttcgtgccagttcctccaagtctatggcacctccctccctctcaaccacttgagcaaactccaagacaccttctaccccaacaccagcaattatgccaagggccgttaggctctcaacatgactatagagaccccgtgtcatcacggagacctttgttcctgtgggaaaatatccctcccacctgcaacagctgcccctgctgactgcgcctgtcttctccctctgaccccagagaaaggggctgtggtcagctgggatcttctgccaccatcagggacaaacgggggcaggaggaaagtcactgatgcccagatgtttgcatcctgcacagctataggtccttaaataaaagtgtgctgttggtt

SEQ ID NO: 1316 - DNA, 5743 bp, Homo sapiens
cttcagattgcaaaccttcttgccttcaagcctcggctccaacaccagtccggcagaggaacccagtctaatgaggactggagactgatgcatgagggggctacggaggcgcaggagcggtggtgatggtctgggaagcggagctgaagtgccctgggctttggtgaggcgtgacagtttatcatgaccgtgttcaggcaggaaaacgtggatgattactacgacaccggcgaggaacttggcagtggacagtttgcggttgtgaagaaatgccgtgagaaaagcaccggcctccagtatgccgccaaattcatcaagaaaaggaggactaagtccagccggcggggtgtgagccgcgaggacatcgagcgggaggtcagcatcctgaaggagatccagcaccccaatgtcatcaccctgcacgaggtctatgagaacaagacggacgtcatcctgatcttggaactcgttgcaggtggcgagctgtttgacttcttagctgaaaaggaatctttaactgaagaggaagcaactgaatttctcaaacaaattcttaatggtgtttactacctgcactcccttcaaatcgcccactttgatcttaagcctgagaacataatgcttttggatagaaatgtccccaaacctcggatcaagatcattgactttgggttggcccataaaattgactttggaaatgaatttaaaaacatatttgggactccagagtttgtcgctcctgagatagtcaactatgaacctcttggtcttgaggcagatatgtggagtatcggggtaataacctatatcctcctaagtggggcctccccatttcttggagacactaagcaagaaacgttagcaaatgtatccgctgtcaactacgaatttgaggatgaatacttcagtaataccagtgccctagccaaagatttcataagaagacttctggtcaaggatccaaagaagagaatgacaattcaagatagtttgcagcatccctggatcaagcctaaagatacacaacaggcacttagtagaaaagcatcagcagtaaacatggagaaattcaagaagtttgcagcccggaaaaaatggaaacaatccgttcgcttgatatcactgtgccaaagattatccaggtcattcctgtccagaagtaacatgagtgttgccagaagcgatgatactctggatgaggaagactcctttgtgatgaaagccatcatccatgccatcaacgatgacaatgtcccaggcctgcagcaccttctgggctcattatccaactatgatgttaaccaacccaacaagcacgggacacctccattactcattgctgctggctgtgggaatattcaaatactacagttgctcattaaaagaggctcgagaatcgatgtccaggataagggcgggtccaatgccgtctactgggctgctcggcatggccacgtcgataccttgaaatttctcagtgagaacaaatgccctttggatgtgaaagacaagtctggagagatggccctccacgtggcagctcgctatggccatgctgacgtggctcagttactgtgcagcttcggctcaaatcccaatatccaggacaaggaagaagaaacccccctgcactgtgctgcttggcacggctattactctgtggccaaagccctttgtgaagccggctgtaacgtgaacatcaagaaccgagaaggagagacgcccctcctgacagcctctgccaggggctaccacgacatcgtggagtgtctggccgaacatggagccgaccttaatgcttgcgacaaggacggacacattgcccttcatctggctgtaagacggtgtcagatggaggtaatcaagactctcctcagccaagggtgtttcgtcgattatcaagacaggcacggcaatactcccctccatgtggcatgtaaagatggcaacatgcctatcgtggtggccctctgtgaagcaaactgcaatttggacatctccaacaagtatgggcgaacgcctctgcaccttgcggccaacaacggaatcctagacgtggtccggtatctctgtctgatgggagccagcgttgaggcgctgaccacggacggaaagacggcagaagatcttgctagatcggaacagcacgagcacgtagcaggtctccttgcaagacttcgaaaggatacgcaccgaggactcttcatccagcagctccgacccacacagaacctgcagccaagaattaagctcaagctgtttggccactcgggatccgggaaaaccacccttgtagaatctctcaagtgtgggctgctgaggagctttttcagaaggcgtcggcccagactgtcttccaccaactccagcaggttcccaccttcacccctggcttctaagcccacagtctcagtgagcatcaacaacctgtacccaggctgcgagaacgtgagtgtgaggagccgcagcatgatgttcgagccgggtcttaccaaagggatgctggaggtgtttgtggccccgacccaccacccgcactgctcggccgatgaccagtccaccaaggccatcgacatccagaacgcttatttgaatggagttggcgatttcagcgtgtgggagttctctggaaatcctgtgtatttctgctgttatgactattttgctgcaaatgatcccacgtcaatccatgttgttgtctttagtctagaagagccctatgagatccagctgaaccaagtgattttctggctcagtttcctgaagtcccttgtcccagttgaagaacccatagccttcggtggcaagctgaagaacccactccaagttgtcctggtggccacccacgctgacatcatgaatgttcctcgaccggctggaggcgagtttggatatgacaaagacacatcgttgctgaaagagattaggaacaggtttggaaatgatcttcacatttcaaataagctgtttgttctggatgctggggcttctgggtcaaaggacatgaaggtacttcgaaatcatctgcaagaaatacgaagccagattgtttcggtctgtcctcccatgactcacctgtgtgagaaaatcatctccacgctgccttcctggaggaagctcaatggacccaaccagctgatgtcgctgcagcagtttgtgtacgacgtgcaggaccagctgaaccccctggccagcgaggaggacctcaggcgcattgctcagcagctccacagcacaggcgagatcaacatcatgcaaagtgaaacagttcaggacgtgctgctcctggacccccgctggctctgcacaaacgtcctggggaagttgctgtccgtggagaccccacgggcgctgcaccactaccggggccgctacaccgtggaggacatccagcgcctggtgcccgacagcgacgtggaggagctgctgcagatcctcgatgccatggacatctgcgcccgggacctgagcagcgggaccatggtggacgtcccagccctgatcaagacagacaacctgcaccgctcctgggctgatgaggaggacgaggtgatggtgtatggtggcgtgcgcatcgtgcccgtggaacacctcacccccttcccatgtggcatctttcacaaggtccaggtgaacctgtgccggtggatccaccagcaaagcacagagggcgacgcggacatccgcctgtgggtgaatggctgcaagctggccaaccgtggggccgagctgctggtgctgctggtcaaccacggccagggcattgaggtccaggtccgcggcctggagacggagaagatcaagtgctgcctgctgctggactcggtgtgcagcaccattgagaacgtcatggccaccacgctgccagggctcctgaccgtgaagcattacctgagcccccagcagctgcgggagcaccatgagcccgtcatgatctaccagccacgggacttcttccgggcacagactctgaaggaaacctcactgaccaacaccatgggggggtacaaggaaagcttcagcagcatcatgtgcttcgggtgtcacgacgtctactcacaggccagcctcggcatggacatccatgcatcagacctgaacctcctcactcggaggaaactgagtcgcctgctggacccgcccgaccccctggggaaggactggtgccttctcgccatgaacttaggcctccctgacctcgtggcaaagtacaacaccagtaacggggctcccaaggatttcctccccagccccctccacgccctgctgcgggaatggaccacctaccctgagagcacagtgggcaccctcatgtccaaactgagggagctgggtcgccgggatgccgcagactttttgctgaaggcatcctctgtgttcaaaatcaacctggatggcaatggccaggaggcctatgcctcgagctgcaacagcggcacctcttacaattccattagctctgttgtatcccggtgagggcagcctctggcttgggcagggtctgtttggactgcagaagcaagggggtgatgtagcccatccttccctttggagatgctgagggtgtttcttcctgcacccacagccagggggatgccactcctccctccggcttgacctgtttctctgccgctacctccctccccgtctcattccgttgtctgtggatggtcattgcagtttaagagcagaacagatcttttactttggccgcttgaaaagctagtgtacctcctctcagtgttttggactccatctctcatcctccagtaccttgcttcttactgataattttgctggaattcctaacttttcaatgacattttttttaactactatattgattgtcctttaaaaaagaaaagtgcatatttatccaaaatgtgtatttcttatacgcttttctttgttataccatttcctcagcttatctcttttatatttgtaggagaaactcccatgtatggaatcccactgtatgatttataaacagacaatatgtgagtgccttttgcagaagagggtgtgtttgaaatcatcggagtcagccaggagctgtcaccaaggaaacgctacctctctgtcccttgctgtatgctgatcatcgccagaggtgcttcaccctgagttttgttttgtattgttttctgacagtttttctgttttgtttggcaaggaaaggggagaagggaatcctcctccagggtgattttatgatcagtgttgttgctctaggaagacatttttccgtttgcttttgttccaatgtcaatgtgaacgtccacatgaaacctacacactgtcatgcttcatcattccctctcatctcaggtagaaggttgacacagttgtagggttacagagacctatgtaagaattcagaagacccctgactcatcatttgtggcagtcccttataattggtgcatagcagatggtttccacatttagatcctggtttcataacttcctgtacttgaagtctaaaagcagaaaataaaggaagcaagttttcttccatgattttaaattgtgatcgagttttaaattgataggagggaacatgtcctaattcttctgtcctgagaagcatgtaatgttaatgttatatcatatgtatatatatatatgcactatgtatatacatatatattaatactggtatttttacttaatctataaaatgtcgttaaaaagttgtttgtttttttctttttttataaataaactgttgctcgttgca

SEQ ID NO: 1317 - DNA, 5892 bp, Homo sapiens
ggaggacagccggaccgagccaacgccggggactttgttccctccgcggaggggactcggcaactcgcagcggcagggtctggggccggcgcctgggagggatctgcgccccccactcactccctagctgtgttcccgccgccgccccggctagtctccggcgctggcgcctatggtcggcctccgacagcgctccggagggaccgggggagctcccaggcgcccgggactggagactgatgcatgagggggctacggaggcgcaggagcggtggtgatggtctgggaagcggagctgaagtgccctgggctttggtgaggcgtgacagtttatcatgaccgtgttcaggcaggaaaacgtggatgattactacgacaccggcgaggaacttggcagtggacagtttgcggttgtgaagaaatgccgtgagaaaagcaccggcctccagtatgccgccaaattcatcaagaaaaggaggactaagtccagccggcggggtgtgagccgcgaggacatcgagcgggaggtcagcatcctgaaggagatccagcaccccaatgtcatcaccctgcacgaggtctatgagaacaagacggacgtcatcctgatcttggaactcgttgcaggtggcgagctgtttgacttcttagctgaaaaggaatctttaactgaagaggaagcaactgaatttctcaaacaaattcttaatggtgtttactacctgcactcccttcaaatcgcccactttgatcttaagcctgagaacataatgcttttggatagaaatgtccccaaacctcggatcaagatcattgactttgggttggcccataaaattgactttggaaatgaatttaaaaacatatttgggactccagagtttgtcgctcctgagatagtcaactatgaacctcttggtcttgaggcagatatgtggagtatcggggtaataacctatatcctcctaagtggggcctccccatttcttggagacactaagcaagaaacgttagcaaatgtatccgctgtcaactacgaatttgaggatgaatacttcagtaataccagtgccctagccaaagatttcataagaagacttctggtcaaggatccaaagaagagaatgacaattcaagatagtttgcagcatccctggatcaagcctaaagatacacaacaggcacttagtagaaaagcatcagcagtaaacatggagaaattcaagaagtttgcagcccggaaaaaatggaaacaatccgttcgcttgatatcactgtgccaaagattatccaggtcattcctgtccagaagtaacatgagtgttgccagaagcgatgatactctggatgaggaagactcctttgtgatgaaagccatcatccatgccatcaacgatgacaatgtcccaggcctgcagcaccttctgggctcattatccaactatgatgttaaccaacccaacaagcacgggacacctccattactcattgctgctggctgtgggaatattcaaatactacagttgctcattaaaagaggctcgagaatcgatgtccaggataagggcgggtccaatgccgtctactgggctgctcggcatggccacgtcgataccttgaaatttctcagtgagaacaaatgccctttggatgtgaaagacaagtctggagagatggccctccacgtggcagctcgctatggccatgctgacgtggctcagttactgtgcagcttcggctcaaatcccaatatccaggacaaggaagaagaaacccccctgcactgtgctgcttggcacggctattactctgtggccaaagccctttgtgaagccggctgtaacgtgaacatcaagaaccgagaaggagagacgcccctcctgacagcctctgccaggggctaccacgacatcgtggagtgtctggccgaacatggagccgaccttaatgcttgcgacaaggacggacacattgcccttcatctggctgtaagacggtgtcagatggaggtaatcaagactctcctcagccaagggtgtttcgtcgattatcaagacaggcacggcaatactcccctccatgtggcatgtaaagatggcaacatgcctatcgtggtggccctctgtgaagcaaactgcaatttggacatctccaacaagtatgggcgaacgcctctgcaccttgcggccaacaacggaatcctagacgtggtccggtatctctgtctgatgggagccagcgttgaggcgctgaccacggacggaaagacggcagaagatcttgctagatcggaacagcacgagcacgtagcaggtctccttgcaagacttcgaaaggatacgcaccgaggactcttcatccagcagctccgacccacacagaacctgcagccaagaattaagctcaagctgtttggccactcgggatccgggaaaaccacccttgtagaatctctcaagtgtgggctgctgaggagctttttcagaaggcgtcggcccagactgtcttccaccaactccagcaggttcccaccttcacccctggcttctaagcccacagtctcagtgagcatcaacaacctgtacccaggctgcgagaacgtgagtgtgaggagccgcagcatgatgttcgagccgggtcttaccaaagggatgctggaggtgtttgtggccccgacccaccacccgcactgctcggccgatgaccagtccaccaaggccatcgacatccagaacgcttatttgaatggagttggcgatttcagcgtgtgggagttctctggaaatcctgtgtatttctgctgttatgactattttgctgcaaatgatcccacgtcaatccatgttgttgtctttagtctagaagagccctatgagatccagctgaaccaagtgattttctggctcagtttcctgaagtcccttgtcccagttgaagaacccatagccttcggtggcaagctgaagaacccactccaagttgtcctggtggccacccacgctgacatcatgaatgttcctcgaccggctggaggcgagtttggatatgacaaagacacatcgttgctgaaagagattaggaacaggtttggaaatgatcttcacatttcaaataagctgtttgttctggatgctggggcttctgggtcaaaggacatgaaggtacttcgaaatcatctgcaagaaatacgaagccagattgtttcggtctgtcctcccatgactcacctgtgtgagaaaatcatctccacgctgccttcctggaggaagctcaatggacccaaccagctgatgtcgctgcagcagtttgtgtacgacgtgcaggaccagctgaaccccctggccagcgaggaggacctcaggcgcattgctcagcagctccacagcacaggcgagatcaacatcatgcaaagtgaaacagttcaggacgtgctgctcctggacccccgctggctctgcacaaacgtcctggggaagttgctgtccgtggagaccccacgggcgctgcaccactaccggggccgctacaccgtggaggacatccagcgcctggtgcccgacagcgacgtggaggagctgctgcagatcctcgatgccatggacatctgcgcccgggacctgagcagcgggaccatggtggacgtcccagccctgatcaagacagacaacctgcaccgctcctgggctgatgaggaggacgaggtgatggtgtatggtggcgtgcgcatcgtgcccgtggaacacctcacccccttcccatgtggcatctttcacaaggtccaggtgaacctgtgccggtggatccaccagcaaagcacagagggcgacgcggacatccgcctgtgggtgaatggctgcaagctggccaaccgtggggccgagctgctggtgctgctggtcaaccacggccagggcattgaggtccaggtccgcggcctggagacggagaagatcaagtgctgcctgctgctggactcggtgtgcagcaccattgagaacgtcatggccaccacgctgccagggctcctgaccgtgaagcattacctgagcccccagcagctgcgggagcaccatgagcccgtcatgatctaccagccacgggacttcttccgggcacagactctgaaggaaacctcactgaccaacaccatgggggggtacaaggaaagcttcagcagcatcatgtgcttcgggtgtcacgacgtctactcacaggccagcctcggcatggacatccatgcatcagacctgaacctcctcactcggaggaaactgagtcgcctgctggacccgcccgaccccctggggaaggactggtgccttctcgccatgaacttaggcctccctgacctcgtggcaaagtacaacaccagtaacggggctcccaaggatttcctccccagccccctccacgccctgctgcgggaatggaccacctaccctgagagcacagtgggcaccctcatgtccaaactgagggagctgggtcgccgggatgccgcagactttttgctgaaggcatcctctgtgttcaaaatcaacctggatggcaatggccaggaggcctatgcctcgagctgcaacagcggcacctcttacaattccattagctctgttgtatcccggtgagggcagcctctggcttgggcagggtctgtttggactgcagaagcaagggggtgatgtagcccatccttccctttggagatgctgagggtgtttcttcctgcacccacagccagggggatgccactcctccctccggcttgacctgtttctctgccgctacctccctccccgtctcattccgttgtctgtggatggtcattgcagtttaagagcagaacagatcttttactttggccgcttgaaaagctagtgtacctcctctcagtgttttggactccatctctcatcctccagtaccttgcttcttactgataattttgctggaattcctaacttttcaatgacattttttttaactactatattgattgtcctttaaaaaagaaaagtgcatatttatccaaaatgtgtatttcttatacgcttttctttgttataccatttcctcagcttatctcttttatatttgtaggagaaactcccatgtatggaatcccactgtatgatttataaacagacaatatgtgagtgccttttgcagaagagggtgtgtttgaaatcatcggagtcagccaggagctgtcaccaaggaaacgctacctctctgtcccttgctgtatgctgatcatcgccagaggtgcttcaccctgagttttgttttgtattgttttctgacagtttttctgttttgtttggcaaggaaaggggagaagggaatcctcctccagggtgattttatgatcagtgttgttgctctaggaagacatttttccgtttgcttttgttccaatgtcaatgtgaacgtccacatgaaacctacacactgtcatgcttcatcattccctctcatctcaggtagaaggttgacacagttgtagggttacagagacctatgtaagaattcagaagacccctgactcatcatttgtggcagtcccttataattggtgcatagcagatggtttccacatttagatcctggtttcataacttcctgtacttgaagtctaaaagcagaaaataaaggaagcaagttttcttccatgattttaaattgtgatcgagttttaaattgataggagggaacatgtcctaattcttctgtcctgagaagcatgtaatgttaatgttatatcatatgtatatatatatatgcactatgtatatacatatatattaatactggtatttttacttaatctataaaatgtcgttaaaaagttgtttgtttttttctttttttataaataaactgttgctcgtt

SEQ ID NO: 1318 - DNA, 6012 bp, Homo sapiens
aaaaggcggcaaggagccgagaggctgcttcggagtgtgaggaggacagccggaccgagccaacgccggggactttgttccctccgcggaggggactcggcaactcgcagcggcagggtctggggccggcgcctgggagggatctgcgccccccactcactccctagctgtgttcccgccgccgccccggctagtctccggcgctggcgcctatggtcggcctccgacagcgctccggagggaccgggggagctcccaggcgcccgggactggagactgatgcatgagggggctacggaggcgcaggagcggtggtgatggtctgggaagcggagctgaagtgccctgggctttggtgaggcgtgacagtttatcatgaccgtgttcaggcaggaaaacgtggatgattactacgacaccggcgaggaacttggcagtggacagtttgcggttgtgaagaaatgccgtgagaaaagcaccggcctccagtatgccgccaaattcatcaagaaaaggaggactaagtccagccggcggggtgtgagccgcgaggacatcgagcgggaggtcagcatcctgaaggagatccagcaccccaatgtcatcaccctgcacgaggtctatgagaacaagacggacgtcatcctgatcttggaactcgttgcaggtggcgagctgtttgacttcttagctgaaaaggaatctttaactgaagaggaagcaactgaatttctcaaacaaattcttaatggtgtttactacctgcactcccttcaaatcgcccactttgatcttaagcctgagaacataatgcttttggatagaaatgtccccaaacctcggatcaagatcattgactttgggttggcccataaaattgactttggaaatgaatttaaaaacatatttgggactccagagtttgtcgctcctgagatagtcaactatgaacctcttggtcttgaggcagatatgtggagtatcggggtaataacctatatcctcctaagtggggcctccccatttcttggagacactaagcaagaaacgttagcaaatgtatccgctgtcaactacgaatttgaggatgaatacttcagtaataccagtgccctagccaaagatttcataagaagacttctggtcaaggatccaaagaagagaatgacaattcaagatagtttgcagcatccctggatcaagcctaaagatacacaacaggcacttagtagaaaagcatcagcagtaaacatggagaaattcaagaagtttgcagcccggaaaaaatggaaacaatccgttcgcttgatatcactgtgccaaagattatccaggtcattcctgtccagaagtaacatgagtgttgccagaagcgatgatactctggatgaggaagactcctttgtgatgaaagccatcatccatgccatcaacgatgacaatgtcccaggcctgcagcaccttctgggctcattatccaactatgatgttaaccaacccaacaagcacgggacacctccattactcattgctgctggctgtgggaatattcaaatactacagttgctcattaaaagaggctcgagaatcgatgtccaggataagggcgggtccaatgccgtctactgggctgctcggcatggccacgtcgataccttgaaatttctcagtgagaacaaatgccctttggatgtgaaagacaagtctggagagatggccctccacgtggcagctcgctatggccatgctgacgtggctcagttactgtgcagcttcggctcaaatcccaatatccaggacaaggaagaagaaacccccctgcactgtgctgcttggcacggctattactctgtggccaaagccctttgtgaagccggctgtaacgtgaacatcaagaaccgagaaggagagacgcccctcctgacagcctctgccaggggctaccacgacatcgtggagtgtctggccgaacatggagccgaccttaatgcttgcgacaaggacggacacattgcccttcatctggctgtaagacggtgtcagatggaggtaatcaagactctcctcagccaagggtgtttcgtcgattatcaagacaggcacggcaatactcccctccatgtggcatgtaaagatggcaacatgcctatcgtggtggccctctgtgaagcaaactgcaatttggacatctccaacaagtatgggcgaacgcctctgcaccttgcggccaacaacggaatcctagacgtggtccggtatctctgtctgatgggagccagcgttgaggcgctgaccacggacggaaagacggcagaagatcttgctagatcggaacagcacgagcacgtagcaggtctccttgcaagacttcgaaaggatacgcaccgaggactcttcatccagcagctccgacccacacagaacctgcagccaagaattaagctcaagctgtttggccactcgggatccgggaaaaccacccttgtagaatctctcaagtgtgggctgctgaggagctttttcagaaggcgtcggcccagactgtcttccaccaactccagcaggttcccaccttcacccctggcttctaagcccacagtctcagtgagcatcaacaacctgtacccaggctgcgagaacgtgagtgtgaggagccgcagcatgatgttcgagccgggtcttaccaaagggatgctggaggtgtttgtggccccgacccaccacccgcactgctcggccgatgaccagtccaccaaggccatcgacatccagaacgcttatttgaatggagttggcgatttcagcgtgtgggagttctctggaaatcctgtgtatttctgctgttatgactattttgctgcaaatgatcccacgtcaatccatgttgttgtctttagtctagaagagccctatgagatccagctgaaccaagtgattttctggctcagtttcctgaagtcccttgtcccagttgaagaacccatagccttcggtggcaagctgaagaacccactccaagttgtcctggtggccacccacgctgacatcatgaatgttcctcgaccggctggaggcgagtttggatatgacaaagacacatcgttgctgaaagagattaggaacaggtttggaaatgatcttcacatttcaaataagctgtttgttctggatgctggggcttctgggtcaaaggacatgaaggtacttcgaaatcatctgcaagaaatacgaagccagattgtttcgaaaaccctgcccttcacaccagatatcctcgttggggtcccactgtggcatcatcagaagatagggggtagtccggtctgtcctcccatgactcacctgtgtgagaaaatcatctccacgctgccttcctggaggaagctcaatggacccaaccagctgatgtcgctgcagcagtttgtgtacgacgtgcaggaccagctgaaccccctggccagcgaggaggacctcaggcgcattgctcagcagctccacagcacaggcgagatcaacatcatgcaaagtgaaacagttcaggacgtgctgctcctggacccccgctggctctgcacaaacgtcctggggaagttgctgtccgtggagaccccacgggcgctgcaccactaccggggccgctacaccgtggaggacatccagcgcctggtgcccgacagcgacgtggaggagctgctgcagatcctcgatgccatggacatctgcgcccgggacctgagcagcgggaccatggtggacgtcccagccctgatcaagacagacaacctgcaccgctcctgggctgatgaggaggacgaggtgatggtgtatggtggcgtgcgcatcgtgcccgtggaacacctcacccccttcccatgtggcatctttcacaaggtccaggtgaacctgtgccggtggatccaccagcaaagcacagagggcgacgcggacatccgcctgtgggtgaatggctgcaagctggccaaccgtggggccgagctgctggtgctgctggtcaaccacggccagggcattgaggtccaggtccgcggcctggagacggagaagatcaagtgctgcctgctgctggactcggtgtgcagcaccattgagaacgtcatggccaccacgctgccagggctcctgaccgtgaagcattacctgagcccccagcagctgcgggagcaccatgagcccgtcatgatctaccagccacgggacttcttccgggcacagactctgaaggaaacctcactgaccaacaccatgggggggtacaaggaaagcttcagcagcatcatgtgcttcgggtgtcacgacgtctactcacaggccagcctcggcatggacatccatgcatcagacctgaacctcctcactcggaggaaactgagtcgcctgctggacccgcccgaccccctggggaaggactggtgccttctcgccatgaacttaggcctccctgacctcgtggcaaagtacaacaccagtaacggggctcccaaggatttcctccccagccccctccacgccctgctgcgggaatggaccacctaccctgagagcacagtgggcaccctcatgtccaaactgagggagctgggtcgccgggatgccgcagactttttgctgaaggcatcctctgtgttcaaaatcaacctggatggcaatggccaggaggcctatgcctcgagctgcaacagcggcacctcttacaattccattagctctgttgtatcccggtgagggcagcctctggcttgggcagggtctgtttggactgcagaagcaagggggtgatgtagcccatccttccctttggagatgctgagggtgtttcttcctgcacccacagccagggggatgccactcctccctccggcttgacctgtttctctgccgctacctccctccccgtctcattccgttgtctgtggatggtcattgcagtttaagagcagaacagatcttttactttggccgcttgaaaagctagtgtacctcctctcagtgttttggactccatctctcatcctccagtaccttgcttcttactgataattttgctggaattcctaacttttcaatgacattttttttaactactatattgattgtcctttaaaaaagaaaagtgcatatttatccaaaatgtgtatttcttatacgcttttctttgttataccatttcctcagcttatctcttttatatttgtaggagaaactcccatgtatggaatcccactgtatgatttataaacagacaatatgtgagtgccttttgcagaagagggtgtgtttgaaatcatcggagtcagccaggagctgtcaccaaggaaacgctacctctctgtcccttgctgtatgctgatcatcgccagaggtgcttcaccctgagttttgttttgtattgttttctgacagtttttctgttttgtttggcaaggaaaggggagaagggaatcctcctccagggtgattttatgatcagtgttgttgctctaggaagacatttttccgtttgcttttgttccaatgtcaatgtgaacgtccacatgaaacctacacactgtcatgcttcatcattccctctcatctcaggtagaaggttgacacagttgtagggttacagagacctatgtaagaattcagaagacccctgactcatcatttgtggcagtcccttataattggtgcatagcagatggtttccacatttagatcctggtttcataacttcctgtacttgaagtctaaaagcagaaaataaaggaagcaagttttcttccatgattttaaattgtgatcgagttttaaattgataggagggaacatgtcctaattcttctgtcctgagaagcatgtaatgttaatgttatatcatatgtatatatatatatgcactatgtatatacatatatattaatactggtatttttacttaatctataaaatgtcgttaaaaagttgtttgtttttttctttttttataaataaactgttgctcgttgcatt

SEQ ID NO: 1319 - DNA, 5759 bp, Homo sapiens
agagcgcgccagcgagcccggagcgcggagctgggaggagcagcgagcgccgcgcagaacccgcagcgccggcctggcagggcagctcggaggactggagactgatgcatgagggggctacggaggcgcaggagcggtggtgatggtctgggaagcggagctgaagtgccctgggctttggtgaggcgtgacagtttatcatgaccgtgttcaggcaggaaaacgtggatgattactacgacaccggcgaggaacttggcagtggacagtttgcggttgtgaagaaatgccgtgagaaaagcaccggcctccagtatgccgccaaattcatcaagaaaaggaggactaagtccagccggcggggtgtgagccgcgaggacatcgagcgggaggtcagcatcctgaaggagatccagcaccccaatgtcatcaccctgcacgaggtctatgagaacaagacggacgtcatcctgatcttggaactcgttgcaggtggcgagctgtttgacttcttagctgaaaaggaatctttaactgaagaggaagcaactgaatttctcaaacaaattcttaatggtgtttactacctgcactcccttcaaatcgcccactttgatcttaagcctgagaacataatgcttttggatagaaatgtccccaaacctcggatcaagatcattgactttgggttggcccataaaattgactttggaaatgaatttaaaaacatatttgggactccagagtttgtcgctcctgagatagtcaactatgaacctcttggtcttgaggcagatatgtggagtatcggggtaataacctatatcctcctaagtggggcctccccatttcttggagacactaagcaagaaacgttagcaaatgtatccgctgtcaactacgaatttgaggatgaatacttcagtaataccagtgccctagccaaagatttcataagaagacttctggtcaaggatccaaagaagagaatgacaattcaagatagtttgcagcatccctggatcaagcctaaagatacacaacaggcacttagtagaaaagcatcagcagtaaacatggagaaattcaagaagtttgcagcccggaaaaaatggaaacaatccgttcgcttgatatcactgtgccaaagattatccaggtcattcctgtccagaagtaacatgagtgttgccagaagcgatgatactctggatgaggaagactcctttgtgatgaaagccatcatccatgccatcaacgatgacaatgtcccaggcctgcagcaccttctgggctcattatccaactatgatgttaaccaacccaacaagcacgggacacctccattactcattgctgctggctgtgggaatattcaaatactacagttgctcattaaaagaggctcgagaatcgatgtccaggataagggcgggtccaatgccgtctactgggctgctcggcatggccacgtcgataccttgaaatttctcagtgagaacaaatgccctttggatgtgaaagacaagtctggagagatggccctccacgtggcagctcgctatggccatgctgacgtggctcagttactgtgcagcttcggctcaaatcccaatatccaggacaaggaagaagaaacccccctgcactgtgctgcttggcacggctattactctgtggccaaagccctttgtgaagccggctgtaacgtgaacatcaagaaccgagaaggagagacgcccctcctgacagcctctgccaggggctaccacgacatcgtggagtgtctggccgaacatggagccgaccttaatgcttgcgacaaggacggacacattgcccttcatctggctgtaagacggtgtcagatggaggtaatcaagactctcctcagccaagggtgtttcgtcgattatcaagacaggcacggcaatactcccctccatgtggcatgtaaagatggcaacatgcctatcgtggtggccctctgtgaagcaaactgcaatttggacatctccaacaagtatgggcgaacgcctctgcaccttgcggccaacaacggaatcctagacgtggtccggtatctctgtctgatgggagccagcgttgaggcgctgaccacggacggaaagacggcagaagatcttgctagatcggaacagcacgagcacgtagcaggtctccttgcaagacttcgaaaggatacgcaccgaggactcttcatccagcagctccgacccacacagaacctgcagccaagaattaagctcaagctgtttggccactcgggatccgggaaaaccacccttgtagaatctctcaagtgtgggctgctgaggagctttttcagaaggcgtcggcccagactgtcttccaccaactccagcaggttcccaccttcacccctggcttctaagcccacagtctcagtgagcatcaacaacctgtacccaggctgcgagaacgtgagtgtgaggagccgcagcatgatgttcgagccgggtcttaccaaagggatgctggaggtgtttgtggccccgacccaccacccgcactgctcggccgatgaccagtccaccaaggccatcgacatccagaacgcttatttgaatggagttggcgatttcagcgtgtgggagttctctggaaatcctgtgtatttctgctgttatgactattttgctgcaaatgatcccacgtcaatccatgttgttgtctttagtctagaagagccctatgagatccagctgaaccaagtgattttctggctcagtttcctgaagtcccttgtcccagttgaagaacccatagccttcggtggcaagctgaagaacccactccaagttgtcctggtggccacccacgctgacatcatgaatgttcctcgaccggctggaggcgagtttggatatgacaaagacacatcgttgctgaaagagattaggaacaggtttggaaatgatcttcacatttcaaataagctgtttgttctggatgctggggcttctgggtcaaaggacatgaaggtacttcgaaatcatctgcaagaaatacgaagccagattgtttcggtctgtcctcccatgactcacctgtgtgagaaaatcatctccacgctgccttcctggaggaagctcaatggacccaaccagctgatgtcgctgcagcagtttgtgtacgacgtgcaggaccagctgaaccccctggccagcgaggaggacctcaggcgcattgctcagcagctccacagcacaggcgagatcaacatcatgcaaagtgaaacagttcaggacgtgctgctcctggacccccgctggctctgcacaaacgtcctggggaagttgctgtccgtggagaccccacgggcgctgcaccactaccggggccgctacaccgtggaggacatccagcgcctggtgcccgacagcgacgtggaggagctgctgcagatcctcgatgccatggacatctgcgcccgggacctgagcagcgggaccatggtggacgtcccagccctgatcaagacagacaacctgcaccgctcctgggctgatgaggaggacgaggtgatggtgtatggtggcgtgcgcatcgtgcccgtggaacacctcacccccttcccatgtggcatctttcacaaggtccaggtgaacctgtgccggtggatccaccagcaaagcacagagggcgacgcggacatccgcctgtgggtgaatggctgcaagctggccaaccgtggggccgagctgctggtgctgctggtcaaccacggccagggcattgaggtccaggtccgcggcctggagacggagaagatcaagtgctgcctgctgctggactcggtgtgcagcaccattgagaacgtcatggccaccacgctgccagggctcctgaccgtgaagcattacctgagcccccagcagctgcgggagcaccatgagcccgtcatgatctaccagccacgggacttcttccgggcacagactctgaaggaaacctcactgaccaacaccatgggggggtacaaggaaagcttcagcagcatcatgtgcttcgggtgtcacgacgtctactcacaggccagcctcggcatggacatccatgcatcagacctgaacctcctcactcggaggaaactgagtcgcctgctggacccgcccgaccccctggggaaggactggtgccttctcgccatgaacttaggcctccctgacctcgtggcaaagtacaacaccagtaacggggctcccaaggatttcctccccagccccctccacgccctgctgcgggaatggaccacctaccctgagagcacagtgggcaccctcatgtccaaactgagggagctgggtcgccgggatgccgcagactttttgctgaaggcatcctctgtgttcaaaatcaacctggatggcaatggccaggaggcctatgcctcgagctgcaacagcggcacctcttacaattccattagctctgttgtatcccggtgagggcagcctctggcttgggcagggtctgtttggactgcagaagcaagggggtgatgtagcccatccttccctttggagatgctgagggtgtttcttcctgcacccacagccagggggatgccactcctccctccggcttgacctgtttctctgccgctacctccctccccgtctcattccgttgtctgtggatggtcattgcagtttaagagcagaacagatcttttactttggccgcttgaaaagctagtgtacctcctctcagtgttttggactccatctctcatcctccagtaccttgcttcttactgataattttgctggaattcctaacttttcaatgacattttttttaactactatattgattgtcctttaaaaaagaaaagtgcatatttatccaaaatgtgtatttcttatacgcttttctttgttataccatttcctcagcttatctcttttatatttgtaggagaaactcccatgtatggaatcccactgtatgatttataaacagacaatatgtgagtgccttttgcagaagagggtgtgtttgaaatcatcggagtcagccaggagctgtcaccaaggaaacgctacctctctgtcccttgctgtatgctgatcatcgccagaggtgcttcaccctgagttttgttttgtattgttttctgacagtttttctgttttgtttggcaaggaaaggggagaagggaatcctcctccagggtgattttatgatcagtgttgttgctctaggaagacatttttccgtttgcttttgttccaatgtcaatgtgaacgtccacatgaaacctacacactgtcatgcttcatcattccctctcatctcaggtagaaggttgacacagttgtagggttacagagacctatgtaagaattcagaagacccctgactcatcatttgtggcagtcccttataattggtgcatagcagatggtttccacatttagatcctggtttcataacttcctgtacttgaagtctaaaagcagaaaataaaggaagcaagttttcttccatgattttaaattgtgatcgagttttaaattgataggagggaacatgtcctaattcttctgtcctgagaagcatgtaatgttaatgttatatcatatgtatatatatatatgcactatgtatatacatatatattaatactggtatttttacttaatctataaaatgtcgttaaaaagttgtttgtttttttctttttttataaataaactgttgctcgttgc

SEQ ID NO: 1320 - DNA, 4186 bp, Homo sapiens
gcaggagcggtggtgatggtctgggaagcggagctgaagtgccctgggctttggtgaggcgtgacagtttatcatgaccgtgttcaggcaggaaaacgtggatgattactacgacaccggcgaggaacttggcagtggacagtttgcggttgtgaagaaatgccgtgagaaaagcaccggcctccagtatgccgccaaattcatcaagaaaaggaggactaagtccagccggcggggtgtgagccgcgaggacatcgagcgggaggtcagcatcctgaaggagatccagcaccccaatgtcatcaccctgcacgaggtctatgagaacaagacggacgtcatcctgatcttggaactcgttgcaggtggcgagctgtttgacttcttagctgaaaaggaatctttaactgaagaggaagcaactgaatttctcaaacaaattcttaatggtgtttactacctgcactcccttcaaatcgcccactttgatcttaagcctgagaacataatgcttttggatagaaatgtccccaaacctcggatcaagatcattgactttgggttggcccataaaattgactttggaaatgaatttaaaaacatatttgggactccagagtttgtcgctcctgagatagtcaactatgaacctcttggtcttgaggcagatatgtggagtatcggggtaataacctatatcctcctaagtggggcctccccatttcttggagacactaagcaagaaacgttagcaaatgtatccgctgtcaactacgaatttgaggatgaatacttcagtaataccagtgccctagccaaagatttcataagaagacttctggtcaaggatccaaagaagagaatgacaattcaagatagtttgcagcatccctggatcaagcctaaagatacacaacaggcacttagtagaaaagcatcagcagtaaacatggagaaattcaagaagtttgcagcccggaaaaaatggaaacaatccgttcgcttgatatcactgtgccaaagattatccaggtcattcctgtccagaagtaacatgagtgttgccagaagcgatgatactctggatgaggaagactcctttgtgatgaaagccatcatccatgccatcaacgatgacaatgtcccaggcctgcagcaccttctgggctcattatccaactatgatgttaaccaacccaacaagcacgggacacctccattactcattgctgctggctgtgggaatattcaaatactacagttgctcattaaaagaggctcgagaatcgatgtccaggataagggcgggtccaatgccgtctactgggctgctcggcatggccacgtcgataccttgaaatttctcagtgagaacaaatgccctttggatgtgaaagacaagtctggagagatggccctccacgtggcagctcgctatggccatgctgacgtggctcagttactgtgcagcttcggctcaaatcccaatatccaggacaaggaagaagaaacccccctgcactgtgctgcttggcacggctattactctgtggccaaagccctttgtgaagccggctgtaacgtgaacatcaagaaccgagaaggagagacgcccctcctgacagcctctgccaggggctaccacgacatcgtggagtgtctggccgaacatggagccgaccttaatgcttgcgacaaggacggacacattgcccttcatctggctgtaagacggtgtcagatggaggtaatcaagactctcctcagccaagggtgtttcgtcgattatcaagacaggcacggcaatactcccctccatgtggcatgtaaagatggcaacatgcctatcgtggtggccctctgtgaagcaaactgcaatttggacatctccaacaagtatgggcgaacgcctctgcaccttgcggccaacaacggaatcctagacgtggtccggtatctctgtctgatgggagccagcgttgaggcgctgaccacggacggaaagacggcagaagatcttgctagatcggaacagcacgagcacgtagcaggtctccttgcaagacttcgaaaggatacgcaccgaggactcttcatccagcagctccgacccacacagaacctgcagccaagaattaagctcaagctgtttggccactcgggatccgggaaaaccacccttgtagaatctctcaagtgtgggctgctgaggagctttttcagaaggcgtcggcccagactgtcttccaccaactccagcaggttcccaccttcacccctggcttctaagcccacagtctcagtgagcatcaacaacctgtacccaggctgcgagaacgtgagtgtgaggagccgcagcatgatgttcgagccgggtcttaccaaagggatgctggaggtgtttgtggccccgacccaccacccgcactgctcggccgatgaccagtccaccaaggccatcgacatccagaacgcttatttgaatgccttcggtggcaagctgaagaacccactccaagttgtcctggtggccacccacgctgacatcatgaatgttcctcgaccggctggaggcgagtttggatatgacaaagacacatcgttgctgaaagagattaggaacaggtttggaaatgatcttcacatttcaaataagctgtttgttctggatgctggggcttctgggtcaaaggacatgaaggtacttcgaaatcatctgcaagaaatacgaagccagattgtttcggtctgtcctcccatgactcacctgtgtgagaaaatcatctccacgctgccttcctggaggaagctcaatggacccaaccagctgatgtcgctgcagcagtttgtgtacgacgtgcaggaccagctgaaccccctggccagcgaggaggacctcaggcgcattgctcagcagctccacagcacaggcgagatcaacatcatgcaaagtgaaacagttcaggacgtgctgctcctggacccccgctggctctgcacaaacgtcctggggaagttgctgtccgtggagaccccacgggcgctgcaccactaccggggccgctacaccgtggaggacatccagcgcctggtgcccgacagcgacgtggaggagctgctgcagatcctcgatgccatggacatctgcgcccgggacctgagcagcgggaccatggtggacgtcccagccctgatcaagacagacaacctgcaccgctcctgggctgatgaggaggacgaggtgatggtgtatggtggcgtgcgcatcgtgcccgtggaacacctcacccccttcccatgtggcatctttcacaaggtccaggtgaacctgtgccggtggatccaccagcaaagcacagagggcgacgcggacatccgcctgtgggtgaatggctgcaagctggccaaccgtggggccgagctgctggtgctgctggtcaaccacggccagggcattgaggtccaggtccgcggcctggagacggagaagatcaagtgctgcctgctgctggactcggtgtgcagcaccattgagaacgtcatggccaccacgctgccagggctcctgaccgtgaagcattacctgagcccccagcagctgcgggagcaccatgagcccgtcatgatctaccagccacgggacttcttccgggcacagactctgaaggaaacctcactgaccaacaccatgggggggtacaaggaaagcttcagcagcatcatgtgcttcgggtgtcacgacgtctactcacaggccagcctcggcatggacatccatgcatcagacctgaacctcctcactcggaggaaactgagtcgcctgctggacccgcccgaccccctggggaaggactggtgccttctcgccatgaacttaggcctccctgacctcgtggcaaagtacaacaccagtaacggggctcccaaggatttcctccccagccccctccacgccctgctgcgggaatggaccacctaccctgagagcacagtgggcaccctcatgtccaaactgagggagctgggtcgccgggatgccgcagactttttgctgaaggcatcctctgtgttcaaaatcaacctggatggcaatggccaggaggcctatgcctcgagctgcaacagcggcacctcttacaattccattagctctgttgtatcccggtgagggcagcctctggcttgg

SEQ ID NO: 1321 - DNA, 2606 bp, Homo sapiens
atatggcggcgcttagttgcatgaaggcggaaactctgtgacttccggtccgtagtggggcctgcggtgggagtgggaaggaaggcggagggaaccatgcgaggttctgagaattgcggcgagggtcgcctcgagagacggtttctgaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaaagcttaagttttacacagaaacattaataaacaataaagttcttttcttactgta

SEQ ID NO: 1322 - DNA, 2613 bp, Homo sapiens
gacaatatggcggcgcttagttgcatgaaggcggaaactctgtgacttccggtccgtagtggggcctgcggtgggagtgggaaggaaggcggagggaaccatgcgaggttctgagaattgcggcgagggtcgcctcgagagacggtttctgagcaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaaagcttaagttttacacagaaacattaataaacaataaagttcttttcttactgta

SEQ ID NO: 1323 - DNA, 2152 bp, Homo sapiens
gtgacttccggtccgtagtggggcctgcggtgggagtgggaaggaaggcggagggaaccatgcgaggttctgagaattgcggcgagggtcgcctcgagagacggtttctgagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaagacaagtgtggccacacaatgcgatccagaagagatcatcgtgctctcagactctgattagctgcctccccttctccctgcctcc

SEQ ID NO: 1324 - DNA, 283 bp, Homo sapiens
caggatggcagaggaaggtgatgtggacgaggcggatgtgttcctggcatttgcccagggtccctcccctcccaggggtcccgtgcgacgtgccttggacaaggctttctttatcttcctggccctcttcctgacactgctgatgctggaggctgcttataagctgctgtggttactactatgggcaaagttaggggactggctcctggggacacctcagaaggaggaggagctggaattgtgaccacctttcctataaacatcttctttccccaccaaggag

SEQ ID NO: 1325 - DNA, 250 bp, Homo sapiens
ggatgtgttcctggcatttgcccagggtccctcccctcccaggggtcccgtgcgacgtgccttggacaaggctttctttatcttcctggccctcttcctgacactgctgatgctggaggctgcttataagctgctgtggttactactatgggcaaagttaggggactggctcctggggacacctcagaaggaggaggagctggaattgtgaccacctttcctataaacatcttctttccccaccaaggag

SEQ ID NO: 1326 - DNA, 702 bp, Homo sapiens
ggtgggagtgggaaggaaggcggagggaaccatgcgaggttctgagaattgcggcgagggtcgcctcgagagacggtttctgaggggctcattctgaggccccatccccttccagcaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctc

SEQ ID NO: 1327 - DNA, 371 bp, Homo sapiens
ttggggagagctgggcgctgagtctgaggggaaagctgtggtaccttcctgtccctgaaagggagtggagcggccgggggctgaactgggggagggggatttggcgggaagcgcatctagcggaccggccggacccacggttgggatctaagaggaatcgcgagagcgtagcgcgcaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccaga

SEQ ID NO: 1328 - DNA, 751 bp, Homo sapiens
ggatgtgttcctggcatttgcccagggtccctcccctcccaggggtcccgtgcgacgtgccttggacaaggctttctttatcttcctggccctcttcctgacactgctgatgctggaggctgcttataagctgctgtggttactactatgggcaaagttaggggactggctcctggggacacctcagaaggaggaggagctggaattgtgaccacctttcctataaacatcttctttccccaccaaggagctcacctctggacccagccttgcctccacgagtccctccagcctccctaaacacaacgagcaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagct

SEQ ID NO: 1329 - DNA, 2874 bp, Homo sapiens
ggagttccagtgatcaagtggaagaaagatggcattcatctggccttgggaatggatgaaaggaagcagcaactttcaaatgggtctctgctgatacaaaacatacttcattccagacaccacaagccagatgagggactttaccaatgtgaggcatctttaggagattctggctcaattattagtcggacagcaaaagttgcagtagcaggaccactgaggttcctttcacagacagaatctgtcacagccttcatgggagacacagtgctactcaagtgtgaagtcattggggagcccatgccaacaatccactggcagaagaaccaacaagacctgactccaatcccaggtgactcccgagtggtggtcttgccctctggagcattgcagatcagccgactccaaccgggggacattggaatttaccgatgctcagctcgaaatccagccagctcaagaacaggaaatgaagcagaagtcagaattttatcagatccaggactgcatagacagctgtattttctgcaaagaccatccaatgtagtagccattgaaggaaaagatgctgtcctggaatgttgtgtttctggctatcctccaccaagttttacctggttacgaggcgaggaagtcatccaactcaggtctaaaaagtattctttattgggtggaagcaacttgcttatctccaatgtgacagatgatgacagtggaatgtatacctgtgttgtcacatataaaaatgagaatattagtgcctctgcagagctcacagtcttggttccgccatggtttttaaatcatccttccaacctgtatgcctatgaaagcatggatattgagtttgaatgtacagtctctggaaagcctgtgcccactgtgaattggatgaagaatggagatgtggtcattcctagtgattattttcagatagtgggaggaagcaacttacggatacttggggtggtgaagtcagatgaaggcttttatcaatgtgtggctgaaaatgaggctggaaatgcccagaccagtgcacagctcattgtccctaagcctgctatcccaagctccagtgtcctcccttcggctcccagagatgtggtccctgtcttggtttccagccgatttgtccgtctcagctggcgcccacctgcagaagcgaaagggaacattcaaactttcacggtctttttctccagagaaggtgacaacagggaacgagcattgaatacaacacagcctgggtcccttcagctcactgtgggaaacctgaagccagaagccatgtacacctttcgagttgtggcttacaatgaatggggaccgggagagagttctcaacccatcaaggtggccacacagcctgagttgcaagttccagggccagtagaaaacctgcaagctgtatctacctcacctacctcaattcttattacctgggaaccccctgcctatgcaaacggtccagtccaaggttacagattgttctgcactgaggtgtccacaggaaaagaacagaatatagaggttgatggactatcttataaactggaaggcctgaaaaaattcaccgaatatagtcttcgattcttagcttataatcgctatggtccgggcgtctctactgatgatataacagtggttacactttctgacgtgccaagtgccccgcctcagaacgtctccctggaagtggtcaattcaagaagtatcaaagttagctggctgcctcctccatcaggaacacaaaatggatttattaccggctataaaattcgacacagaaagacgacccgcaggggtgagatggaaacactggagccaaacaacctctggtacctattcacaggactggagaaaggaagtcagtacagtttccaggtgtcagccatgacagtcaatggtactggaccaccttccaactggtatactgcagagactccagagaatgatctagatgaatctcaagttcctgatcaaccaagctctcttcatgtgaggccccagactaactgcatcatcatgagttggactcctcccttgaacccaaacatcgtggtgcgaggttatattatcggttatggcgttgggagcccttacgctgagacagtgcgtgtggacagcaagcagcgatattattccattgagaggttagagtcaagttcccattatgtaatctccctaaaagcttttaacaatgccggagaaggagttcctctttatgaaagtgccaccaccaggtctataaccgtcagaagacacaacatctctaagttacacagcaacaggcctcaaaccaaacacaatgtatgaattctcggtcatggtaacaaaaaacagaaggtccagtacttggagcatgactgcacatgccaccacgtatgaagcagcccccacctctgctcccaaggacttgacagtcattactagggaagggaagcctcgtgccgtcattgtgagttggcagcctcccttggaagccaatgggaaaattactgcttacatcttattttataccttggacaagaacatcccaattgatgactggattatggaaacaatcagtggtgataggcttactcatcaaatcatggatctcaaccttgatactatgtattactttcgaattcaagcacgaaattcaaaaggagtggggccactctctgatcctatcctcttcaggactctgaaagtggaacaccctgacaaaatggctaatgaccaagacactggcgtgacgattaatcttgttaatgaagttctgcttggctgaggctgcggctctgataaggaagatgtaaattttcttgagaggaaattgttttgtctccattctgaaggaccaattaaaatgtcaagcttctttgtatg

SEQ ID NO: 1330 - DNA, 3169 bp, Homo sapiens
gttccagtgatcaagtggaagaaagatggcattcatctggccttgggaatggatgaaaggaagcagcaactttcaaatgggtctctgctgatacaaaacatacttcattccagacaccacaagccagatgagggactttaccaatgtgaggcatctttaggagattctggctcaattattagtcggacagcaaaagttgcagtagcagactaggtgtcatgtgatataactggacccaggagaatgaccccacaactgaaagatttttatgaaggatgatttactattctccaacgtactgacatttttctacagcccaatcattgctggggagaccactgaggttcctttcacagacagaatctgtcacagccttcatgggagacacagtgctactcaagtgtgaagtcattggggagcccatgccaacaatccactggcagaagaaccaacaagacctgactccaatcccaggtgactcccgagtggtggtcttgccctctggagcattgcagatcagccgactccaaccgggggacattggaatttaccgatgctcagctcgaaatccagccagctcaagaacaggaaatgaagcagaagtcagaattttatcagatccaggactgcatagacagctgtattttctgcaaagaccatccaatgtagtagccattgaaggaaaagatgctgtcctggaatgttgtgtttctggctatcctccaccaagttttacctggttacgaggcgaggaagtcatccaactcaggtctaaaaagtattctttattgggtggaagcaacttgcttatctccaatgtgacagatgatgacagtggaatgtatacctgtgttgtcacatataaaaatgagaatattagtgcctctgcagagctcacagtcttggttccgccatggtttttaaatcatccttccaacctgtatgcctatgaaagcatggatattgagtttgaatgtacagtctctggaaagcctgtgcccactgtgaattggatgaagaatggagatgtggtcattcctagtgattattttcagatagtgggaggaagcaacttacggatacttggggtggtgaagtcagatgaaggcttttatcaatgtgtggctgaaaatgaggctggaaatgcccagaccagtgcacagctcattgtccctaagcctgctatcccaagctccagtgtcctcccttcggctcccagagatgtggtccctgtcttggtttccagccgatttgtccgtctcagctggcgcccacctgcagaagcgaaagggaacattcaaactttcacggtctttttctccagagaaggtgacaacagggaacgagcattgaatacaacacagcctgggtcccttcagctcactgtgggaaacctgaagccagaagccatgtacacctttcgagttgtggcttacaatgaatggggaccgggagagagttctcaacccatcaaggtggccacacagcctgagttgcaagttccagggccagtagaaaacctgcaagctgtatctacctcacctacctcaattcttattacctgggaaccccctgcctatgcaaacggtccagtccaaggttacagattgttctgcactgaggtgtccacaggaaaagaacagaatatagaggttgatggactatcttataaactggaaggcctgaaaaaattcaccgaatatagtcttcgattcttagcttataatcgctatggtccgggcgtctctactgatgatataacagtggttacactttctgacgtgccaagtgccccgcctcagaacgtctccctggaagtggtcaattcaagaagtatcaaagttagctggctgcctcctccatcaggaacacaaaatggatttattaccggctataaaattcgacacagaaagacgacccgcaggggtgagatggaaacactggagccaaacaacctctggtacctattcacaggactggagaaaggaagtcagtacagtttccaggtgtcagccatgacagtcaatggtactggaccaccttccaactggtatactgcagagactccagagaatgatctagatgaatctcaagttcctgatcaaccaagctctcttcatgtgaggccccagactaactgcatcatcatgagttggactcctcccttgaacccaaacatcgtggtgcgaggttatattatcggttatggcgttgggagcccttacgctgagacagtgcgtgtggacagcaagcagcgatattattccattgagaggttagagtcaagttcccattatgtaatctccctaaaagcttttaacaatgccggagaaggagttcctctttatgaaagtgccaccaccaggtctataaccgatctctccacccccatgctcccaccagtaggtgtacaggctgtggctcttacccatgatgctgtgagggtcagctgggcagacaactctgtccctaagaaccaaaagacgtctgaggtgcgactttacaccgtccggtggagaaccagcttttctgcaagtgcaaaatacaagtcagaagacacaacatctctaagttacacagcaacaggcctcaaaccaaacacaatgtatgaattctcggtcatggtaacaaaaaacagaaggtccagtacttggagcatgactgcacatgccaccacgtatgaagcagcccccacctctgctcccaaggacttgacagtcattactagggaagggaagcctcgtgccgtcattgtgagttggcagcctcccttggaagccaatgggaaaattactgcttacatcttattttataccttggacaagaacatcccaattgatgactggattatggaaacaatcagtggtgataggcttactcatcaaatcatggatctcaaccttgatactatgtattactttcgaattcaagcacgaaattcaaaaggagtggggccactctctgatcctatcctcttcaggactctgaaagtggaacaccctgacaaaatggctaatgaccaagacactggcgtgacgattaatcttgttaatgaagttctgcttggctgaggctgcggctctgataaggaagatgtaaattttcttgagaggaaattgttttgtctccattctgaaggaccaattaaaatgtcaagcttctttgtatg

SEQ ID NO: 1331 - DNA, 9590 bp, Homo sapiens
atggagaatagtcttagatgtgtttgggtacccaagctggcttttgtactcttcggagcttccttgttcagcgcgcatcttcaagtaaccggttttcaaattaaagctttcacagcactgcgcttcctctcagaaccttctgatgccgtcacaatgcggggaggaaatgtcctcctcgactgctccgcggagtccgaccgaggagttccagtgatcaagtggaagaaagatggcattcatctggccttgggaatggatgaaaggaagcagcaactttcaaatgggtctctgctgatacaaaacatacttcattccagacaccacaagccagatgagggactttaccaatgtgaggcatctttaggagattctggctcaattattagtcggacagcaaaagttgcagtagcaggaccactgaggttcctttcacagacagaatctgtcacagccttcatgggagacacagtgctactcaagtgtgaagtcattggggagcccatgccaacaatccactggcagaagaaccaacaagacctgactccaatcccaggtgactcccgagtggtggtcttgccctctggagcattgcagatcagccgactccaaccgggggacattggaatttaccgatgctcagctcgaaatccagccagctcaagaacaggaaatgaagcagaagtcagaattttatcagatccaggactgcatagacagctgtattttctgcaaagaccatccaatgtagtagccattgaaggaaaagatgctgtcctggaatgttgtgtttctggctatcctccaccaagttttacctggttacgaggcgaggaagtcatccaactcaggtctaaaaagtattctttattgggtggaagcaacttgcttatctccaatgtgacagatgatgacagtggaatgtatacctgtgttgtcacatataaaaatgagaatattagtgcctctgcagagctcacagtcttggttccgccatggtttttaaatcatccttccaacctgtatgcctatgaaagcatggatattgagtttgaatgtacagtctctggaaagcctgtgcccactgtgaattggatgaagaatggagatgtggtcattcctagtgattattttcagatagtgggaggaagcaacttacggatacttggggtggtgaagtcagatgaaggcttttatcaatgtgtggctgaaaatgaggctggaaatgcccagaccagtgcacagctcattgtccctaagcctgctatcccaagctccagtgtcctcccttcggctcccagagatgtggtccctgtcttggtttccagccgatttgtccgtctcagctggcgcccacctgcagaagcgaaagggaacattcaaactttcacggtctttttctccagagaaggtgacaacagggaacgagcattgaatacaacacagcctgggtcccttcagctcactgtgggaaacctgaagccagaagccatgtacacctttcgagttgtggcttacaatgaatggggaccgggagagagttctcaacccatcaaggtggccacacagcctgagttgcaagttccagggccagtagaaaacctgcaagctgtatctacctcacctacctcaattcttattacctgggaaccccctgcctatgcaaacggtccagtccaaggttacagattgttctgcactgaggtgtccacaggaaaagaacagaatatagaggttgatggactatcttataaactggaaggcctgaaaaaattcaccgaatatagtcttcgattcttagcttataatcgctatggtccgggcgtctctactgatgatataacagtggttacactttctgacgtgccaagtgccccgcctcagaacgtctccctggaagtggtcaattcaagaagtatcaaagttagctggctgcctcctccatcaggaacacaaaatggatttattaccggctataaaattcgacacagaaagacgacccgcaggggtgagatggaaacactggagccaaacaacctctggtacctattcacaggactggagaaaggaagtcagtacagtttccaggtgtcagccatgacagtcaatggtactggaccaccttccaactggtatactgcagagactccagagaatgatctagatgaatctcaagttcctgatcaaccaagctctcttcatgtgaggccccagactaactgcatcatcatgagttggactcctcccttgaacccaaacatcgtggtgcgaggttatattatcggttatggcgttgggagcccttacgctgagacagtgcgtgtggacagcaagcagcgatattattccattgagaggttagagtcaagttcccattatgtaatctccctaaaagcttttaacaatgccggagaaggagttcctctttatgaaagtgccaccaccaggtctataaccgatcccactgacccagttgattattatcctttgcttgatgatttccccacctcggtcccagatctctccacccccatgctcccaccagtaggtgtacaggctgtggctcttacccatgatgctgtgagggtcagctgggcagacaactctgtccctaagaaccaaaagacgtctgaggtgcgactttacaccgtccggtggagaaccagcttttctgcaagtgcaaaatacaagtcagaagacacaacatctctaagttacacagcaacaggcctcaaaccaaacacaatgtatgaattctcggtcatggtaacaaaaaacagaaggtccagtacttggagcatgactgcacatgccaccacgtatgaagcagcccccacctctgctcccaaggacttgacagtcattactagggaagggaagcctcgtgccgtcattgtgagttggcagcctcccttggaagccaatgggaaaattactgcttacatcttattttataccttggacaagaacatcccaattgatgactggattatggaaacaatcagtggtgataggcttactcatcaaatcatggatctcaaccttgatactatgtattactttcgaattcaagcacgaaattcaaaaggagtggggccactctctgatcctatcctcttcaggactctgaaagtggaacaccctgacaaaatggctaatgaccaaggtcgtcatggagatggaggttattggccagttgatactaatttgattgatagaagcaccctaaatgagccgccaattggacaaatgcaccccccgcatggcagtgtcactcctcagaagaacagcaacctgcttgtgatcattgtggtcaccgttggtgtcatcacagtgctggtagtggtcatcgtggctgtgatttgcacccgacgctcttcagcccagcagagaaagaaacgggccacccacagtgctggcaaaaggaagggcagccagaaggacctccgaccccctgatctttggatccatcatgaagaaatggagatgaaaaatattgaaaagccatctggcactgaccctgcaggaagggactctcccatccaaagttgccaagacctcacaccagtcagccacagccagtcagaaacccaactgggaagcaaaagcacctctcattcaggtcaagacactgaggaagcagggagctctatgtccactctggagaggtcgctggctgcacgccgagccccccgggccaagctcatgattcccatggatgcccagtccaacaatcctgctgtcgtgagcgccatcccggtgccaacgctagaaagtgcccagtacccaggaatcctcccgtctcccacctgtggatatccccacccgcagttcactctccggcctgtgccattcccaacactctcagtggaccgaggtttcggagcaggaagaagtcagtcagtgagtgaaggaccaactacccaacaaccacctatgctgcccccatctcagcctgagcattctagcagcgaggaggcaccaagcagaaccatccccacagcttgtgttcgaccaactcacccactccgcagctttgctaatcctttgctacctccaccaatgagtgcaatagaaccgaaagtcccttacacaccacttttgtctcagccagggcccactcttcctaagacccatgtgaaaacagcctcccttgggttggctggaaaagcaagatcccctttgcttcctgtgtctgtgccaacagcccctgaagtgtctgaggagagccacaaaccaacagaggattcagccaatgtgtatgaacaggatgatctgagtgaacaaatggcaagtttggaaggactcatgaagcagcttaatgccatcacaggctcagccttttaacatgtatttctgaatggatgaggtgaattttccgggaactttgcagcataccaattacccataaacagcacacctgtgtccaagaactctaaccagtgtacaggtcacccatcaggaccactcagttaaggaagatcctgaagcagttcagaaggaataagcattccttctttcacaggcatcaggaattgtcaaatgatgattatgagttccctaaacaaaagcaaagatgcattttcactgcaatgtcaaagtttaagctgctagaatagtcatgggcctttgtcactgcagtgaccacactgtcataactaatacctatgttttcctttgtcaaggcctgttgtttaatgtgtaggtctagtcttacaaaatgcaagtgcattatttaagcctgtaccatgccatggcaaaccagtgcaagctcactattttgttttcaacttaaacatacaaagcacccatgggaatctctcatgccatagcaccaaaggattggatgttttccttacagcacaaaaagtaaatagtaaacaaacaaaaggcagagaatgcttatgtttgtaactcagtcattcatcttgcacaagtggtggatattagtgagtggctaaaaattcacctattttggcaagtatttgtaaatccacccttggttaatatgtatgtctggagtccaggaatataaaaatctgcaactagtggcattctgccagcagcagtacatttctggaaagaggatataatatgcaatcttctcagacacatggtaattatatgcttaagcttgtaataggacagttttcaatttgggtggcttttgtgccataccacactgtgatacaatttcaaagcttcactaaggccatcttccttaggagtttggccagaagaatgcccccaccccttcaccccatccctccctgagttctccttggcaactagcgttgggtgaaatggccagctccacatgtcatatggtgcactggccaatgtcgcctgtcttctaatcccgtagaaatggcagactccctgagagcaggaagagaaggaaaataaaaggtagcttctaacagtaccttctcttaaagaatgccaactctgcctacagggtcagtgttggcaagcattggccaccagacccttttgttaagggaaacttttacactacacctgtgtcagagtcagggggaagcagaggggcaggtgccacctgacacttccgacatgtaaatccagcagatacttttcaaagcagcatcttaaactgtggactacagttttaaacttctattgccatgtttatctacagcttggaactagctaaaattaagaacattttgtatgcagcattttagtttctgaattttcagctgcatttggagttaatccctgtttatgcagctgaatcgccaaaagggagctagtttgcatatttatcagttaggtgacttgaaaacccaatgagagagtttcagctgaattattcctttcagctctgcctttgatttcaagcttgagtaggtcataattttaaaagagcatggaagggataggatctttacaacctaatagctccttttattaggtgggtaattatatatgaatccctgaataaaatattttgagcaaaatggcactgtaacagaagtaataattcagtttatttttttacagttttatgtcgggaaggaaatctgatgtcaaagagagggctgttcaaatggttcattagaaagtccggtccatttgcgaatttgttccttcaacaagagtgctcattcaagttactcagattttctggaagtcttttctgaagagctatgtgatgttgttctatgggacagactactcttatttaacatctgggcacttaggtagacaaccttctactgacctggaataaagtgtttcctaacataatattgaattattcagaaataatccattacttcaaaaaagaaaatattcattgggctagcccaaccttctctaggccctaagaattattacctcccctttctaattctagcaaacatggaacattctccttaggcacttgacacccacgagggtaatcctgagtgctcagtttggaataggttgcaaatctcagattttagggattgagtcacaccttcaatctatagaatgaagttgaccaattaaaaaaaaaaaaaaaacctatcattttcacaaatttctagatccttctagtcaaaaataattatttaggaaataaaatttttaaaaatccatttaaatacatgttatttgtcttcagtggaagttatatttctgctgcatgcttttgaaactttcttcattaaatagaatggtttgtcttagtaactggcaatgccagtattagcaccatgcatttaatctataatacaatcaatttaaacatcctcaaaaaactctagtatcatttacctggtagtattaatatacaatgatgtcaccacaacttttgtataactctgttccctttaccctcaaatgattcatatatgtatataattgcctgcccaagttttcaggtaacttattaatttcccagtctcctgatctcttgacaagaagaaacctgtgaatactgcaaactagcctctgacttcctcctactgagtctagttcatggtatccaggactctttatgctcataactctctctgattcccattgggtgatacctgacagccaaccagccgctctgccaccagaactcatttctccctgaaaaagaagaaaatcatatttggcagagcattctctggtctgccctgtaatgtgcttaaatgtcaggcaacatcctcttttttttaaaaaaaatggtatttttctttaaatttcaccctaataagaaagctattttctctcctctgcagaaatttctgcatttgtgaaacttataaaaatttagatagttcaaatgtataaagaatatttggatgatgctctagccaaaagttaaatatttcgtagtgaatcatagccaataagaaaccagtcatacttgcctctttgaataacagagatataagcttctagaatatttaaataatgaagttttacatttgggtattataaaatgcatactcaattgaatgagctgaaaaaaataccaagccagtgatataagtggagatttattaaggattcctgttgagtatattcttagtttcctcaaaatagggattattcaaaattaggtgtatgttcaatctcctgctttggttccagctacacaaggagagccatcctgtgctagtgtgatgtttcagacaacattctgaaactaaaatgtttggcacttattggcttttccaataaagaatctcttaagtacaggtatttctggaagctgttggtgtctgtgcttgaagatgattgctgatacttatccaccctttgggtacttctgttgactttgtttaaataatcatcttatggttgtccccaaatgtaatatggtatctcagatatagcagctggactgtaattacaacaaaaggttacctctaaagataacatcttaccattttagataaaattgtgtcccagaattcttatggtttcggaatgtacatttctagtcaatgaaagaaagaaaaatggaaaaattgtctagtttcaggcatgtttaaagaaaacaaagtcatctgaactttaaaatagatgcagagcagggttactttccctttcactcagttcccttcatgcaaccacaggcagtcctgcaggccagaggttactatcctaacctgctcataaccatatactatacagagcccacaactttctggagatgcagaagcagccatacactcaagtctctgtttttgtaaatcacattcaaagcaacattttactcataatttgcatttctctggtgactttcagaaatcactttagtattgtacagaaaagctttttatttgagtctagtgtttaaaattaaattggatacttgggaaaatcatagataggtgttttgtatgatattccattccaatgcaaaatatatgtacccatgcctcaatgtatcttgctatctaaatacctgttgccaaaaagtattgatttgggaaaaaaaatgccaatttcctggtcagtgaggttatgtaaaagacaaaataccacacccatatcagcaaatgaatattactactcatctggactcttcgttgccactattgcataacgttcacgtggcagacttccagttgcactctctgaaggacttttttctcttactctcaatagagagcctttgtacattgtcatcctatgattgttgttggtagaagagcaagagcaaaactctgcaagatttaataaacacaggggcatgggccaagggatctcactgtgtgctgaacatgtattttcagatgcaagaaaggaatgatggagaggaggagaaatgctgttttttattattgtagggtaaatctgacaattctgaactttgtgaattgtcagcttgtttgggggaagggtgggcgggtatggggtgtactttttataagtaatatttaatttattatttagagtggcttctttttggataatttatgataaaaagggagatctggttgggatctagatacggctgttaaagctgcagtgttccatacctcagagggaccactttggaaatgaattgtccattgctgagtatgaagagatgtccagtccaggcaaagccttcactgaagttccatcatcgccacttctccctttttagggtcattcaaagaagataacaccaaacctaaataattctgaaagcattttgcagatcagtgctactcattcaaagggctttgcaactcaaacagattgttagtgtgctagtgataagtttatttggtagaaatgggtatactacagctttaactagccttagtgagaaaagaaattttttgttgttacaaaacaccttttttaacaaaaaggtattttgagcctacaaaaagtttctttaaactgtcagattctagcattgttaaccaaattagactagtgattgcaatatttaagtgtaaatcttgttctacaagaaaggaaacttgcttacagtttaaaacaatgactgtttctacacatgatcttgtatactactacacaaggaaaagggggttttgtaaacactgtagaacagtctcatattcatttttttatagaaatgttattccaatggtgcattttttgtttaataaataaagttttgatacaaa

SEQ ID NO: 1332 - DNA, 1251 bp, Homo sapiens
ctattgtttctacctcaccctggcccaggaagacagatctactgaggaaagccctgaacactctgcggcttctctgagaaaccctatcgaaggggatgtggaatcccagagctactcttgctatcaactcgccgcatgaccttgggaaaatcatttcacctggttcagcaatgatttactgagctattgaaggccttactttccagatccagatccttgtgcatacaactgacttgtgtgggtgaggcttgcagaaaaaatcagctagaacagccttgggggtagtggcaaggtggccagagcaattgactgggagctgggaacaggaatgaagaggaagagctgataagaaacatgcccagagcagatttgatgctactgccaatgtacctgaataagaagacaactctttctggaaaaagggaaaacttgaagggctattgaaggccgctagaaagtacagaaggaactttggatgtgggagagaaagacaaggagaaacctgaaagcagcccagttatgacaatgaatgttctggaggctgggaagtggaagagcattgtgccagcacctggtgagggccttcttgccgtgttacacatgatggtttttactgatgccctgcacagagagaggtctgtaaagtggcaagcaggagtctgctacaatggaggaaaggattttgctgtatctcttgccaggcccaaggctgcagagggaattgcagattgaatgtaagtgacttggaaaaggaagaggagttgccagaaacagctaaaatgtcagtagaagacttgacagcttgagaatagaggaaaaaataaaagcgaagcagacaaaaagaaccttacctcccccacaatacaacattgggctgctgaacccacaaaaatctaaatccgtttagaatcatctatttaactcctcagagacatgcacaaactattctagagaggcttgtgcctacgaagattacttaagaatgtgttgacacatttggagggggttaatttaccagttatcatttactagaaaggctttttctataagaatatatgaaagagtttcctcggagcattcaaccgggcttctttgtagggtatgtgtactgcttggagctacggaagaccacgtcctagaagtgctgtgtccctgaggcacacctatgtgtgttatctctctggcatactttccaacaaggattcttttctagtctatacattctgattaatttgcagtcagaggcaatgc

SEQ ID NO: 1333 - DNA, 2451 bp, Homo sapiens
tgggcctggttgtggaggccccttttgcaaaacctcagtctgaatttagtagacagaagtcactaggaatgccttgacaggatcctgccttagctaaggctccctccagctgcagagggtgtttttgttagactcacacactgcgtgaaactgctcagaatagagccatgatctcaaccacgaaatgggaacttagattttggagaaactaacggggacggacttctttcctagcctgagtgttgagcagtgtcatgccttggcgtttcagctcctcgttgtctaggtggtgaaatgacagaactcattcgcttctttgattggtgattttgaaataatctttcatcaagttccatctcctttaccctcatatggaatatatctctctgtctgttgttaaactacgatgacatgtctgtagctatcagaaagagaagctgggaagaacatgtgacccactggatgggacagccttttaattctgatgatcgtaacacagcatgtcatcatggactagtagctgacagcttgcaggcaagtatggaaaaagatgcaactctaaatgtggaccgcaaagagaagtgtgtttcactacctgactgctgtcatggatcagagctgagagattttcctgggaggccaatgggtcatctttcaaaggatgtggacgaaaatgacagccatgaaggtgaagatcagtttctttctctggaagccagcacagaaacactagtgcatgtttctgatgaggataacaatgctgatttatgccttacagatgataaacaggttttaaatacccaagggcagaaaacatcaggccaacatatgatccaaggagcaggctccttagaaaaggcactgcccatcatacaaagtaaccaagtttcttctaactcctggggaatagctggtgaaactgaattagcactggtaaaagaaagtggggagagaaaagttactgactctataagtaaaagcctggagctttgcaatgaaataagcttaagtgaaataaaagatgcacccaaagtaaatgcagtggatactttgaacgtgaaagatattgcacctgagaaacaattgcttaactctgctgtaattgctcagcaacgaaggaaacctgacccccctaaagatgaaaatgaaagaagcacctgcaatgtagtacaaaatgagttcttggatactccttgcacaaacagaggactgccattattaaaaacagattttggaagctgccttctgcagcctccttcctgccccaatggaatgtcagctgaaaatggcctggagaagagtggtttttcacaacatcaaaacaaaagtccaccaaaggtcaaggcagaagatggcatgcagtgtttacaattaaaggagaccctggccacccaggaacccacagataaccaagtcagacttcgtaagagaaaggaaataagagaagatcgagatagggcgcggctggactccatggtgctgctgattatgaaactggaccagcttgatcaggacatagaaaatgccctcagcaccagctcctctccatcaggcacaccaacaaacctgcggcggcacgttcctgatctggaatcaggatctgaaagtggagcagataccatttcagtaaatcagacacgagtaaatttgtcttctgacactgagtccacggacctcccatcttccactccagtagccaattctggaaccaaacccaagactacggctattcaaggtatttcagagaaggaaaaggctggtaagttgacattttggttctgttttctcgccaatctattttagaataaatttcaccttaaaataggcattttattaaatatataaaatgtatacatctcatgaatatatgggaaaatgttgtttaaattctgtaaaagaaatttgttttgctcaatatgtaagaaaaatatacgtggttttctgacataatgacattgtgttagaataagatatgtgtttcttggggtcttccttgtaactgcaaccacaatttttttttcttaagcaaaagaattaaatgttgatcaaggttctggggaatgaatttggaaattagttattaataattaccaaggtttatttttactcttaatgacttagtagccacagaaaaagatgtaattgatgcttaaagctgatgccatactatcaaaaatatagtgatgaagcaatgtgaataattgtattgaagaaaaaaattatagtatttttctgtgttctgtgctttaattataattatttaacagtattatgggaaatggacaaggactgatgagaaatgaaaatatgaaaaattagacatggattggtagatctatgtgtttttaaaaaatcatactatcttatgtgttctgtgtaataaaaacgaaaacagattaaaggtatattatctaacttgaagtacatcacttagtttgtagacatttgtga

SEQ ID NO: 1334 - DNA, 6426 bp, Homo sapiens
gttagcggcgtctcggttgccatggagaccaggagctccaaaacgcggaggtctttagcgtcccggaccaacgagtgccaggggacaatgtgggcgccaacttcgccaccagccgggtccagcagccccagccagcccacctggaagtcctccttgtattcctccctcgcctactctgaggccttccactacagcttcgcagcccggccccgccgcctcacgcagcttgcgctggcgcagcgtcccgagcctcagctgcttcgtctgcgcccctcctcgctgcgcacccaagatatctcgcacttgctcaccggcgtcttccgcaacttgtactcagccgaggtcatcggcgacgaagtgagcgcaagcttgatcaaggcccgcggcagcgagaatgagcgccacgaggagttcgtggaccagctgcagcagattcgggagctctataagcagcggctggatgagtttgaaatgttggagagacatatcactcaggcccaagcacgggctattgcggaaaatgagcgggtcatgagccaggctggagtacaggacctcgagagccttgtcaggttgcctccagtgaagagtgtctccagatggtgtatagacagcgagttgctacggaaacatcatttgatctccccagaagattactacaccgatacagtgccgtttcactctgcacctaaaggcatctccctacctggatgttcaaaactgacatttagctgtgagaagcgttccgtccagaagaaagagctgaacaagaagcttgaagattcatgcaggaagaagcttgctgagttcgaagatgagttagaccacactgtggacagcctgacatggaatttaactcctaaggccaaagaaaggaccagagaacctctcaagaaagcaagtcaaccaaggaataaaaactggatgaaccacttacgtgtgccacagagagagctagacagacttctgcttgccagaatggagagtcggaaccacttcctaaaaaatccccgtttttttcctcctaacactcgatatggaggcaagtctcttgtttttcctccaaagaagccagcaccgataggagaattccagagtacagagccagaacagagttgtgctgatactccagtgtttctagctaagccaccaattgggtttttcacagattatgaaattggtccagtttatgagatggtaattgcgctgcagaacaccaccacgaccagccgctacctgcgagtcctcccgccttccacgccatacttcgctctgggactggggatgttcccaggaaaaggtggaatggtggctcctggaatgacctgccagtacattgtccagttttttcccgactgccttggggattttgatgattttattttagtggagacccagtcagcccacacacttctgatccccctgcaggcccggaggccgccccccgtgctgacattgtcaccggtgttggactgtggttactgcctcattgggggagtcaagatgaccagattcatctgcaaaaatgtgggtttcagtgttggcaggttctgcattatgcccaaaacaagctggccaccactaagtttcaaggccattgcaaccgtcggctttgttgaacaacctccttttggaatcctgccttcggtgtttgagctggccccgggacatgctatattagtggaggtcttgttttccccaaagagcctaggaaaggcagagcagaccttcatcatcatgtgcgacaactgccagataaaggagctggtgaccataggaattgggcagctgattgctttggatctgatctatatttctggtgaaaaaagccagccagaccctggagagctcacagacttaacagcccagcacttcatacgatttgagcctgaaaaccttcggtccacggctaggaagcagctgattattagaaatgctacgcacgtggagctggccttctactggcagatcatgaagcccaacctgcagcccctcatgcctggagaaaccttcagcatggacagcatcaagtgctaccccgacaaggagactgccttctccatcatgcccagaaagggggttctaagcccccacacagaccacgagttcatcctgagcttttctcctcatgagctgagggattttcacagtgtgctccagatggtgctagaggaagtcccagagcctgtaagttcagaagcggagagcctggggcactcctcctactctgtggatgatgtgattgtcctggaaatcgaggtgaaaggctcagtagaacctttccaggttctcttagagccatatgccctcatcatcccaggggagaactacattgggataaatgtgaagaaggcttttaagatgtggaacaacagcaagtcacccatcagatacctgtgggggaagatcagcgactgccacatcattgaagtggagcccggcacaggggtcatagagcccagtgaggtcggggattttgagttgaactttactgggggtgtccctggccccacaagccaggacctgctgtgtgaaatcgaagactcgccctcgccagtggtgttacacattgaggctgtctttaaggggcctgccctcatcatcaacgtctcagcccttcagtttggtctgctccgcctggggcagaaagccacaaactccatccagatccggaacgtcagccagctcccagccacatggcgcatgaaggagagcccagtctccctccaggaaaggcctgaggatgtgtctcccttcgacattgagccttcgagtggccagcttcactctctgggggagtgcagggtggacatcaccttggaggccctgcactgccagcatctggagaccgtcctggagctggaggtggaaaatggtgcctggagctaccttcctgtgtatgctgaggtacagaagccccatgtgtacctacagagcagccaggtggaggttagaaatctctacctgggtgtgcccacgaagacaaccatcacacttatcaatggcacgctcctgcctacccagttccactggggcaagctcctcggacaccaagcagaattctgcatggtgacagtctcccccaaacatggcctgctgggcccaagtgaggagtgccagctcaagttggagttgactgctcatacccaggaagagctgacccatctggccctcccttgtcacgtgtcaggcatgaagaagccactggttctaggcatttctgggaagccccagggactgcaagtggccattaccatctctaaggagagctctgattgcagcacagagcagtggccaggccacccaaaggagctccgcctggactttggctcagcggtgccactgaggacccgtgtgactcgccagctcattctcaccaatcgctccccaatacggacccgtttctccctcaagtttgagtatttcgggagcccccaaaacagcctgagcaaaaagaccagccttcccaacatgcctcctgccctgctaaagacagtgcggatgcaagagcacctggccaagcgagagcagctggattttatggagagcatgctatcccacgggaaaggagctgctttcttccctcacttttcccagggcatgctggggccctaccagcagctgtgcattgacatcacaggctgtgccaacatgtggggcgagtactgggacaacctcatctgcacggtgggagacctgctgccggaagtcatcccagtgcacatggcagcggtgggctgccccatcagctccctgaggaccacctcctacactattgaccaggcccagaaggaaccagccatgaggttcggcacccaggtctccggaggagacacagttacccgaacccttcgcctgaataactccagcccctgtgacatccgcctggattgggagacctatgttccagaagacaaggaagaccggctggtggagctgctggtgttttatgggccacctttcccgctgcgggaccaagccgggaatgagcttgtgtgccctgatacccctgagggtggctgcctcctctggtccccaggcccctccagttcatcggaattcagccatgaaactgactcatcagttgagggcagctccagtgccagcaatagggtggcacagaagctcatctcagtcatcctgcaggcacatgagggggtgccctccggccacctgtactgtatcagccccaagcaggtggtggtccctgctgggggcagcagtaccatctacatctccttcacccctatggtgctcagccctgagatcctgcacaaggtggagtgtactggctacgccctgggtttcatgagcttggacagcaaggtggaaagggagattccagggaagaggcatcgcctgcaggactttgcggtgggacccctgaaactggacctgcatagctacgtgaggcctgcacagctaagtgtggagctggactacggcggcagtatggaattccagtgccaggccagtgacctcattcccgagcagccctgctctggggtgctgagtgagctggtgaccacccaccacctgaagctgaccaacactacagagatcccacactacttccggcttatggtctccaggcccttctccgtttctcaagatggggcgagccaggaccacagagctcctggccctggccagaagcaggagtgtgaggaggagacagcctcagcggacaagcagctggtgctccaagcacaggagaacatgctggtgaacgtgtccttctcactctccctggagctgctctcctatcagaagctcccagctgaccagacactgcctggggtggacattcagcagagtgcgagtggagagagagagatggtgtttactcagaacctgctcctggagtacaccaaccagaccactcaggtggtgcccctgcgggctgtggtggccgtgcctgagctgcagctctccaccagctgggtggactttgggacctgctttgtgagccagcagcgagtccgggaggtctacctgatgaacctgagcgggtgccgaagctactggactatgctgatgggccagcaggagccagccaaggccgctgtggccttcagggtctccccaaacagtgggctgctagaagcacgatccgccaatgcacccccaacctccatcgccttgcaggttttcttcactgccaggagtagtgagctgtacgagtccacgatggtggtggaaggtgtgctcggtgagaagtcctgcaccctgcggctccggggccaaggctcctatgatgagagatacatgttgcctcaccagccctgaggctccgccccagccctcagccccaggccccagctggagaaaaaacattgcccagggattaggagcagctcttcagcacaaagacacagacttggggacctggggacctctgggcagctcctggaatggaagaacccccttccacaatggtctcagcctaggccctcatgatatgtcctcagagctaacataaaggacaggccacaccacagcagagaccaccacattgagatcactactcagtgcatagcgaagaccagtatggcaaaattagtcttggaaaaaaaccacagccactaagataaattcatgcacttttactatgcccattgcacttctcatccatggatttgccttgccttaagaattaaccatggccttgtggcctgggtgacccaggctgcttttatcttgcacagctaaagagggtctgatgggtggctcaacaccccacccactcctataccatgtcatcagtgttcacattttccaaatgagttgaagtgccttgatctgtccactgccaccaccaccagtgctgagttttcccatgtggttttgcttttgtggtgttactgccttgctgctagagcagcaggactgtctgcgtagcgcctccagcctgggacctcactcagttcccagggtattcaaagacggcagcggctcccattccagtcccgatgcacatggacaccactccgtatgccctgtgaaaacaaaacttaattggctgggcaaaggcacccaccaaattacctccagaccaggctgacccagaaggacgtcatggacaagtaggatgcaaaaccatcagaccagatctgtgggcaagcggtaccctggcctcccacttgggcacacacacggtgacagatgcccactgcaggctagtatccctttcaaggctggcccttaaggaaaacagggatcatgcccctacatcctaagttcagggtgtttctgtgtgcatgttcccctccccagggatcgatcataatcccaaaagacacaatcccaaacacaatcatcccaaatgttgaaatcctggaagaacaaaatccctaaagtctaaaatcctgaaaatcacaatcctaaaagatcaaaatcctgaaaatataattctggaaaaaataa

SEQ ID NO: 1335 - DNA, 5491 bp, Homo sapiens
gttagcggcgtctcggttgccatggagaccaggagctccaaaacgcggaggtctttagcgtcccggaccaacgagtgccaggggacaatgtgggcgccaacttcgccaccagccgggtccagcagccccagccagcccacctggaagtcctccttgtattcctccctcgcctactctgaggccttccactacagcttcgcagcccggccccgccgcctcacgcagcttgcgctggcgcagcgtcccgagcctcagctgcttcgtctgcgcccctcctcgctgcgcacccaagatatctcgcacttgctcaccggcgtcttccgcaacttgtactcagccgaggtcatcggcgacgaagtgagcgcaagcttgatcaaggcccgcggcagcgagaatgagcgccacgaggagttcgtggaccagctgcagcagattcgggagctctataagcagcggctggatgagtttgaaatgttggagagacatatcactcaggcccaagcacgggctattgcggaaaatgagcgggtcatgagccaggctggagtacaggacctcgagagccttgtcaggttgcctccagtgaagagtgtctccagatggtgtatagacagcgagttgctacggaaacatcatttgatctccccagaagattactacaccgatacagtgccgtttcactctgcacctaaaggcatctccctacctggatgttcaaaactgacatttagctgtgagaagcgttccgtccagaagaaagagctgaacaagaagcttgaagattcatgcaggaagaagcttgctgagttcgaagatgagttagaccacactgtggacagcctgacatggaatttaactcctaaggccaaagaaaggaccagagaacctctcaagaaagcaagtcaaccaaggaataaaaactggatgaaccacttacgtgtgccacagagagagctagacagacttctgcttgccagaatggagagtcggaaccacttcctaaaaaatccccgtttttttcctcctaacactcgatatggaggcaagtctcttgtttttcctccaaagaagccagcaccgataggagaattccagagtacagagccagaacagagttgtgctgatactccagtgtttctagctaagccaccaattgggtttttcacagattatgaaattggtccagtttatgagatggtaattgcgctgcagaacaccaccacgaccagccgctacctgcgagtcctcccgccttccacgccatacttcgctctgggactggggatgttcccaggaaaaggtggaatggtggctcctggaatgacctgccagtacattgtccagttttttcccgactgccttggggattttgatgattttattttagtggagacccagtcagcccacacacttctgatccccctgcaggcccggaggccgccccccgtgctgacattgtcaccggtgttggactgtggttactgcctcattgggggagtcaagatgaccagattcatctgcaaaaatgtgggtttcagtgttggcaggttctgcattatgcccaaaacaagctggccaccactaagtttcaaggccattgcaaccgtcggctttgttgaacaacctccttttggaatcctgccttcggtgtttgagctggccccgggacatgctatattagtggaggtcttgttttccccaaagagcctaggaaaggcagagcagaccttcatcatcatgtgcgacaactgccagataaaggagctggtgaccataggaattgggcagctgattgctttggatctgatctatatttctggtgaaaaaagccagccagaccctggagagctcacagacttaacagcccagcacttcatacgatttgagcctgaaaaccttcggtccacggctaggaagcagctgattattagaaatgctacgcacgtggagctggccttctactggcagatcatgaagcccaacctgcagcccctcatgcctggagaaaccttcagcatggacagcatcaagtgctaccccgacaaggagactgccttctccatcatgcccagaaagggggttctaagcccccacacagaccacgagttcatcctgagcttttctcctcatgagctgagggattttcacagtgtgctccagatggtgctagaggaagtcccagagcctgtaagttcagaagcggagagcctggggcactcctcctactctgtggatgatgtgattgtcctggaaatcgaggtgaaaggctcagtagaacctttccaggttctcttagagccatatgccctcatcatcccaggggagaactacattgggataaatgtgaagaaggcttttaagatgtggaacaacagcaagtcacccatcagatacctgtgggggaagatcagcgactgccacatcattgaagtggagcccggcacaggggtcatagagcccagtgaggtcggggattttgagttgaactttactgggggtgtccctggccccacaagccaggacctgctgtgtgaaatcgaagactcgccctcgccagtggtgttacacattgaggctgtctttaaggggcctgccctcatcatcaacgtctcagcccttcagtttggtctgctccgcctggggcagaaagccacaaactccatccagatccggaacgtcagccagctcccagccacatggcgcatgaaggagagcccagtctccctccaggaaaggcctgaggatgtgtctcccttcgacattgagccttcgagtggccagcttcactctctgggggagtgcagggtggacatcaccttggaggccctgcactgccagcatctggagaccgtcctggagctggaggtggaaaatggtgcctggagctaccttcctgtgtatgctgaggtacagaagccccatgtgtacctacagagcagccaggtggaggttagaaatctctacctgggtgtgcccacgaagacaaccatcacacttatcaatggcacgctcctgcctacccagttccactggggcaagctcctcggacaccaagcagaattctgcatggtgacagtctcccccaaacatggcctgctgggcccaagtgaggagtgccagctcaagttggagttgactgctcatacccaggaagagctgacccatctggccctcccttgtcacgtgtcaggcatgaagaagccactggttctaggcatttctgggaagccccagggactgcaagtggccattaccatctctaaggagagctctgattgcagcacagagcagtggccaggccacccaaaggagctccgcctggactttggctcagcggtgccactgaggacccgtgtgactcgccagctcattctcaccaatcgctccccaatacggacccgtttctccctcaagtttgagtatttcgggagcccccaaaacagcctgagcaaaaagaccagccttcccaacatgcctcctgccctgctaaagacagtgcggatgcaagagcacctggccaagcgagagcagctggattttatggagagcatgctatcccacgggaaaggagctgctttcttccctcacttttcccagggcatgctggggccctaccagcagctgtgcattgacatcacaggctgtgccaacatgtggggcgagtactgggacaacctcatctgcacggtgggagacctgctgccggaagtcatcccagtgcacatggcagcggtgggctgccccatcagctccctgaggaccacctcctacactattgaccaggcccagaaggaaccagccatgaggttcggcacccaggtctccggaggagacacagttacccgaacccttcgcctgaataactccagcccctgtgacatccgcctggattgggagacctatgttccagaagacaaggaagaccggctggtggagctgctggtgttttatgggccacctttcccgctgcgggaccaagccgggaatgagcttgtgtgccctgatacccctgagggtggctgcctcctctggtccccaggcccctccagttcatcggaattcagccatgaaactgactcatcagttgagggcagctccagtgccagcaatagggtggcacagaagctcatctcagtcatcctgcaggcacatgagggggtgccctccggccacctgtactgtatcagccccaagcaggtggtggtccctgctgggggcagcagtaccatctacatctccttcacccctatggtgctcagccctgagatcctgcacaaggtggagtgtactggctacgccctgggtttcatgagcttggacagcaaggtggaaagggagattccagggaagaggcatcgcctgcaggactttgcggtgggacccctgaaactggacctgcatagctacgtgaggcctgcacagctaagtgtggagctggactacggcggcagtatggaattccagtgccaggccagtgacctcattcccgagcagccctgctctggggtgctgagtgagctggtgaccacccaccacctgaagctgaccaacactacagagatcccacactacttccggcttatggtctccaggcccttctccgtttctcaagatggggcgagccaggaccacagagctcctggccctggccagaagcaggagtgtgaggaggagacagcctcagcggacaagcagctggtgctccaagcacaggagaacatgctggtgaacgtgtccttctcactctccctggagctgctctcctatcagaagctcccagctgaccagacactgcctggggtggacattcagcagagtgcgagtggagagagagagatggtgtttactcagaacctgctcctggagtacaccaaccagaccactcaggtggtgcccctgcgggctgtggtggccgtgcctgagctgcagctctccaccagctgggtggactttgggacctgctttgtgagccagcagcgagtccgggaggtctacctgatgaacctgagcgggtgccgaagctactggactatgctgatgggagtagtgagctgtacgagtccacgatggtggtggaaggtgtgctcggtgagaagtcctgcaccctgcggctccggggccaaggctcctatgatgagagatacatgttgcctcaccagccctgaggctccgccccagccctcagccccaggccccagctggagaaaaaacattgcccagggattaggagcagctcttcagcacaaagacacagacttggggacctggggacctctgggcagctcctggaatggaagaacccccttccacaatggtctcagcctaggccctcatgatatgtcctcagagctaacataaaggacaggccacaccacagcagagaccaccacattgagatcactactcagtgcatagcgaagaccagtatggcaaaattagtcttggaaaaaaaccacagccactaagataaattcatgcacttttactatgc

SEQ ID NO: 1336 - DNA, 5624 bp, Homo sapiens
gttagcggcgtctcggttgccatggagaccaggagctccaaaacgcggaggtctttagcgtcccggaccaacgagtgccaggggacaatgtgggcgccaacttcgccaccagccgggtccagcagccccagccagcccacctggaagtcctccttgtattcctccctcgcctactctgaggccttccactacagcttcgcagcccggccccgccgcctcacgcagcttgcgctggcgcagcgtcccgagcctcagctgcttcgtctgcgcccctcctcgctgcgcacccaagatatctcgcacttgctcaccggcgtcttccgcaacttgtactcagccgaggtcatcggcgacgaagtgagcgcaagcttgatcaaggcccgcggcagcgagaatgagcgccacgaggagttcgtggaccagctgcagcagattcgggagctctataagcagcggctggatgagtttgaaatgttggagagacatatcactcaggcccaagcacgggctattgcggaaaatgagcgggtcatgagccaggctggagtacaggacctcgagagccttgtcaggttgcctccagtgaagagtgtctccagatggtgtatagacagcgagttgctacggaaacatcatttgatctccccagaagattactacaccgatacagtgccgtttcactctgcacctaaaggcatctccctacctggatgttcaaaactgacatttagctgtgagaagcgttccgtccagaagaaagagctgaacaagaagcttgaagattcatgcaggaagaagcttgctgagttcgaagatgagttagaccacactgtggacagcctgacatggaatttaactcctaaggccaaagaaaggaccagagaacctctcaagaaagcaagtcaaccaaggaataaaaactggatgaaccacttacgtgtgccacagagagagctagacagacttctgcttgccagaatggagagtcggaaccacttcctaaaaaatccccgtttttttcctcctaacactcgatatggaggcaagtctcttgtttttcctccaaagaagccagcaccgataggagaattccagagtacagagccagaacagagttgtgctgatactccagtgtttctagctaagccaccaattgggtttttcacagattatgaaattggtccagtttatgagatggtaattgcgctgcagaacaccaccacgaccagccgctacctgcgagtcctcccgccttccacgccatacttcgctctgggactggggatgttcccaggaaaaggtggaatggtggctcctggaatgacctgccagtacattgtccagttttttcccgactgccttggggattttgatgattttattttagtggagacccagtcagcccacacacttctgatccccctgcaggcccggaggccgccccccgtgctgacattgtcaccggtgttggactgtggttactgcctcattgggggagtcaagatgaccagattcatctgcaaaaatgtgggtttcagtgttggcaggttctgcattatgcccaaaacaagctggccaccactaagtttcaaggccattgcaaccgtcggctttgttgaacaacctccttttggaatcctgccttcggtgtttgagctggccccgggacatgctatattagtggaggtcttgttttccccaaagagcctaggaaaggcagagcagaccttcatcatcatgtgcgacaactgccagataaaggagctggtgaccataggaattgggcagctgattgctttggatctgatctatatttctggtgaaaaaagccagccagaccctggagagctcacagacttaacagcccagcacttcatacgatttgagcctgaaaaccttcggtccacggctaggaagcagctgattattagaaatgctacgcacgtggagctggccttctactggcagatcatgaagcccaacctgcagcccctcatgcctggagaaaccttcagcatggacagcatcaagtgctaccccgacaaggagactgccttctccatcatgcccagaaagggggttctaagcccccacacagaccacgagttcatcctgagcttttctcctcatgagctgagggattttcacagtgtgctccagatggtgctagaggaagtcccagagcctgtaagttcagaagcggagagcctggggcactcctcctactctgtggatgatgtgattgtcctggaaatcgaggtgaaaggctcagtagaacctttccaggttctcttagagccatatgccctcatcatcccaggggagaactacattgggataaatgtgaagaaggcttttaagatgtggaacaacagcaagtcacccatcagatacctgtgggggaagatcagcgactgccacatcattgaagtggagcccggcacaggggtcatagagcccagtgaggtcggggattttgagttgaactttactgggggtgtccctggccccacaagccaggacctgctgtgtgaaatcgaagactcgccctcgccagtggtgttacacattgaggctgtctttaaggggcctgccctcatcatcaacgtctcagcccttcagtttggtctgctccgcctggggcagaaagccacaaactccatccagatccggaacgtcagccagctcccagccacatggcgcatgaaggagagcccagtctccctccaggaaaggcctgaggatgtgtctcccttcgacattgagccttcgagtggccagcttcactctctgggggagtgcagggtggacatcaccttggaggccctgcactgccagcatctggagaccgtcctggagctggaggtggaaaatggtgcctggagctaccttcctgtgtatgctgaggtacagaagccccatgtgtacctacagagcagccaggtggaggttagaaatctctacctgggtgtgcccacgaagacaaccatcacacttatcaatggcacgctcctgcctacccagttccactggggcaagctcctcggacaccaagcagaattctgcatggtgacagtctcccccaaacatggcctgctgggcccaagtgaggagtgccagctcaagttggagttgactgctcatacccaggaagagctgacccatctggccctcccttgtcacgtgtcaggcatgaagaagccactggttctaggcatttctgggaagccccagggactgcaagtggccattaccatctctaaggagagctctgattgcagtgttttcagcacagagcagtggccaggccacccaaaggagctccgcctggactttggctcagcggtgccactgaggacccgtgtgactcgccagctcattctcaccaatcgctccccaatacggacccgtttctccctcaagtttgagtatttcgggagcccccaaaacagcctgagcaaaaagaccagccttcccaacatgcctcctgccctgctaaagacagtgcggatgcaagagcacctggccaagcgagagcagctggattttatggagagcatgctatcccacgggaaaggagctgctttcttccctcacttttcccagggcatgctggggccctaccagcagctgtgcattgacatcacaggctgtgccaacatgtggggcgagtactgggacaacctcatctgcacggtgggagacctgctgccggaagtcatcccagtgcacatggcagcggtgggctgccccatcagctccctgaggaccacctcctacactattgaccaggcccagaaggaaccagccatgaggttcggcacccaggtctccggaggagacacagttacccgaacccttcgcctgaataactccagcccctgtgacatccgcctggattgggagacctatgttccagaagacaaggaagaccggctggtggagctgctggtgttttatgggccacctttcccgctgcgggaccaagccgggaatgagcttgtgtgccctgatacccctgagggtggctgcctcctctggtccccaggcccctccagttcatcggaattcagccatgaaactgactcatcagttgagggcagctccagtgccagcaatagggtggcacagaagctcatctcagtcatcctgcaggcacatgagggggtgccctccggccacctgtactgtatcagccccaagcaggtggtggtccctgctgggggcagcagtaccatctacatctccttcacccctatggtgctcagccctgagatcctgcacaaggtggagtgtactggctacgccctgggtttcatgagcttggacagcaaggtggaaagggagattccagggaagaggcatcgcctgcaggactttgcggtgggacccctgaaactggacctgcatagctacgtgaggcctgcacagctaagtgtggagctggactacggcggcagtatggaattccagtgccaggccagtgacctcattcccgagcagccctgctctggggtgctgagtgagctggtgaccacccaccacctgaagctgaccaacactacagagatcccacactacttccggcttatggtctccaggcccttctccgtttctcaagatggggcgagccaggaccacagagctcctggccctggccagaagcaggagtgtgaggaggagacagcctcagcggacaagcagctggtgctccaagcacaggagaacatgctggtgaacgtgtccttctcactctccctggagctgctctcctatcagaagctcccagctgaccagacactgcctggggtggacattcagcagagtgcgagtggagagagagagatggtgtttactcagaacctgctcctggagtacaccaaccagaccactcaggtggtgcccctgcgggctgtggtggccgtgcctgagctgcagctctccaccagctgggtggactttgggacctgctttgtgagccagcagcgagtccgggaggtctacctgatgaacctgagcgggtgccgaagctactggactatgctgatgggccagcaggagccagccaaggccgctgtggccttcagggtctccccaaacagtgggctgctagaagcacgatccgccaatgcacccccaacctccatcgccttgcaggttttcttcactgccaggagtagtgagctgtacgagtccacgatggtggtggaaggtgtgctcggtgagaagtcctgcaccctgcggctccggggccaaggctcctatgatgagagatacatgttgcctcaccagccctgaggctccgccccagccctcagccccaggccccagctggagaaaaaacattgcccagggattaggagcagctcttcagcacaaagacacagacttggggacctggggacctctgggcagctcctggaatggaagaacccccttccacaatggtctcagcctaggccctcatgatatgtcctcagagctaacataaaggacaggccacaccacagcagagaccaccacattgagatcactactcagtgcatagcgaagaccagtatggcaaaattagtcttggaaaaaaaccacagccactaagataaattcatgcacttttactatgc

SEQ ID NO: 1337 - DNA, 981 bp, Homo sapiens
gcacatgcgcagaatcatcgtggtgcacggctctccctttgcttcttcggttgcagtcctcttgcttcttgcgcgtgcgtgtagcgcttttgcaaagccgcggaggtgaagtgaacttagaggttgtggggccgaggggtcgtcttatagctaccagcccacaggcatttagtctacgttggaggtaaacaaatacgggtcctgcttaggagaaaagaaaaacgtcttacagccagtgtctaaactccaaacaacggaatgtatcaatgagaccttgtatatggatacacgtgcatttaaaaccgccctgccggcttgtagagcttttgccgttctccagcgctttacaggggttatcgcacttaagcctcggaacaactttaccagtgattctaccagaaaggaatgaagaacagaaccttcaggaattgagtcacaatgcagacaaatatcaaatgggagattgttgcaaggaagagattgatgatagtattttctactagccattgggaagataaaaggagacagaagattgaagcctttgccagccattctttccctttttgcttccaaactcctcaactgggaaccttcatatgtgcagtatttatattggatcatactggtgattataaaagttcctaggaggctagaagagccaaccaacagagaagggaaagcagtctgttctgaacatagggacataagttcattcatgccaagtatctttccagcatgtttctcccatttagaatatctagcatgtaaggcctttcaatattaatataagcccaatatcagctctttctctttgtatttcatctctttctactctcctatttgtattttgtgttcctatcaaagtgtcgtatctgggagatgacctgccttatcctgttctataacagttttgtttgctgctgtgtctttagaacagtgcctggcacacagtaagcactcaataaatctttgatgaatgaa

SEQ ID NO: 1338 - DNA, 1294 bp, Homo sapiens
gccattttcgagtgatgcctgatctcatcaatctagcgggagagacaggataacctgtccgagagtatagcgccactatgactccgccggaaaaattactttaaaaatcgccaaaaattacttggagcaaagggcagtcggcggagcttcgccaaggctggcgcagtcggttttgacctgtagcagagaaccaattctggagaacagcctcacttctttgattgaatacttacataatgcattggaacatgacatgagattaaggtttaataatgatagaatgaagaccacaataaaagagacctctacttagctcagcaattcttacctttcatttcatgtttttcccttgatgtgaagtcttacctatttgatgaagatgtcttttgaaaggtgtactgcaaggaacaaaatgtttgtaaattctccttttaccaaggtggataattactgtaccttcctcatggaaaaagttttatttaaagtgttatttctcattgaatactatcaaaaaggaaaaaaaaatgacctaaacttttgagatagatttggctctagtaagtatttagttatatcacttgcatatctgggagaagaaataagagactatcatcagtacattcccatctactaaaaaaatttattttacacatgtcaagggattacttataacttccattttattactaatagcttgaacccttttaatgaagacctaactcctccaccagaaatttaagtttatgttcttactttgtttacttataaaatacatctcaggtatttcggatgtcttttttttttctaagcctatatgaaatgaaaaatatattggcaaaataaatgtttaaaccttttacgttaaaattactttgaaagatgaaaagttagtgctgtttttgtctacgttatactgaaattaaatgtttataatttatattttgggtttatgtataaatcatggaatttatgcaaaaatatgagtagtacagattctcctctaattctgtaggactttgaataatgtgatatttttcttataattggacccttgtgttttgaagaaatgccaactgcttgaagaatctccttgttatttgtattatttgctatagggttagatgttgagaaattctgctgacaaaaaattttaagccagttttacactaaatgttcctcagtctgattaatttgttattggatgtattctgtatctttcttttgtaatttgtaacttttatccacttagcacgaatgattctattaaagaaaatcattaggaagtggtagaaac

SEQ ID NO: 1339 - DNA, 1116 bp, Homo sapiens
gatgcctgatctcatcaatctagcgggagagacaggataacctgtccgagagtatagcgccactatgactccgccggaaaaattactttaaaaatcgccaaaaattacttggagcaaagggcagtcggcggagcttcgccaaggctggcgcagtcggttttgacctgtagcagagaaccaattctggagaacagcctcacttctttgattgaatacttacataatgcattggaacatgacatgagattaaggtttaataatgatagaatgaagaccacaataaaagagacctctacttagctcagcaattcttacctttcttacctatttgatgaagatgtcttttgaaaggtgtactgcaaggaacaaaatgtttgtaaattctccttttaccaaggtttcttttttaattgatgccaaagagttccaatattgaacatcttaagtctgttacttggattacggattgagtttggagcttactcagaggactacaggagagtatccaggaagtagcaagaaatgtggataattactgtaccttcctcatggaaaaagttttatttaaagtgttatttctcattgaatactatcaaaaaggaaaaaaaaatgacctaaacttttgagatagatttggctctagtaagtatttagttatatcacttgcatatctgggagaagaaataagagactatcatcagtacattcccatctactaaaaaaatttattttacacatgtcaagggattacttataacttccattttattacgaattgcttgaacctgggaggtggaggttgcagtgggctaagatggcaccactgcactccagcctgggtgagagagcaagaccctgcctcagaaaaaaaaaaaaaaaaaatctaagacctgtatatcaaattttgagtttgtttcttcttttgtacctcaatagttacatttatcaaaaagctgagctgttgtaaaattgtggaattcacattggatattcaaaaacatttcttactattaatgacaaccaatagttatggatatttcattttaaacatggttataaaatgtaaacatgacactaataagctcaataaatgtttggcctgtctagtataataaa

SEQ ID NO: 1340 - DNA, 692 bp, Homo sapiens
ctgatctcatcaatctagcgggagagacaggataacctgtccgagagtatagcgccactatgactccgccggaaaaattactttaaaaatcgccaaaaattacttggagcaaagggcagtcggcggagcttcgccaaggctggcgcagtcggtttaataatgatagaatgaagaccacaataaaagagacctctacttagctcagcaattcttacctttcttacctatttgatgaagatgtcttttgaaaggtgtactgcaaggaacaaaatgtttgtaaattctccttttaccaaggtaaagatcaaattttataaatttacttgtttgtttatacaaggaaaaataacttcatatattgaatatattcaaaagtttaagcatttagttgtattgccctgttaagttggcatagcaaataaatgcttttcttttcctcattttattctttgtgtttcctaacctatagcactgtgctgggcacagaatggacttcagttaagtttttgatgtagaaatgttttattattctacttaaaatctccttaaaaataattatgcatattacatcaatgttataatgtttaaacatagatttttttacatgcattctttttttcctgaaagaaaatattttttatattctttaggcgcgaatgtgtgtttaaaaaaaataaaaccttggagtaaag

SEQ ID NO: 1341 - DNA, 1267 bp, Homo sapiens
ggggagcagaaggccgcgggcgggcggctggcgcgctgtgtacttaggtcgtgtgctggggcttttctctcccaggagccggcggggggaggggagggggaggggccaccgctccgccttctccttttcgcaatgttgacgcaatctataaatagtggaacaaaaggaccaacttcctcggagctttgctgaaactgcacaaaaaatcgagccggggggttccctggtccccggcgatggggcggggagcgctgcgccgggggagggggcgggcgcggcggcgcgggccccgccgaggggggacacctggctgaggcacagctgccgccgtgcctttccgcgcgagcccagagctccgatccctgcgcgggctcgagagctcgccccgaacgggggtcttcctcctccgccgttgacaggttttgacctgtagcagagaaccaattctggagaacagcctcacttctttgattgaatacttacataatgcattggaacatgacatgagattaaggtttaataatgatagaatgaagaccacaataaaagagacctctacttagctcagcaattcttacctttcttacctatttgatgaagatgtcttttgaaaggtgtactgcaaggaacaaaatgtttgtaaattctccttttaccaaggtggataattactgtaccttcctcatggaaaaagttttatttaaagtgttatttctcattgaatactatcaaaaaggaaaaaaaaatgacctaaacttttgagatagatttggctctaggcctactctaggtgcggtacttcactatagtttataaaagatggtccctgtcagcaaagaactgtaacctgtatgagaatattatactaacatacaagaaacaagtagagaataatggaatgtaaactctggcttgctaacttaagtgtggtagaagcttgaaggaaatgtggacttaaacttatcagagaagacttataagaggatatgaaaggtgtaaattttgataccaccattgccgccttcccctcaaaaaaggtgagaactgactaaactactggtacttagaccatgtggagaaggaactgaaaatggaaacagaaacacgtctgtacagagcagagtgtcagataatagctcattttagtagagggcaataaatgccacatgagatgatcacctcagcagaaaactgtaagtaactggggacttacaggagaattgaacagttgtttctgctgactcagtaaaaagtcttcattttataa

SEQ ID NO: 1342 - DNA, 699 bp, Homo sapiens
cgccattttcgagtgatgcctgatctcatcaatctagcgggagagacaggataacctgtccgagagtatagcgccactatgactccgccggaaaaattactttaaaaatcgccaaaaattacttggagcaaagggcagtcggcggagcttcgccaaggctggcgcagtcgggtttaataatgatagaatgaagaccacaataaaagagacctctacttagctcagcaattcttacctttcttacctatttgatgaagatgtcttttgaaaggtgtactgcaaggaacaaaatgtttgtaaattctccttttaccaaggtggataattactgtaccttcctcatggaaaaagttttatttaaagtgttatttctcattgaatactatcaaaaaggaaaaaaaaatgacctaaacttttgagatagatttggctctagtaagtatttagttatatcacttgcatatctgggagaagaaataagagactatcatcagtacattcccatctactaaaaaaatttattttacacatgtcaagggattacttataacttccattttattactaatagcttgaacccttttaatgaagacctaactcctccaccagaaatttaagtttatgttcttactttgtttacttataaaatacatctcaggtatttcggatgtcttttttttttctaagcctatatgaaat

SEQ ID NO: 1343 - DNA, 2090 bp, Homo sapiens
gatgcctgatctcatcaatctagcgggagagacaggataacctgtccgagagtatagcgccactatgactccgccggaaaaattactttaaaaatcgccaaaaattacttggagcaaagggcagtcggcggagcttcgccaaggctggcgcagtcgccgttttctcgacccggtgatggccgtcatctcgtgacaagaaacttaaggtcgacagaaaattcaggacccggagtcatgggtccctccggtgggtcgtggcaacagtcccccccgccaccgcccggcacccatctatctatattgtcttttgacgctgaagcgtgaggtgccccaggaaagagtttcccaagccctggctgccctcccccggcgcgctgggtcccggtgaggtctctaggtaggttttgacctgtagcagagaaccaattctggagaacagcctcacttctttgattgaatacttacataatgcattggaacatgacatgagattaaggtttaataatgatagaatgaagaccacaataaaagagacctctacttagctcagcaattcttacctttcttacctatttgatgaagatgtcttttgaaaggtgtactgcaaggaacaaaatgtttgtaaattctccttttaccaaggtttcttttttaattgatgccaaagagttccaatattgaacatcttaagtctgttacttggattacggattgagtttggagcttactcagaggactacaggagagtatccaggaagtggataattactgtaccttcctcatggaaaaagttttatttaaagtgttatttctcattgaatactatcaaaaaggaaaaaaaaatgacctaaacttttgagatagatttggctctagtaagtatttagttatatcacttgcatatctgggagaagaaataagagactatcatcagtacattcccatctactaaaaaaatttattttacacatgtcaagggattacttataacttccattttattactaatagcttgaacccttttaatgaagacctaactcctccaccagaaatttaagtttatgttcttactttgtttacttataaaatacatctcaggtatttcggatgtcttttttttttctaagcctatatgaaatgaaaaatatattggcaaaataaatgtttaaaccttttacgttaaaattactttgaaagatgaaaagttagtgctgtttttgtctacgttatactgaaattaaatgtttataatttatattttgggtttatgtataaatcatggaatttatgcaaaaatatgagtagtacagattctcctctaattctgtaggactttgaataatgtgatatttttcttataattggacccttgtgttttgaagaaatgccaactgcttgaagaatctccttgttatttgtattatttgctatagggttagatgttgagaaattctgctgacaaaaaattttaagccagttttacactaaatgttcctcagtctgattaatttgttattggatgtattctgtatctttcttttgtaatttgtaacttttatccacttagcacgaatgattctattaaagaaaatcattaggaagtggtagaaactttaaatcgccccagagtttgcctgtttccatattttattatcttataatcttcgggagtgcttacacttatggagctaacattttcagagatacagcttcttatagtaacactaaaactttcttcctctttggactgaatacctataattataactatatggtagtttaagtttccttgtgattagtcaaaaataccattttagtatgaagcaatgaagtctattatttgttgtcccataattgagaaagcttaaatacaccttttattaagagtttgtaaattctagcttagtctacacagatttttatatcaatttgtttatatttttattaatgtcatttctggaagtgtgaaaatgttaatgttcaacaagcaacattaaaaatagatttgaaacatttatatatagagaggtacacatttatttactgtttaggtactgaagattatcacttaataaaaaatatatatccca

SEQ ID NO: 1344 - DNA, 705 bp, Homo sapiens
tgatctcatcaatctagcgggagagacaggataacctgtccgagagtatagcgccactatgactccgccggaaaaattactttaaaaatcgccaaaaattacttggagcaaagggcagtcggcggagcttcgccaaggctggcgcagtcggttttgacctgtagcagagaaccaattctggagaacagcctcacttctttgattgaatacttacataatgcattggaacatgacatgagattaagtgtataaagccaaatgtcccatttaaagtttgacatttgcaatagcattctatttaaaaggtttaataatgatagaatgaagaccacaataaaagagacctctacttagctcagcaattcttacctttcttacctatttgatgaagatgtcttttgaaaggtgtactgcaaggaacaaaatgtttgtaaattctccttttaccaaggtggataattactgtaccttcctcatggaaaaagttttatttaaagtgttatttctcattgaatactatcaaaaaggaaaaaaaaatgacctaaacttttgagatagatttggctctagtaagtatttagttatatcacttgcatatctgggagaagaaataagagactatcatcagtacattcccatctactaaaaaaatttattttacacatgtcaagggattacttataacttccattttattactaatag

SEQ ID NO: 1345 - DNA, 791 bp, Homo sapiens
gatgcctgatctcatcaatctagcgggagagacaggataacctgtccgagagtatagcgccactatgactccgccggaaaaattactttaaaaatcgccaaaaattacttggagcaaagggcagtcggcggagcttcgccaaggctggcgcagtcggttttgacctgtagcagagaaccaattctggagaacagcctcacttctttgattgaatacttacataatgcattggaacatgacatgagattaaggtttaataatgatagaatgaagaccacaataaaagagacctctacttagctcagcaattcttacctttcttacctatttgatgaagatgtcttttgaaaggtgtactgcaaggaacaaaatgtttgtaaattctccttttaccaaggtaaagatcaaattttataaatttacttgtttgtttatacaaggaaaaataacttcatatattgaatatattcaaaagtttaagcatttagttgtattgccctgttaagttggcatagcaaataaatgcttttcttttcctcattttattctttgtgtttcctaacctatagcactgtgctgggcacagaatggacttcagttaagtttttgatgtagaaatgttttattattctacttaaaatctccttaaaaataattatgcatattacatcaatgttataatgtttaaacatagatttttttacatgcattctttttttcctgaaagaaaatattttttatattctttaggcgcgaatgtgtgtttaaaaaaaataaaaccttggagtaaa

SEQ ID NO: 1346 - DNA, 1251 bp, Homo sapiens
gatgcctgatctcatcaatctagcgggagagacaggataacctgtccgagagtatagcgccactatgactccgccggaaaaattactttaaaaatcgccaaaaattacttggagcaaagggcagtcggcggagcttcgccaaggctggcgcagtcggttttgacctgtagcagagaaccaattctggagaacagcctcacttctttgattgaatacttacataatgcattggaacatgacatgagattaaggtttaataatgatagaatgaagaccacaataaaagagacctctacttagctcagcaattcttacctttcttacctatttgatgaagatgtcttttgaaaggtgtactgcaaggaacaaaatgtttgtaaattctccttttaccaaggtggataattactgtaccttcctcatggaaaaagttttatttaaagtgttatttctcattgaatactatcaaaaaggaaaaaaaaatgacctaaacttttgagatagatttggctctagtaagtatttagttatatcacttgcatatctgggagaagaaataagagactatcatcagtacattcccatctactaaaaaaatttattttacacatgtcaagggattacttataacttccattttattactaatagcttgaacccttttaatgaagacctaactcctccaccagaaatttaagtttatgttcttactttgtttacttataaaatacatctcaggtatttcggatgtcttttttttttctaagcctatatgaaatgaaaaatatattggcaaaataaatgtttaaaccttttacgttaaaattactttgaaagatgaaaagttagtgctgtttttgtctacgttatactgaaattaaatgtttataatttatattttgggtttatgtataaatcatggaatttatgcaaaaatatgagtagtacagattctcctctaattctgtaggactttgaataatgtgatatttttcttataattggacccttgtgttttgaagaaatgccaactgcttgaagaatctccttgttatttgtattatttgctatagggttagatgttgagaaattctgctgacaaaaaattttaagccagttttacactaaatgttcctcagtctgattaatttgttattggatgtattctgtatctttcttttgtaatttgtaacttttatccacttagcacgaatgattctattaaagaaaatcattaggaagtggtagaaa

SEQ ID NO: 1347 - DNA, 5802 bp, Homo sapiens
tttatagcagcagtagaaatataccaccctagaggacacacctccttttagctaggtacctataaatgtccaggattttctattcaattgagaagaacccagcaaaatggggatctccacagtcatccttgaaatgtgtcttttatggggacaagttctatctacaggtgggtggatcccaaggactacagactacgcttcactgattccctcggaggtgcccttggatccaactgtagcagaaggttctccatttccctcggagtcgaccctggagtcaactgtagcagaaggttctccgatttccttggagtcaaccctggagtcaaccgtagcagaaggttctctgattccctcagagtcaaccctggagtcaactgtagcagaaggatctgattctggtttggccctgaggctggtgaatggagatggcaggtgtcagggccgagtggagatcctataccgaggctcctggggcaccgtgtgtgatgacagctgggacaccaatgatgccaacgtggtctgtaggcagctgggttgtggctgggccatgtcagctccaggaaatgcctggtttggccagggctcaggacccattgccctggatgatgtgcgctgctcaggacacgaatcctacctgtggagctgcccccacaatggctggctctcccataactgtggccatggtgaagatgctggtgttatctgctcagctgcccagcctcagtcaacactcaggccagaaagttggcctgtcaggatatcaccacctgtacccacagaaggatctgaatccagtttggccctgaggctggtgaatggaggcgacaggtgtcgaggccgagtggaggtcctataccgaggctcctggggcaccgtgtgtgatgactactgggacaccaatgatgccaatgtggtctgcaggcagctgggctgtggctgggccatgtcagccccaggaaatgcccagtttggccagggctcaggacccattgtcctggatgatgtgcgctgctcaggacatgagtcctacctgtggagctgcccccacaatggctggctcacccacaactgtggccatagtgaagacgctggtgtcatctgctcagctccccagtcccggccgacacccagcccagatacttggccgacctcacatgcatcaacagcaggacctgaatccagtttggccctgaggctggtgaatggaggtgacaggtgtcagggccgagtggaggtcctataccgaggctcctggggcaccgtgtgtgatgatagctgggacaccagtgacgccaatgtggtctgccggcagctgggctgtggctgggccacgtcagccccaggaaatgcccggtttggccagggttcaggacccattgtcctggatgacgtgcgctgctcaggctatgagtcctacctgtggagctgcccccacaatggctggctctcccataactgtcagcacagtgaagacgctggtgtcatctgctcagctgcccactcctggtcgacgcccagtccagacacattgccgaccatcaccttgcctgcatcgacagtaggatctgaatccagtttggccctgaggctggtgaatggaggtgacaggtgtcagggccgagtggaggtcctataccaaggctcctggggcaccgtgtgcgatgacagctgggacaccaatgatgccaatgtcgtctgcaggcaactgggctgtggctgggccatgtcagccccaggaaatgcccggtttggtcagggctcaggacccattgtcctggatgatgtgcgctgctcaggacacgagtcttacctgtggagctgcccccacaatggctggctctcccacaactgtggccatagtgaagacgctggtgtcatctgctcagcttcccagtcccggccaacacctagtccagacacttggccaacctcacatgcatcaacagcaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccatgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctcacatgcatcaacagcaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccacgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctctcgtgcatcaacagcaggatctgaatccactttggccctgagactggtgaatggaggtgacaggtgtcgaggccgagtggaggtcctataccaaggctcctggggcaccgtgtgtgatgactactgggacaccaatgatgccaacgtggtctgcaggcagctgggctgtggctgggccatgtcagccccaggaaatgcccagtttggccagggctcaggacccattgtcctggatgatgtgcgctgctcaggacacgagtcttacctgtggagctgcccccacaatggctggctctcccacaactgtggccatcatgaagatgctggtgtcatctgctcagctgctcagtcccagtcaacgcccaggccagatacttggctgaccaccaacttaccggcattgacagtaggatctgaatccagtttggctctgaggctggtgaatggaggtgacaggtgtcgaggccgagtggaggtcctgtatcgaggctcctggggaaccgtgtgtgatgacagctgggacaccaatgatgccaatgtggtctgcaggcagctgggctgtggctgggccatgtcggccccaggaaatgcccggtttggccagggctcaggacccattgtcctggatgatgtgcgctgctcagggaatgagtcctacctgtggagctgcccccacaaaggctggctcacccacaactgtggccatcacgaagacgctggtgtcatctgctcagccacccaaataaattctactacgacagattggtggcatccaacaactacaaccactgcaagaccctcttcaaattgtggtggcttcttattctatgccagtgggacattctccagcccatcctaccctgcatactaccccaacaatgctaagtgtgtttgggaaatagaagtgaattctggttatcgcataaacctgggcttcagtaatctgaaattggaggcacaccataactgcagttttgattatgttgaaatctttgatggatcattgaatagcagtctcctgctggggaaaatctgtaatgataccaggcaaatatttacatcttcttacaaccgaatgaccattcactttcgaagtgacatcagtttccaaaacactggctttttggcttggtataactccttcccaagcgatgccaccttgaggttggtcaatttaaattcatcctatggtctatgtgccgggcgtgtagaaatttaccatggtggcacctgggggacagtttgtgatgactcctggaccattcaggaagctgaggtggtctgcagacagctagggtgtggacgtgcagtttcagcccttggaaatgcatattttggctctggctctggccccatcaccctggacgatgtagagtgctcagggacggaatccactctctggcagtgccggaaccgaggctggttctcccacaactgtaatcatcgtgaagatgctggtgtcatctgctcaggaaaccatctatcgacacctgctccttttctcaacatcacccgtccaaacacagattattcctgcggaggcttcctatcccaaccatcaggggacttttccagcccattctatcccgggaactatccaaacaatgccaagtgtgtgtgggacattgaggtgcaaaacaactaccgtgtgactgtgatcttcagagatgtccagcttgaaggtggctgcaactatgattatattgaagttttcgatggcccctaccgcagttcccctctcattgctcgagtttgtgatggggccagaggctccttcacttcttcctccaacttcatgtccattcgcttcatcagtgaccacagcatcacaaggagagggttccgggctgagtactactccagtccctccaatgacagcaccaacctgctctgtctgccaaatcacatgcaagccagtgtgagcaggagctatctccaatccttgggcttttctgccagtgaccttgtcatttccacctggaatggatactacgagtgtcggccccagataacgccgaacctggtgatattcacaattccctactcaggctgcggcaccttcaagcaggcagacaatgacaccatcgactattccaacttcctcacagcagctgtctcaggtggcatcatcaagaggaggacagacctccgtattcacgtcagctgcagaatgcttcagaacacctgggtcgacaccatgtacattgctaatgacaccatccacgttgctaataacaccatccaggtcgaggaagtccagtatggcaattttgacgtgaacatttccttttatacttcctcatctttcttgtatcctgtgaccagccgcccttactacgtggacctgaaccaggacttgtacgttcaggctgaaatcctccattctgatgctgtactgaccttgtttgtggacacctgcgtggcatcaccatactccaatgacttcacgtctttgacttatgatctaatccggagtggatgcgtgagggatgacacctacggaccctactcctcgccatctcttcgcattgcccgcttccggttcagggccttccacttcctgaaccgcttcccctccgtgtacctgcgttgtaaaatggtggtgtgcagagcgtatgacccctcttcccgctgctaccgaggctgtgtgttgaggtcgaagagggatgtgggctcctaccaggaaaaggtggacgtcgtcctgggtcccatccagctgcagacccccccacgccgagaagaggagcctcggtaggtggtcgctctcagaccccactgtccaccggggcgcagacccctgactcggggacttgggatgttcctcttggtgtcatattccaactcagattgagccctacattgtgctgcacctggtcatacggagttgaatcagacctggttcccgcctcccccaaggctcatggtccttggaggacccgttgcagggtgaggtcaagagagttctgacctggatggcccatagacctgacgtcccagaatccatgcttctcatctgcaaaatgaaaatgtcaatacttacttcttagcactgttgagagggttacttacataaaggaattttggtgaaactgc

SEQ ID NO: 1348 - DNA, 5802 bp, Homo sapiens; identical to SEQ ID NO: 1347

SEQ ID NO: 1349 - DNA, 7686 bp, Homo sapiens
tttatagcagcagtagaaatataccaccctagaggacacacctccttttagctaggtacctataaatgtccaggattttctattcaattgagaagaacccagcaaaatggggatctccacagtcatccttgaaatgtgtcttttatggggacaagttctatctacaggtgggtggatcccaaggactacagactacgcttcactgattccctcggaggtgcccttggatccaactgtagcagaaggttctccatttccctcggagtcgaccctggagtcaactgtagcagaaggttctccgatttccttggagtcaaccctggagtcaaccgtagcagaaggttctctgattccctcagagtcaaccctggagtcaactgtagcagaaggatctgattctggtttggccctgaggctggtgaatggagatggcaggtgtcagggccgagtggagatcctataccgaggctcctggggcaccgtgtgtgatgacagctgggacaccaatgatgccaacgtggtctgtaggcagctgggttgtggctgggccatgtcagctccaggaaatgcctggtttggccagggctcaggacccattgccctggatgatgtgcgctgctcaggacacgaatcctacctgtggagctgcccccacaatggctggctctcccataactgtggccatggtgaagatgctggtgttatctgctcagctgcccagcctcagtcaacactcaggccagaaagttggcctgtcaggatatcaccacctgtacccacagaaggatctgaatccagtttggccctgaggctggtgaatggaggcgacaggtgtcgaggccgagtggaggtcctataccgaggctcctggggcaccgtgtgtgatgactactgggacaccaatgatgccaatgtggtctgcaggcagctgggctgtggctgggccatgtcagccccaggaaatgcccagtttggccagggctcaggacccattgtcctggatgatgtgcgctgctcaggacatgagtcctacctgtggagctgcccccacaatggctggctcacccacaactgtggccatagtgaagacgctggtgtcatctgctcagctccccagtcccggccgacacccagcccagatacttggccgacctcacatgcatcaacagcaggacctgaatccagtttggccctgaggctggtgaatggaggtgacaggtgtcagggccgagtggaggtcctataccgaggctcctggggcaccgtgtgtgatgatagctgggacaccagtgacgccaatgtggtctgccggcagctgggctgtggctgggccacgtcagccccaggaaatgcccggtttggccagggttcaggacccattgtcctggatgacgtgcgctgctcaggctatgagtcctacctgtggagctgcccccacaatggctggctctcccataactgtcagcacagtgaagacgctggtgtcatctgctcagctgcccactcctggtcgacgcccagtccagacacgttgccgaccatcaccttacctgcatcgacagtaggatctgaatccagtttggccctgaggctggtgaatggaggtgacaggtgtcagggccgagtggaggtcctataccgaggctcctggggcaccgtgtgtgatgacagctgggacaccaatgatgccaatgtggtctgcaggcagctgggctgtggctgggccatgttggccccaggaaatgcccggtttggtcagggctcaggacccattgtcctggatgacgtgcgctgctcagggaatgagtcctacttgtggagctgcccccacaatggctggctctcccataactgtggccatagtgaagacgctggtgtcatctgctcaggacctgaatccagtttggccctgaggctggtgaatggaggtgacaggtgtcagggccgagtggaggtcctataccgaggctcttggggcaccgtgtgtgatgacagctgggacaccaatgatgccaatgtggtctgcaggcagctgggctgtggctgggccacgtcagccccaggaaatgcccggtttggtcagggctcaggacccattgtcctggatgatgtgcgctgctcaggacatgagtcctacctgtggagctgccccaacaatggctggctctcccacaactgtggccatcatgaagatgctggtgtcatctgctcagctgcccagtcccggtcgacgcccaggccagacacgttgtcgaccatcacgttacctccatcgacagtaggatctgaatccagtttgaccctgaggctggtgaatggaagtgacaggtgtcagggccgagtagaggtcctataccgaggctcctggggcaccgtgtgtgatgacagctgggataccaatgatgccaatgtggtctgcaggcagctgggctgtggctgggccacgtcggccccaggaaatgcccggtttggccagggctcaggacccattgttctggatgatgtgcgctgctcaggacacgagtcctacctgtggagctgcccccacaatggctggctctcccacaactgtggccatcatgaagatgctggtgtcatctgctcagtttcccagtcccggccgacacccagtccagatacttggccgacctcacatgcatcaacagcaggacctgaatccagtttggccctgaggctggtgaatggaggtgacaggtgtcagggccgagtggaggtcctataccgaggctcctggggcaccgtgtgtgatgatagctgggacaccagtgacgccaatgtggtctgccggcagctgggctgtggctgggccacgtcagccccaggaaatgcccggtttggccagggttcaggacccattgtcctggatgacgtgcgctgctcaggctatgagtcctacctgtggagctgcccccacaatggctggctctcccataactgtcagcacagtgaagacgctggtgtcatctgctcagctgcccactcctggtcgacgcccagtccagacacattgccgaccatcaccttgcctgcatcgacagtaggatctgaatccagtttggccctgaggctggtgaatggaggtgacaggtgtcagggccgagtggaggtcctataccaaggctcctggggcaccgtgtgcgatgacagctgggacaccaatgatgccaatgtcgtctgcaggcaactgggctgtggctgggccatgtcagccccaggaaatgcccggtttggtcagggctcaggacccattgtcctggatgatgtgcgctgctcaggacacgagtcttacctgtggagctgcccccacaatggctggctctcccacaactgtggccatagtgaagacgctggtgtcatctgctcagcttcccagtcccggccaacacctagtccagacacttggccaacctcacatgcatcaacagcaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccatgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctcacatgcatcaacagcaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccacgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctcacatgcatcaacagcaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccacgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctctcgtgcatcaacagcaggatctgaatccactttggccctgagactggtgaatggaggtgacaggtgtcgaggccgagtggaggtcctataccaaggctcctggggcaccgtgtgtgatgactactgggacaccaatgatgccaacgtggtctgcaggcagctgggctgtggctgggccatgtcagccccaggaaatgcccagtttggccagggctcaggacccattgtcctggatgatgtgcgctgctcaggacacgagtcttacctgtggagctgcccccacaatggctggctctcccacaactgtggccatcatgaagatgctggtgtcatctgctcagctgctcagtcccagtcaacgcccaggccagatacttggctgaccaccaacttaccggcattgacagtaggatctgaatccagtttggctctgaggctggtgaatggaggtgacaggtgtcgaggccgagtggaggtcctgtatcgaggctcctggggaaccgtgtgtgatgacagctgggacaccaatgatgccaatgtggtctgcaggcagctgggctgtggctgggccatgtcggccccaggaaatgcccggtttggccagggctcaggacccattgtcctggatgatgtgcgctgctcagggaatgagtcctacctgtggagctgcccccacaaaggctggctcacccacaactgtggccatcacgaagacgctggtgtcatctgctcagccacccaaataaattctactacgacagattggtggcatccaacaactacaaccactgcaagaccctcttcaaattgtggtggcttcttattctatgccagtgggacattctccagcccatcctaccctgcatactaccccaacaatgctaagtgtgtttgggaaatagaagtgaattctggttatcgcataaacctgggcttcagtaatctgaaattggaggcacaccataactgcagttttgattatgttgaaatctttgatggatcattgaatagcagtctcctgctggggaaaatctgtaatgataccaggcaaatatttacatcttcttacaaccgaatgaccattcactttcgaagtgacatcagtttccaaaacactggctttttggcttggtataactccttcccaagcgatgccaccttgaggttggtcaatttaaattcatcctatggtctatgtgccgggcgtgtagaaatttaccatggtggcacctgggggacagtttgtgatgactcctggaccattcaggaagctgaggtggtctgcagacagctagggtgtggacgtgcagtttcagcccttggaaatgcatattttggctctggctctggccccatcaccctggacgatgtagagtgctcagggacggaatccactctctggcagtgccggaaccgaggctggttctcccacaactgtaatcatcgtgaagatgctggtgtcatctgctcaggaaaccatctatcgacacctgctccttttctcaacatcacccgtccaaacacagattattcctgcggaggcttcctatcccaaccatcaggggacttttccagcccattctatcccgggaactatccaaacaatgccaagtgtgtgtgggacattgaggtgcaaaacaactaccgtgtgactgtgatcttcagagatgtccagcttgaaggtggctgcaactatgattatattgaagttttcgatggcccctaccgcagttcccctctcattgctcgagtttgtgatggggccagaggctccttcacttcttcctccaacttcatgtccattcgcttcatcagtgaccacagcatcacaaggagagggttccgggctgagtactactccagtccctccaatgacagcaccaacctgctctgtctgccaaatcacatgcaagccagtgtgagcaggagctatctccaatccttgggcttttctgccagtgaccttgtcatttccacctggaatggatactacgagtgtcggccccagataacgccgaacctggtgatattcacaattccctactcaggctgcggcaccttcaagcaggcagacaatgacaccatcgactattccaacttcctcacagcagctgtctcaggtggcatcatcaagaggaggacagacctccgtattcacgtcagctgcagaatgcttcagaacacctgggtcgacaccatgtacattgctaatgacaccatccacgttgctaataacaccatccaggtcgaggaagtccagtatggcaattttgacgtgaacatttccttttatacttcctcatctttcttgtatcctgtgaccagccgcccttactacgtggacctgaaccaggacttgtacgttcaggctgaaatcctccattctgatgctgtactgaccttgtttgtggacacctgcgtggcatcaccatactccaatgacttcacgtctttgacttatgatctaatccggagtggatgcgtgagggatgacacctacggaccctactcctcgccatctcttcgcattgcccgcttccggttcagggccttccacttcctgaaccgcttcccctccgtgtacctgcgttgtaaaatggtggtgtgcagagcgtatgacccctcttcccgctgctaccgaggctgtgtgttgaggtcgaagagggatgtgggctcctaccaggaaaaggtggacgtcgtcctgggtcccatccagctgcagacccccccacgccgagaagaggagcctcggtaggtggtcgctctcagaccccactgtccaccggggcgcagacccctgactcggggacttgggatgttcctcttggtgtcatattccaactcagattgagccctacattgtgctgcacctggtcatacggagttgaatcagacctggttcccgcctcccccaaggctcatggtccttggaggacccgttgcagggtgaggtcaagagagttctgacctggatggcccatagacctgacgtcccagaatccatgcttctcatctgcaaaatgaaaatgtcaatacttacttcttagcactgttgagagggttacttacataaaggaattttggtgaaactgc

SEQ ID NO: 1350 - DNA, 5802 bp, Homo sapiens; identical to SEQ ID NO: 1347

SEQ ID NO: 1351 - DNA, 7686 bp, Homo sapiens; identical to SEQ ID NO: 1349

SEQ ID NO: 1352 - DNA, 7686 bp, Homo sapiens; identical to SEQ ID NO: 1349

SEQ ID NO: 1353 - DNA, 7656 bp, Homo sapiens
tttatagcagcagtagaaatataccaccctagaggacacacctccttttagctaggtacctataaatgtccaggattttctattcaattgagaagaacccagcaaaatggggatctccacagtcatccttgaaatgtgtcttttatggggacaagttctatctacaggtgggtggatcccaaggactacagactacgcttcactgattccctcggaggtgcccttggatccaactgtagcagaaggttctccatttccctcggagtcgaccctggagtcaactgtagcagaaggttctccgatttccttggagtcaaccctggagtcaaccgtagcagaaggttctctgattccctcagagtcaaccctggagtcaactgtagcagaaggatctgattctggtttggccctgaggctggtgaatggagatggcaggtgtcagggccgagtggagatcctataccgaggctcctggggcaccgtgtgtgatgacagctgggacaccaatgatgccaacgtggtctgtaggcagctgggttgtggctgggccatgtcagctccaggaaatgcctggtttggccagggctcaggacccattgccctggatgatgtgcgctgctcaggacacgaatcctacctgtggagctgcccccacaatggctggctctcccataactgtggccatggtgaagatgctggtgttatctgctcagctgcccagcctcagtcaacactcaggccagaaagttggcctgtcaggatatcaccacctgtacccacagaaggatctgaatccagtttggccctgaggctggtgaatggaggcgacaggtgtcgaggccgagtggaggtcctataccgaggctcctggggcaccgtgtgtgatgactactgggacaccaatgatgccaatgtggtctgcaggcagctgggctgtggctgggccatgtcagccccaggaaatgcccagtttggccagggctcaggacccattgtcctggatgatgtgcgctgctcaggacatgagtcctacctgtggagctgcccccacaatggctggctcacccacaactgtggccatagtgaagacgctggtgtcatctgctcagctccccagtcccggccgacacccagcccagatacttggccgacctcacatgcatcaacagcaggacctgaatccagtttggccctgaggctggtgaatggaggtgacaggtgtcagggccgagtggaggtcctataccgaggctcctggggcaccgtgtgtgatgatagctgggacaccagtgacgccaatgtggtctgccggcagctgggctgtggctgggccacgtcagccccaggaaatgcccggtttggccagggttcaggacccattgtcctggatgacgtgcgctgctcaggctatgagtcctacctgtggagctgcccccacaatggctggctctcccataactgtcagcacagtgaagacgctggtgtcatctgctcagacacgttgccgaccatcaccttacctgcatcgacagtaggatctgaatccagtttggccctgaggctggtgaatggaggtgacaggtgtcagggccgagtggaggtcctataccgaggctcctggggcaccgtgtgtgatgacagctgggacaccaatgatgccaatgtggtctgcaggcagctgggctgtggctgggccatgttggccccaggaaatgcccggtttggtcagggctcaggacccattgtcctggatgacgtgcgctgctcagggaatgagtcctacttgtggagctgcccccacaatggctggctctcccataactgtggccatagtgaagacgctggtgtcatctgctcaggacctgaatccagtttggccctgaggctggtgaatggaggtgacaggtgtcagggccgagtggaggtcctataccgaggctcttggggcaccgtgtgtgatgacagctgggacaccaatgatgccaatgtggtctgcaggcagctgggctgtggctgggccacgtcagccccaggaaatgcccggtttggtcagggctcaggacccattgtcctggatgatgtgcgctgctcaggacatgagtcctacctgtggagctgccccaacaatggctggctctcccacaactgtggccatcatgaagatgctggtgtcatctgctcagctgcccagtcccggtcgacgcccaggccagacacgttgtcgaccatcacgttacctccatcgacagtaggatctgaatccagtttgaccctgaggctggtgaatggaagtgacaggtgtcagggccgagtagaggtcctataccgaggctcctggggcaccgtgtgtgatgacagctgggataccaatgatgccaatgtggtctgcaggcagctgggctgtggctgggccacgtcggccccaggaaatgcccggtttggccagggctcaggacccattgttctggatgatgtgcgctgctcaggacacgagtcctacctgtggagctgcccccacaatggctggctctcccacaactgtggccatcatgaagatgctggtgtcatctgctcagtttcccagtcccggccgacacccagtccagatacttggccgacctcacatgcatcaacagcaggacctgaatccagtttggccctgaggctggtgaatggaggtgacaggtgtcagggccgagtggaggtcctataccgaggctcctggggcaccgtgtgtgatgatagctgggacaccagtgacgccaatgtggtctgccggcagctgggctgtggctgggccacgtcagccccaggaaatgcccggtttggccagggttcaggacccattgtcctggatgacgtgcgctgctcaggctatgagtcctacctgtggagctgcccccacaatggctggctctcccataactgtcagcacagtgaagacgctggtgtcatctgctcagctgcccactcctggtcgacgcccagtccagacacattgccgaccatcaccttgcctgcatcgacagtaggatctgaatccagtttggccctgaggctggtgaatggaggtgacaggtgtcagggccgagtggaggtcctataccaaggctcctggggcaccgtgtgcgatgacagctgggacaccaatgatgccaatgtcgtctgcaggcaactgggctgtggctgggccatgtcagccccaggaaatgcccggtttggtcagggctcaggacccattgtcctggatgatgtgcgctgctcaggacacgagtcttacctgtggagctgcccccacaatggctggctctcccacaactgtggccatagtgaagacgctggtgtcatctgctcagcttcccagtcccggccaacacctagtccagacacttggccaacctcacatgcatcaacagcaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccatgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctcacatgcatcaacagcaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccacgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctcacatgcatcaacagcaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccacgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctctcgtgcatcaacagcaggatctgaatccactttggccctgagactggtgaatggaggtgacaggtgtcgaggccgagtggaggtcctataccaaggctcctggggcaccgtgtgtgatgactactgggacaccaatgatgccaacgtggtctgcaggcagctgggctgtggctgggccatgtcagccccaggaaatgcccagtttggccagggctcaggacccattgtcctggatgatgtgcgctgctcaggacacgagtcttacctgtggagctgcccccacaatggctggctctcccacaactgtggccatcatgaagatgctggtgtcatctgctcagctgctcagtcccagtcaacgcccaggccagatacttggctgaccaccaacttaccggcattgacagtaggatctgaatccagtttggctctgaggctggtgaatggaggtgacaggtgtcgaggccgagtggaggtcctgtatcgaggctcctggggaaccgtgtgtgatgacagctgggacaccaatgatgccaatgtggtctgcaggcagctgggctgtggctgggccatgtcggccccaggaaatgcccggtttggccagggctcaggacccattgtcctggatgatgtgcgctgctcagggaatgagtcctacctgtggagctgcccccacaaaggctggctcacccacaactgtggccatcacgaagacgctggtgtcatctgctcagccacccaaataaattctactacgacagattggtggcatccaacaactacaaccactgcaagaccctcttcaaattgtggtggcttcttattctatgccagtgggacattctccagcccatcctaccctgcatactaccccaacaatgctaagtgtgtttgggaaatagaagtgaattctggttatcgcataaacctgggcttcagtaatctgaaattggaggcacaccataactgcagttttgattatgttgaaatctttgatggatcattgaatagcagtctcctgctggggaaaatctgtaatgataccaggcaaatatttacatcttcttacaaccgaatgaccattcactttcgaagtgacatcagtttccaaaacactggctttttggcttggtataactccttcccaagcgatgccaccttgaggttggtcaatttaaattcatcctatggtctatgtgccgggcgtgtagaaatttaccatggtggcacctgggggacagtttgtgatgactcctggaccattcaggaagctgaggtggtctgcagacagctagggtgtggacgtgcagtttcagcccttggaaatgcatattttggctctggctctggccccatcaccctggacgatgtagagtgctcagggacggaatccactctctggcagtgccggaaccgaggctggttctcccacaactgtaatcatcgtgaagatgctggtgtcatctgctcaggaaaccatctatcgacacctgctccttttctcaacatcacccgtccaaacacagattattcctgcggaggcttcctatcccaaccatcaggggacttttccagcccattctatcccgggaactatccaaacaatgccaagtgtgtgtgggacattgaggtgcaaaacaactaccgtgtgactgtgatcttcagagatgtccagcttgaaggtggctgcaactatgattatattgaagttttcgatggcccctaccgcagttcccctctcattgctcgagtttgtgatggggccagaggctccttcacttcttcctccaacttcatgtccattcgcttcatcagtgaccacagcatcacaaggagagggttccgggctgagtactactccagtccctccaatgacagcaccaacctgctctgtctgccaaatcacatgcaagccagtgtgagcaggagctatctccaatccttgggcttttctgccagtgaccttgtcatttccacctggaatggatactacgagtgtcggccccagataacgccgaacctggtgatattcacaattccctactcaggctgcggcaccttcaagcaggcagacaatgacaccatcgactattccaacttcctcacagcagctgtctcaggtggcatcatcaagaggaggacagacctccgtattcacgtcagctgcagaatgcttcagaacacctgggtcgacaccatgtacattgctaatgacaccatccacgttgctaataacaccatccaggtcgaggaagtccagtatggcaattttgacgtgaacatttccttttatacttcctcatctttcttgtatcctgtgaccagccgcccttactacgtggacctgaaccaggacttgtacgttcaggctgaaatcctccattctgatgctgtactgaccttgtttgtggacacctgcgtggcatcaccatactccaatgacttcacgtctttgacttatgatctaatccggagtggatgcgtgagggatgacacctacggaccctactcctcgccatctcttcgcattgcccgcttccggttcagggccttccacttcctgaaccgcttcccctccgtgtacctgcgttgtaaaatggtggtgtgcagagcgtatgacccctcttcccgctgctaccgaggctgtgtgttgaggtcgaagagggatgtgggctcctaccaggaaaaggtggacgtcgtcctgggtcccatccagctgcagacccccccacgccgagaagaggagcctcggtaggtggtcgctctcagaccccactgtccaccggggcgcagacccctgactcggggacttgggatgttcctcttggtgtcatattccaactcagattgagccctacattgtgctgcacctggtcatacggagttgaatcagacctggttcccgcctcccccaaggctcatggtccttggaggacccgttgcagggtgaggtcaagagagttctgacctggatggcccatagacctgacgtcccagaatccatgcttctcatctgcaaaatgaaaatgtcaatacttacttcttagcactgttgagagggttacttacataaaggaattttggtgaaactgc

SEQ ID NO: 1354 - DNA, 7686 bp, Homo sapiens; identical to SEQ ID NO: 1349

SEQ ID NO: 1355 - DNA, 3826 bp, Homo sapiens
ataccaccctagaggacacacctccttttagctaggtacctataaatgtccaggattttctattcaattgagaagaacccagcaaaatggggatctccacagtcatccttgaaatgtgtcttttatggggacaagttctatctacaggtgggtggatcccaaggactacagactacgcttcactgattccctcggaggtgcccttggatccaactgtagcagaaggttctccatttccctcggagtcgaccctggagtcaactgtagcagaaggttctccgatttccttggagtcaaccctggagtcaaccgtagcagaaggttctctgattccctcagagtcaaccctggagtcaactgtagcagaaggatctgattctggtttggccctgaggctggtgaatggagatggcaggtgtcagggccgagtggagatcctataccgaggctcctggggcaccgtgtgtgatgacagctgggacaccaatgatgccaacgtggtctgtaggcagctgggttgtggctgggccatgtcagctccaggaaatgcctggtttggccagggctcaggacccattgccctggatgatgtgcgctgctcaggacacgaatcctacctgtggagctgcccccacaatggctggctctcccataactgtggccatggtgaagatgctggtgttatctgctcagctccccagtcccggccgacacccagcccagatacttggccgacctcacatgcatcaacagcaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccacgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctctcgtgcatcaacagcaggatctgaatccactttggccctgagactggtgaatggaggtgacaggtgtcgaggccgagtggaggtcctataccaaggctcctggggcaccgtgtgtgatgactactgggacaccaatgatgccaacgtggtctgcaggcagctgggctgtggctgggccatgtcagccccaggaaatgcccagtttggccagggctcaggacccattgtcctggatgatgtgcgctgctcaggacacgagtcttacctgtggagctgcccccacaatggctggctctcccacaactgtggccatcatgaagatgctggtgtcatctgctcagccacccaaataaattctactacgacagattggtggcatccaacaactacaaccactgcaagaccctcttcaaattgtggtggcttcttattctatgccagtgggacattctccagcccatcctaccctgcatactaccccaacaatgctaagtgtgtttgggaaatagaagtgaattctggttatcgcataaacctgggcttcagtaatctgaaattggaggcacaccataactgcagttttgattatgttgaaatctttgatggatcattgaatagcagtctcctgctggggaaaatctgtaatgataccaggcaaatatttacatcttcttacaaccgaatgaccattcactttcgaagtgacatcagtttccaaaacactggctttttggcttggtataactccttcccaagcgatgccaccttgaggttggtcaatttaaattcatcctatggtctatgtgccgggcgtgtagaaatttaccatggtggcacctgggggacagtttgtgatgactcctggaccattcaggaagctgaggtggtctgcagacagctagggtgtggacgtgcagtttcagcccttggaaatgcatattttggctctggctctggccccatcaccctggacgatgtagagtgctcagggacggaatccactctctggcagtgccggaaccgaggctggttctcccacaactgtaatcatcgtgaagatgctggtgtcatctgctcaggaaaccatctatcgacacctgctccttttctcaacatcacccgtccaaacacagattattcctgcggaggcttcctatcccaaccatcaggggacttttccagcccattctatcccgggaactatccaaacaatgccaagtgtgtgtgggacattgaggtgcaaaacaactaccgtgtgactgtgatcttcagagatgtccagcttgaaggtggctgcaactatgattatattgaagttttcgatggcccctaccgcagttcccctctcattgctcgagtttgtgatggggccagaggctccttcacttcttcctccaacttcatgtccattcgcttcatcagtgaccacagcatcacaaggagagggttccgggctgagtactactccagtccctccaatgacagcaccaacctgctctgtctgccaaatcacatgcaagccagtgtgagcaggagctatctccaatccttgggcttttctgccagtgaccttgtcatttccacctggaatggatactacgagtgtcggccccagataacgccgaacctggtgatattcacaattccctactcaggctgcggcaccttcaagcaggcagacaatgacaccatcgactattccaacttcctcacagcagctgtctcaggtggcatcatcaagaggaggacagacctccgtattcacgtcagctgcagaatgcttcagaacacctgggtcgacaccatgtacattgctaatgacaccatccacgttgctaataacaccatccaggtcgaggaagtccagtatggcaattttgacgtgaacatttccttttatacttcctcatctttcttgtatcctgtgaccagccgcccttactacgtggacctgaaccaggacttgtacgttcaggctgaaatcctccattctgatgctgtactgaccttgtttgtggacacctgcgtggcatcaccatactccaatgacttcacgtctttgacttatgatctaatccggagtggatgcgtgagggatgacacctacggaccctactcctcgccatctcttcgcattgcccgcttccggttcagggccttccacttcctgaaccgcttcccctccgtgtacctgcgttgtaaaatggtggtgtgcagagcgtatgacccctcttcccgctgctaccgaggctgtgtgttgaggtcgaagagggatgtgggctcctaccaggaaaaggtggacgtcgtcctgggtcccatccagctgcagacccccccacgccgagaagaggagcctcggtaggtggtcgctctcagaccccactgtccaccggggcgcagacccctgactcggggacttgggatgttcctcttggtgtcatattccaactcagattgagccctacattgtgctgcacctggtcatacggagttgaatcagacctggttcccgcctcccccaaggctcatggtccttggaggacccgttgcagggtgaggtcaagagagttctgacctggatggcccatagacctgacgtcccagaatccatgcttctcatctgcaaaatgaaaatgtcaatacttacttcttagcactgttgagagggttacttacataaaggaattttggtgaaactgc

SEQ ID NO: 1356 - DNA, 7686 bp, Homo sapiens; identical to SEQ ID NO: 1349

SEQ ID NO: 1357 - DNA, 8073 bp, Homo sapiens
tttatagcagcagtagaaatataccaccctagaggacacacctccttttagctaggtacctataaatgtccaggattttctattcaattgagaagaacccagcaaaatggggatctccacagtcatccttgaaatgtgtcttttatggggacaagttctatctacaggtgggtggatcccaaggactacagactacgcttcactgattccctcggaggtgcccttggatccaactgtagcagaaggttctccatttccctcggagtcgaccctggagtcaactgtagcagaaggttctccgatttccttggagtcaaccctggagtcaaccgtagcagaaggttctctgattccctcagagtcaaccctggagtcaactgtagcagaaggatctgattctggtttggccctgaggctggtgaatggagatggcaggtgtcagggccgagtggagatcctataccgaggctcctggggcaccgtgtgtgatgacagctgggacaccaatgatgccaacgtggtctgtaggcagctgggttgtggctgggccatgtcagctccaggaaatgcctggtttggccagggctcaggacccattgccctggatgatgtgcgctgctcaggacacgaatcctacctgtggagctgcccccacaatggctggctctcccataactgtggccatggtgaagatgctggtgttatctgctcagctgcccagcctcagtcaacactcaggccagaaagttggcctgtcaggatatcaccacctgtacccacagaaggatctgaatccagtttggccctgaggctggtgaatggaggcgacaggtgtcgaggccgagtggaggtcctataccgaggctcctggggcaccgtgtgtgatgactactgggacaccaatgatgccaatgtggtctgcaggcagctgggctgtggctgggccatgtcagccccaggaaatgcccagtttggccagggctcaggacccattgtcctggatgatgtgcgctgctcaggacatgagtcctacctgtggagctgcccccacaatggctggctcacccacaactgtggccatagtgaagacgctggtgtcatctgctcagctccccagtcccggccgacacccagcccagatacttggccgacctcacatgcatcaacagcaggacctgaatccagtttggccctgaggctggtgaatggaggtgacaggtgtcagggccgagtggaggtcctataccgaggctcctggggcaccgtgtgtgatgatagctgggacaccagtgacgccaatgtggtctgccggcagctgggctgtggctgggccacgtcagccccaggaaatgcccggtttggccagggttcaggacccattgtcctggatgacgtgcgctgctcaggctatgagtcctacctgtggagctgcccccacaatggctggctctcccataactgtcagcacagtgaagacgctggtgtcatctgctcagctgcccactcctggtcgacgcccagtccagacacgttgccgaccatcaccttacctgcatcgacagtaggatctgaatccagtttggccctgaggctggtgaatggaggtgacaggtgtcagggccgagtggaggtcctataccgaggctcctggggcaccgtgtgtgatgacagctgggacaccaatgatgccaatgtggtctgcaggcagctgggctgtggctgggccatgttggccccaggaaatgcccggtttggtcagggctcaggacccattgtcctggatgacgtgcgctgctcagggaatgagtcctacttgtggagctgcccccacaatggctggctctcccataactgtggccatagtgaagacgctggtgtcatctgctcaggacctgaatccagtttggccctgaggctggtgaatggaggtgacaggtgtcagggccgagtggaggtcctataccgaggctcttggggcaccgtgtgtgatgacagctgggacaccaatgatgccaatgtggtctgcaggcagctgggctgtggctgggccacgtcagccccaggaaatgcccggtttggtcagggctcaggacccattgtcctggatgatgtgcgctgctcaggacatgagtcctacctgtggagctgccccaacaatggctggctctcccacaactgtggccatcatgaagatgctggtgtcatctgctcagctgcccagtcccggtcgacgcccaggccagacacgttgtcgaccatcacgttacctccatcgacagtaggatctgaatccagtttgaccctgaggctggtgaatggaagtgacaggtgtcagggccgagtagaggtcctataccgaggctcctggggcaccgtgtgtgatgacagctgggataccaatgatgccaatgtggtctgcaggcagctgggctgtggctgggccacgtcggccccaggaaatgcccggtttggccagggctcaggacccattgttctggatgatgtgcgctgctcaggacacgagtcctacctgtggagctgcccccacaatggctggctctcccacaactgtggccatcatgaagatgctggtgtcatctgctcagtttcccagtcccggccgacacccagtccagatacttggccgacctcacatgcatcaacagcaggacctgaatccagtttggccctgaggctggtgaatggaggtgacaggtgtcagggccgagtggaggtcctataccgaggctcctggggcaccgtgtgtgatgatagctgggacaccagtgacgccaatgtggtctgccggcagctgggctgtggctgggccacgtcagccccaggaaatgcccggtttggccagggttcaggacccattgtcctggatgacgtgcgctgctcaggctatgagtcctacctgtggagctgcccccacaatggctggctctcccataactgtcagcacagtgaagacgctggtgtcatctgctcagctgcccactcctggtcgacgcccagtccagacacattgccgaccatcaccttgcctgcatcgacagtaggatctgaatccagtttggccctgaggctggtgaatggaggtgacaggtgtcagggccgagtggaggtcctataccaaggctcctggggcaccgtgtgcgatgacagctgggacaccaatgatgccaatgtcgtctgcaggcaactgggctgtggctgggccatgtcagccccaggaaatgcccggtttggtcagggctcaggacccattgtcctggatgatgtgcgctgctcaggacacgagtcttacctgtggagctgcccccacaatggctggctctcccacaactgtggccatagtgaagacgctggtgtcatctgctcagcttcccagtcccggccaacacctagtccagacacttggccaacctcacatgcatcaacagcaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccatgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctcacatgcatcaacagcaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccacgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctcacatgcatcaacagcaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccacgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctcacatgcatcaacagcaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccacgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctctcgtgcatcaacagcaggatctgaatccactttggccctgagactggtgaatggaggtgacaggtgtcgaggccgagtggaggtcctataccaaggctcctggggcaccgtgtgtgatgactactgggacaccaatgatgccaacgtggtctgcaggcagctgggctgtggctgggccatgtcagccccaggaaatgcccagtttggccagggctcaggacccattgtcctggatgatgtgcgctgctcaggacacgagtcttacctgtggagctgcccccacaatggctggctctcccacaactgtggccatcatgaagatgctggtgtcatctgctcagctgctcagtcccagtcaacgcccaggccagatacttggctgaccaccaacttaccggcattgacagtaggatctgaatccagtttggctctgaggctggtgaatggaggtgacaggtgtcgaggccgagtggaggtcctgtatcgaggctcctggggaaccgtgtgtgatgacagctgggacaccaatgatgccaatgtggtctgcaggcagctgggctgtggctgggccatgtcggccccaggaaatgcccggtttggccagggctcaggacccattgtcctggatgatgtgcgctgctcagggaatgagtcctacctgtggagctgcccccacaaaggctggctcacccacaactgtggccatcacgaagacgctggtgtcatctgctcagccacccaaataaattctactacgacagattggtggcatccaacaactacaaccactgcaagaccctcttcaaattgtggtggcttcttattctatgccagtgggacattctccagcccatcctaccctgcatactaccccaacaatgctaagtgtgtttgggaaatagaagtgaattctggttatcgcataaacctgggcttcagtaatctgaaattggaggcacaccataactgcagttttgattatgttgaaatctttgatggatcattgaatagcagtctcctgctggggaaaatctgtaatgataccaggcaaatatttacatcttcttacaaccgaatgaccattcactttcgaagtgacatcagtttccaaaacactggctttttggcttggtataactccttcccaagcgatgccaccttgaggttggtcaatttaaattcatcctatggtctatgtgccgggcgtgtagaaatttaccatggtggcacctgggggacagtttgtgatgactcctggaccattcaggaagctgaggtggtctgcagacagctagggtgtggacgtgcagtttcagcccttggaaatgcatattttggctctggctctggccccatcaccctggacgatgtagagtgctcagggacggaatccactctctggcagtgccggaaccgaggctggttctcccacaactgtaatcatcgtgaagatgctggtgtcatctgctcaggaaaccatctatcgacacctgctccttttctcaacatcacccgtccaaacacagattattcctgcggaggcttcctatcccaaccatcaggggacttttccagcccattctatcccgggaactatccaaacaatgccaagtgtgtgtgggacattgaggtgcaaaacaactaccgtgtgactgtgatcttcagagatgtccagcttgaaggtggctgcaactatgattatattgaagttttcgatggcccctaccgcagttcccctctcattgctcgagtttgtgatggggccagaggctccttcacttcttcctccaacttcatgtccattcgcttcatcagtgaccacagcatcacaaggagagggttccgggctgagtactactccagtccctccaatgacagcaccaacctgctctgtctgccaaatcacatgcaagccagtgtgagcaggagctatctccaatccttgggcttttctgccagtgaccttgtcatttccacctggaatggatactacgagtgtcggccccagataacgccgaacctggtgatattcacaattccctactcaggctgcggcaccttcaagcaggcagacaatgacaccatcgactattccaacttcctcacagcagctgtctcaggtggcatcatcaagaggaggacagacctccgtattcacgtcagctgcagaatgcttcagaacacctgggtcgacaccatgtacattgctaatgacaccatccacgttgctaataacaccatccaggtcgaggaagtccagtatggcaattttgacgtgaacatttccttttatacttcctcatctttcttgtatcctgtgaccagccgcccttactacgtggacctgaaccaggacttgtacgttcaggctgaaatcctccattctgatgctgtactgaccttgtttgtggacacctgcgtggcatcaccatactccaatgacttcacgtctttgacttatgatctaatccggagtggatgcgtgagggatgacacctacggaccctactcctcgccatctcttcgcattgcccgcttccggttcagggccttccacttcctgaaccgcttcccctccgtgtacctgcgttgtaaaatggtggtgtgcagagcgtatgacccctcttcccgctgctaccgaggctgtgtgttgaggtcgaagagggatgtgggctcctaccaggaaaaggtggacgtcgtcctgggtcccatccagctgcagacccccccacgccgagaagaggagcctcggtaggtggtcgctctcagaccccactgtccaccggggcgcagacccctgactcggggacttgggatgttcctcttggtgtcatattccaactcagattgagccctacattgtgctgcacctggtcatacggagttgaatcagacctggttcccgcctcccccaaggctcatggtccttggaggacccgttgcagggtgaggtcaagagagttctgacctggatggcccatagacctgacgtcccagaatccatgcttctcatctgcaaaatgaaaatgtcaatacttacttcttagcactgttgagagggttacttacataaaggaattttggtgaaactgc

SEQ ID NO: 1358 - DNA, 7683 bp, Homo sapiens
tttatagcagcagtagaaatataccaccctagaggacacacctccttttagctaggtacctataaatgtccaggattttctattcaattgagaagaacccagcaaaatggggatctccacagtcatccttgaaatgtgtcttttatggggacaagttctatctacaggtgggtggatcccaaggactacagactacgcttcactgattccctcggaggtgcccttggatccaactgtagcagaaggttctccatttccctcggagtcgaccctggagtcaactgtagcagaaggttctccgatttccttggagtcaaccctggagtcaaccgtagcagaaggttctctgattccctcagagtcaaccctggagtcaactgtagcagaaggatctgattctggtttggccctgaggctggtgaatggagatggcaggtgtcagggccgagtggagatcctataccgaggctcctggggcaccgtgtgtgatgacagctgggacaccaatgatgccaacgtggtctgtaggcagctgggttgtggctgggccatgtcagctccaggaaatgcctggtttggccagggctcaggacccattgccctggatgatgtgcgctgctcaggacacgaatcctacctgtggagctgcccccacaatggctggctctcccataactgtggccatggtgaagatgctggtgttatctgctcagctgcccagcctcagtcaacactcaggccagaaagttggcctgtcaggatatcaccacctgtacccacagaaggatctgaatccagtttggccctgaggctggtgaatggaggcgacaggtgtcgaggccgagtggaggtcctataccgaggctcctggggcaccgtgtgtgatgactactgggacaccaatgatgccaatgtggtctgcaggcagctgggctgtggctgggccatgtcagccccaggaaatgcccagtttggccagggctcaggacccattgtcctggatgatgtgcgctgctcaggacatgagtcctacctgtggagctgcccccacaatggctggctcacccacaactgtggccatagtgaagacgctggtgtcatctgctcagctccccagtcccggccgacacccagcccagatacttggccgacctcacatgcatcaacagcaggacctgaatccagtttggccctgaggctggtgaatggaggtgacaggtgtcagggccgagtggaggtcctataccgaggctcctggggcaccgtgtgtgatgatagctgggacaccagtgacgccaatgtggtctgccggcagctgggctgtggctgggccacgtcagccccaggaaatgcccggtttggccagggttcaggacccattgtcctggatgacgtgcgctgctcaggctatgagtcctacctgtggagctgcccccacaatggctggctctcccataactgtcagcacagtgaagacgctggtgtcatctgctcagctgcccactcctggtcgacgcccagtccagacacgttgccgaccatcaccttacctgcatcgacagtaggatctgaatccagtttggccctgaggctggtgaatggaggtgacaggtgtcagggccgagtggaggtcctataccgaggctcctggggcaccgtgtgtgatgacagctgggacaccaatgatgccaatgtggtctgcaggcagctgggctgtggctgggccatgttggccccaggaaatgcccggtttggtcagggctcaggacccattgtcctggatgacgtgcgctgctcagggaatgagtcctacttgtggagctgcccccacaatggctggctctcccataactgtggccatagtgaagacgctggtgtcatctgctcaggacctgaatccagtttggccctgaggctggtgaatggaggtgacaggtgtcagggccgagtggaggtcctataccgaggctcttggggcaccgtgtgtgatgacagctgggacaccaatgatgccaatgtggtctgcaggcagctgggctgtggctgggccacgtcagccccaggaaatgcccggtttggtcagggctcaggacccattgtcctggatgatgtgcgctgctcaggacatgagtcctacctgtggagctgccccaacaatggctggctctcccacaactgtggccatcatgaagatgctggtgtcatctgctcagctgcccagtcccggtcgacgcccaggccagacacgttgtcgaccatcacgttacctccatcgacagtaggatctgaatccagtttgaccctgaggctggtgaatggaagtgacaggtgtcagggccgagtagaggtcctataccgaggctcctggggcaccgtgtgtgatgacagctgggataccaatgatgccaatgtggtctgcaggcagctgggctgtggctgggccacgtcggccccaggaaatgcccggtttggccagggctcaggacccattgttctggatgatgtgcgctgctcaggacacgagtcctacctgtggagctgcccccacaatggctggctctcccacaactgtggccatcatgaagatgctggtgtcatctgctcagtttcccagtcccggccgacacccagtccagatacttggccgacctcacatgcatcaacagcaggacctgaatccagtttggccctgaggctggtgaatggaggtgacaggtgtcagggccgagtggaggtcctataccgaggctcctggggcaccgtgtgtgatgatagctgggacaccagtgacgccaatgtggtctgccggcagctgggctgtggctgggccacgtcagccccaggaaatgcccggtttggccagggttcaggacccattgtcctggatgacgtgcgctgctcaggctatgagtcctacctgtggagctgcccccacaatggctggctctcccataactgtcagcacagtgaagacgctggtgtcatctgctcagctgcccactcctggtcgacgcccagtccagacacattgccgaccatcaccttgcctgcatcgacagtaggatctgaatccagtttggccctgaggctggtgaatggaggtgacaggtgtcagggccgagtggaggtcctataccaaggctcctggggcaccgtgtgcgatgacagctgggacaccaatgatgccaatgtcgtctgcaggcaactgggctgtggctgggccatgtcagccccaggaaatgcccggtttggtcagggctcaggacccattgtcctggatgatgtgcgctgctcaggacacgagtcttacctgtggagctgcccccacaatggctggctctcccacaactgtggccatagtgaagacgctggtgtcatctgctcagcttcccagtcccggccaacacctagtccagacacttggccaacctcacatgcatcaacagcaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccatgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctcacatgcatcaacagcaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccacgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctcacatgcatcaacagcaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccacgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctctcgtgcatcaacagcaggatctgaatccactttggccctgagactggtgaatggaggtgacaggtgtcgaggccgagtggaggtcctataccaaggctcctggggcaccgtgtgtgatgactactgggacaccaatgatgccaacgtggtctgcaggcagctgggctgtggctgggccatgtcagccccaggaaatgcccagtttggccagggctcaggacccattgtcctggatgatgtgcgctgctcaggacacgagtcttacctgtggagctgcccccacaatggctggctctcccacaactgtggccatcatgaagatgctggtgtcatctgctcagctgctcagtcccagtcaacgcccaggccagatacttggctgaccaccaacttaccggcattgacagtaggatctgaatccagtttggctctgaggctggtgaatggaggtgacaggtgtcgaggccgagtggaggtcctgtatcgaggctcctggggaaccgtgtgtgatgacagctgggacaccaatgatgccaatgtggtctgcaggcagctgggctgtggctgggccatgtcggccccaggaaatgcccggtttggccagggctcaggacccattgtcctggatgatgtgcgctgctcagggaatgagtcctacctgtggagctgcccccacaaaggctggctcacccacaactgtggccatcacgaagacgctggtgtcatctgctcagccacccaaataaattctactacgacagattggtggcatccaacaactacaaccactgcaagaccctcttcaaattgtggtggcttcttattctatgccagtgggacattctccagcccatcctaccctgcatactaccccaacaatgctaagtgtgtttgggaaatagaagtgaattctggttatcgcataaacctgggcttcagtaatctgaaattggaggcacaccataactgcagttttgattatgttgaaatctttgatggatcattgaatagcagtctcctgctggggaaaatctgtaatgataccaggcaaatatttacatcttcttacaaccgaatgaccattcactttcgaagtgacatcagtttccaaaacactggctttttggcttggtataactccttcccaagcgatgccaccttgaggttggtcaatttaaattcatcctatggtctatgtgccgggcgtgtagaaatttaccatggtggcacctgggggacagtttgtgatgactcctggaccattcaggaagctgaggtggtctgcagacagctagggtgtggacgtgcagtttcagcccttggaaatgcatattttggctctggctctggccccatcaccctggacgatgtagagtgctcagggacggaatccactctctggcagtgccggaaccgaggctggttctcccacaactgtaatcatcgtgaagatgctggtgtcatctgctcaggaaaccatctatcgacacctgctccttttctcaacatcacccgtccaaacaattattcctgcggaggcttcctatcccaaccatcaggggacttttccagcccattctatcccgggaactatccaaacaatgccaagtgtgtgtgggacattgaggtgcaaaacaactaccgtgtgactgtgatcttcagagatgtccagcttgaaggtggctgcaactatgattatattgaagttttcgatggcccctaccgcagttcccctctcattgctcgagtttgtgatggggccagaggctccttcacttcttcctccaacttcatgtccattcgcttcatcagtgaccacagcatcacaaggagagggttccgggctgagtactactccagtccctccaatgacagcaccaacctgctctgtctgccaaatcacatgcaagccagtgtgagcaggagctatctccaatccttgggcttttctgccagtgaccttgtcatttccacctggaatggatactacgagtgtcggccccagataacgccgaacctggtgatattcacaattccctactcaggctgcggcaccttcaagcaggcagacaatgacaccatcgactattccaacttcctcacagcagctgtctcaggtggcatcatcaagaggaggacagacctccgtattcacgtcagctgcagaatgcttcagaacacctgggtcgacaccatgtacattgctaatgacaccatccacgttgctaataacaccatccaggtcgaggaagtccagtatggcaattttgacgtgaacatttccttttatacttcctcatctttcttgtatcctgtgaccagccgcccttactacgtggacctgaaccaggacttgtacgttcaggctgaaatcctccattctgatgctgtactgaccttgtttgtggacacctgcgtggcatcaccatactccaatgacttcacgtctttgacttatgatctaatccggagtggatgcgtgagggatgacacctacggaccctactcctcgccatctcttcgcattgcccgcttccggttcagggccttccacttcctgaaccgcttcccctccgtgtacctgcgttgtaaaatggtggtgtgcagagcgtatgacccctcttcccgctgctaccgaggctgtgtgttgaggtcgaagagggatgtgggctcctaccaggaaaaggtggacgtcgtcctgggtcccatccagctgcagacccccccacgccgagaagaggagcctcggtaggtggtcgctctcagaccccactgtccaccggggcgcagacccctgactcggggacttgggatgttcctcttggtgtcatattccaactcagattgagccctacattgtgctgcacctggtcatacggagttgaatcagacctggttcccgcctcccccaaggctcatggtccttggaggacccgttgcagggtgaggtcaagagagttctgacctggatggcccatagacctgacgtcccagaatccatgcttctcatctgcaaaatgaaaatgtcaatacttacttcttagcactgttgagagggttacttacataaaggaattttggtgaaactgc

SEQ ID NO: 1359 - DNA, 7686 bp, Homo sapiens; identical to SEQ ID NO: 1349

SEQ ID NO: 1360 - DNA, 7656 bp, Homo sapiens; identical to SEQ ID NO: 1353

SEQ ID NO: 1361 - DNA, 5802 bp, Homo sapiens; identical to SEQ ID NO: 1347

SEQ ID NO: 1362 - DNA, 2769 bp, Homo sapiens
ctcgcgacatccgcccagcggcggccggaatctcgcgataaaggctcattgtctcgcgggagcgctgctggcggtcgggcgctcgggcggccctggccggggagacgagttgcatgtgttggttcagctggcgatagcggcgggagcggagccggcggggcctgtgcgaccgcctgggtttgtgaaatggctgctgacatttctgaatccagcggggctgactgcaaaggagacccaaggaacagtgccaagttagatgccgattacccacttcgagtcctttattgtggagtctgttcattaccaacagagtactgtgaatatatgcctgatgttgctaaatgtagacaatggttagagaagaattttccaaatgaatttgcaaaacttactgtagaaaattcacccaaacaagaagctggaattagtgagggtcaaggaacagcaggggaagaagaggagaagaaaaaacagaagagaggtggaaggggtcaaataaaacaaaaaaagaagaccgtaccacaaaaggttactatagccaaaattcccagagcaaagaagaaatatgtgacaagagtatgtggccttgcaacttttgaaattgatcttaaagaagcacaaagattttttgctcaaaaattctcctgtggtgcctcagtaacaggggaggatgaaattatcattcagggagattttacagatgacataattgatgtcattcaggaaaaatggccagaggtagatgatgacagcatcgaagatcttggagaagtaaagaagtgaatttgaaaatttgtctgtatttaatggcctgaactgagagttgatatggccaaagggagagaggccttttaaaatatatatatatatacacatatatatgtatatatacacatatatgtatgtatacacatatacacatgtatatatacatgtgtgtatgtatacatgtatatatatatacatacacatatatgtatacatatatacacatatatgtatacatatatacacatatgtatacatatatatatattctacagtaaaactgtagactgtcctcgtccttggcattttcactgttctgtacaaggctgcttgtttttttattgccaaagtcaaataaacgggagactgtcatgctcatgcatgaatagaatttagtcaaataaaaaattttggtcatttggtactgactttctctctctctctctctctcttttttttttttgacagagtctcgcactgttgcctgggctggaatgcagtggtgcgatctcggctcactgcaacctccgcctcccgggttcaagtgattctcctgcctcagcctcccaagtaggtgggattacaggcgcccgccaccacgcccagctaatttttgtatttttagtagagatggggtttcactatgttggccaggctggtctcgaactcctgacctcgtgattggcccacctcagcctcccaaagtgctggtattacagatgtgagccaccgcacccagcctgagtttctctttctctctttttaactttattttttgaaaaacccggtagactttttgtggggagcatttttgttgataattttactgatctaaagctgagtgattttttaaaagaatttgaatttggcttcctcaccagtaatatgtctccttgcttctttgatgtgatagttttgagatgggtgagaatctaatagatctgtggttgaatttgctgtgttgttatgaagtccaccctgtgggcacaataacataactgttggtaggagttgtttgagctattctggagattatttggtaaagtatactaaaagccttaaaaccatgtatgtgcgctgtttgaacccgtaagccacttctttgacattagaagacattagaagaaataatcagccttgcataaaacttatggatgaaagtattcatcacaatattatttataataaaaaattgcaaatgttataaatgaacaattgggaaatggttaaagaagtgatggtgcattgtgtggtagaatattatgcatatgtttaaagaatcatattttctaagattatttggaagcatgtttggtaatgtcaagtggagtaccccagatacattttagacatttatcgtcatcatctgctctgagtggaaggccgttcagagaggctagaggttcttattctggctataaattatgtgagtaaaattgtgctaaccagttaaaagtactgtacacccatgctcaatatatagtcctggaaatagcaattgaaacatgtcttctcacaagagaaaatgacagttttaatgatgtatttgatgaatttaaactttaagtcaggtgctgcaaattggaaagaagacttgtggtgttttaagttgctgtggacacttttaagaaacttagaacccatggaacccttgtttatcgccatgcaaattacaatcttgaatgagtgttttttaaaaataaagtattagaaaaatgtgtagtaaagatgtaaaattaaaaaatggaattctccattaactgtggattttactaaatagaattactggtgaagcagatttatccatcgagactatctggtatgcgttatgtatgtagtctgttgctgctgaaagatgtctgtgtgcctgtatcaacatgtgacttcatgtaaagtttctttgtgttcacagttcttagcaaatgcagttacaatccatagatagccagcagtggatgttactccaggaaaatgcaggattaaaattgtccttgtgtataa

SEQ ID NO: 1363 - DNA, 1972 bp, Homo sapiens
gtgagatgacatcaaaacccttcgtgtaggagggtggcagtctccctcccttctggagacaccaccagatgggccagccagaggcagcagcagcctcttcccatggatccaccacgagcgtcccacttgagccctcggaagaagagaccccggcagacgggtgccttgatggcctcctctcctcaagacatcaaatttcaagatttggtcgtcttcattttggagaagaaaatgggaaccacccgcagagcgttcctcatggagctggcccgcaggaaagggttcagggttgaaaatgagctcagtgattctgtcacccacatcgtagcagagaacaactcgggttcggatgttctggagtggcttcaagcacagaaagtacaagtcagctcacaaccagagctcctcgatgtctcctggctgatcgaatgcataagagcagggaaaccggtggaaatgacaggaaaacaccagcttgttgtgagaagagactattcagatagcaccaacccaggccccccgaagactccaccaattgctgtacaaaagatctcccagtatgcgtgtcagagaagaaccactttaaacaactgtaaccagatattcacggatgcctttgatatactggctgaaaactgtgagtttagagaaaatgaagactcctgtgtgacatttatgagagcagcttctgtattgaaatctctgccattcacaatcatcagtatgaaggacacagaaggaattccctgcctggggtccaaggtgaagggtatcatagaggagattattgaagatggagaaagttctgaagttaaagctgtgttaaatgatgaacgatatcaatccttcaaactctttacttctgtatttggagtggggctgaagacttctgagaagtggttcaggatgggtttcagaactctgagtaaagtaaggtcggacaaaagcctgaaatttacacgaatgcagaaagcaggatttctgtattatgaagaccttgtcagctgtgtgaccagggcagaagcagaggccgtcagtgtgctggttaaagaggctgtctgggcatttcttccggatgctttcgtcaccatgacaggagggttccggaggggtaagaagatggggcatgatgtagattttttaattaccagcccaggatcaacagaggatgaagagcaacttttacagaaagtgatgaacttatgggaaaagaagggattacttttatattatgaccttgtggagtcaacatttgaaaagctcaggttgcctagcaggaaggttgatgctttggatcattttcaaaagtgctttctgattttcaaattgcctcgtcaaagagtggacagtgaccagtccagctggcaggaaggaaagacctggaaggccatccgtgtggatttagttctgtgcccctacgagcgtcgtgcctttgccctgttgggatggactggctcccggcagtttgagagagacctccggcgctatgccacacatgagcggaagatgattctggataaccatgctttatatgacaagaccaagaggatattcctcaaagcagaaagtgaagaagaaatttttgcgcatctgggattggattatattgaaccgtgggaaagaaatgcctaggaaagtgttgtcaacatttttttcctattcttttcaagttaaataaattatgcttcatattagtaaaagatgccataggagagtttggggttatttaggtcttattgaaatgcagattgctactagaaataaataactttggaaacatgggaaggtgccactggtaatgggtaaggttctaataggccatgtttatgactgttgcatagaattcacaatgcatttttcaagagaaatgatgttgtcactggtggctcattcagggaagctcatcaaagcccactttgttcgcagtgtagctgaaatactgtctatctctaataaaaacaggaggaaacaa

SEQ ID NO: 1364 - DNA, 2016 bp, Homo sapiens
acactttggcaggaagctgttgccagggcagcacctgtgaagccctggcctggcttcagagtctgctggtgagatgacatcaaaacccttcgtgtaggagggtggcagtctccctcccttctggagacaccaccagatgggccagccagaggcagcagcagcctcttcccatggatccaccacgagcgtcccacttgagccctcggaagaagagaccccggcagacgggtgccttgatggcctcctctcctcaagacatcaaatttcaagatttggtcgtcttcattttggagaagaaaatgggaaccacccgcagagcgttcctcatggagctggcccgcaggaaagggttcagggttgaaaatgagctcagtgattctgtcacccacatcgtagcagagaacaactcgggttcggatgttctggagtggcttcaagcacagaaagtacaagtcagctcacaaccagagctcctcgatgtctcctggctgatcgaatgcataagagcagggaaaccggtggaaatgacaggaaaacaccagcttgttgtgagaagagactattcagatagcaccaacccaggccccccgaagactccaccaattgctgtacaaaagatctcccagtatgcgtgtcagagaagaaccactttaaacaactgtaaccagatattcacggatgcctttgatatactggctgaaaactgtgagtttagagaaaatgaagactcctgtgtgacatttatgagagcagcttctgtattgaaatctctgccattcacaatcatcagtatgaaggacacagaaggaattccctgcctggggtccaaggtgaagggtatcatagaggagattattgaagatggagaaagttctgaagttaaagctgtgttaaatgatgaacgatatcaatccttcaaactctttacttctgtatttggagtggggctgaagacttctgagaagtggttcaggatgggtttcagaactctgagtaaagtaaggtcggacaaaagcctgaaatttacacgaatgcagaaagcaggatttctgtattatgaagaccttgtcagctgtgtgaccagggcagaagcagaggccgtcagtgtgctggttaaagaggctgtctgggcatttcttccggatgctttcgtcaccatgacaggagggttccggaggggtaagaagatggggcatgatgtagattttttaattaccagcccaggatcaacagaggatgaagagcaacttttacagaaagtgatgaacttatgggaaaagaagggattacttttatattatgaccttgtggagtcaacatttgaaaagctcaggttgcctagcaggaaggttgatgctttggatcattttcaaaagtgctttctgattttcaaattgcctcgtcaaagagtggacagtgaccagtccagctggcaggaaggaaagacctggaaggccatccgtgtggatttagttctgtgcccctacgagcgtcgtgcctttgccctgttgggatggactggctcccggtttgagagagacctccggcgctatgccacacatgagcggaagatgattctggataaccatgctttatatgacaagaccaagaggatattcctcaaagcagaaagtgaagaagaaatttttgcgcatctgggattggattatattgaaccgtgggaaagaaatgcctaggaaagtgttgtcaacatttttttcctattcttttcaagttaaataaattatgcttcatattagtaaaagatgccataggagagtttggggttatttaggtcttattgaaatgcagattgctactagaaataaataactttggaaacatgggaaggtgccactggtaatgggtaaggttctaataggccatgtttatgactgttgcatagaattcacaatgcatttttcaagagaaatgatgttgtcactggtggctcattcagggaagctcatcaaagcccactttgttcgcagtgtagctgaaatactgtctatctct

SEQ ID NO: 1365 - DNA, 4826 bp, Homo sapiens
cgctcggcccgcgacctgccccgagccctctccatggaggcagcccgcccctccggctcctggaacggagccctctgccggctgctcctgctgaccctcgcgatcttaatatttgccagtgatgcctgcaaaaatgtgacattacatgttccctccaaactagatgccgagaaacttgttggtagagttaacctgaaagagtgctttacagctgcaaatctaattcattcaagtgatcctgacttccaaattttggaggatggttcagtctatacaacaaatactattctattgtcctcggagaagagaagttttaccatattactttccaacactgagaaccaagaaaagaagaaaatatttgtctttttggagcatcaaacaaaggtcctaaagaaaagacatactaaagaaaaagttctaaggcgcgccaagagaagatgggctccaattccttgttcgatgctagaaaactccttgggtccttttccacttttccttcaacaggttcaatctgacacggcccaaaactataccatatactattccataagaggtcctggagttgaccaagaacctcggaatttattttatgtggagagagacactggaaacttgtattgtactcgtcctgtagatcgtgagcagtatgaatcttttgagataattgcctttgcaacaactccagatgggtatactccagaacttccactgcccctaataatcaaaatagaggatgaaaatgataactacccaatttttacagaagaaacttatacttttacaatttttgaaaattgcagagtgggcactactgtgggacaagtgtgtgctactgacaaagatgagcctgacacgatgcacacacgcctgaagtactccatcattgggcaggtgccaccatcacccaccctattttctatgcatccaactacaggcgtgatcaccacaacatcatctcagctagacagagagttaattgacaagtaccagttgaaaataaaagtacaagacatggatggtcagtattttggtctacagacaacttcaacttgtatcattaacattgatgatgtaaatgaccacttgccaacatttactcgtacttcttatgtgacatcagtggaagaaaatacagttgatgtggaaatcttacgagttactgttgaggataaggacttagtgaatactgctaactggagagctaattataccattttaaagggcaatgaaaatggcaattttaaaattgtaacagatgccaaaaccaatgaaggagttctttgtgtagttaagcctttgaattatgaagaaaagcaacagatgatcttgcaaattggtgtagttaatgaagctccattttccagagaggctagtccaagatcagccatgagcacagcaacagttactgttaatgtagaagatcaggatgagggccctgagtgtaaccctccaatacagactgttcgcatgaaagaaaatgcagaagtgggaacaacaagcaatggatataaagcatatgacccagaaacaagaagtagcagtggcataaggtataagaaattaactgatccaacagggtgggtcaccattgatgaaaatacaggatcaatcaaagttttcagaagcctggatagagaggcagagaccatcaaaaatggcatatataatattacagtccttgcatcagaccaaggagggagaacatgtacggggacactgggcattatacttcaagacgtgaatgataacagcccattcatacctaaaaagacagtgatcatctgcaaacccaccatgtcatctgcggagattgttgcggttgatcctgatgagcctatccatggcccaccctttgactttagtctggagagttctacttcagaagtacagagaatgtggagactgaaagcaattaatgatacagcagcacgtctttcctatcagaatgatcctccatttggctcatatgtagtacctataacagtgagagatagacttggcatgtctagtgtcacttcattggatgttacactgtgtgactgcattaccgaaaatgactgcacacatcgtgtagatccaaggattggcggtggaggagtacaacttggaaagtgggccatccttgcaatattgttgggcatagcattgctcttttgcatcctgtttacgctggtctgtggggcttctgggacgtctaaacaaccaaaagtaattcctgatgatttagcccagcagaacctaattgtatcaaacacagaagctcctggagatgacaaagtgtattctgcgaatggcttcacaacccaaactgtgggcgcttctgctcagggagtttgtggcaccgtgggatcaggaatcaaaaacggaggtcaggagaccatcgaaatggtgaaaggaggacaccagacctcggaatcctgccggggggctggccaccatcacaccctggactcctgcaggggaggacacacggaggtggacaactgcagatacacttactcggagtggcacagttttactcagccccgtcttggtgaagaatccattagaggacacactctgattaaaaattaaacaatgaaagaaagtgtatctgtgtaatcaagatgaaaatcacaagcatgcccaagactatgtcctgacatataactatgaaggaagaggatcggtggctgggtctgtaggttgttgcagtgaacgacaagaagaagatgggcttgaatttttggataatttggagcccaaatttaggacactagcagaagcatgcatgaagagatgagtgtgttctaataagtctctgaaagccagtggctttatgacttttaaaaaaaattacaaaccaagaattttttaaagcagaagatgctatttgtgggggtttttctctcattatttggatggaatctctttggtcaaatgcacatttacagagagacactataaacaagtacacaaatttttcaatttttacatatttttaaattacttatcttctatccaaggaggtctacagagaaattaaagtctgccttatttgttacatttgggtataatgacaacagccaatttatagtgcaataaaatgtaattaattcaagtccttattatagactatttgaagcacaacctaatggaaaattgtagagaccttgctttaacattatctccagttaattaagtgttcatgtggtgcttggaaactgttgttttcctgaacatctaaagtgtgtagactgcattcttgctattattttattcttgtaatgtgaccttttcactgtgcaaagggagatttctagccaggcattgactattacaatttcattttggtggagtttagttttaggttttattgtatataaaatcctgcactgaatctgtgtctcctctgttacctacttttgccagtgaaatttaagttttaaaatactttcagaatgtatttttactactgcaagtttttggtctttaaaatgtcaagtagcatctctctctttctctctgtctctttctgtttctctctccagttttttttttttttttaatttccatatgggctaaagaatccaaatattttaaaaatctgtctctcttttcttctctcataaagtgaattattccttttttttgttttatgtaagtgtatatattcttagtttttcttgaaatcattgtaatgttaactttgttgtttcaaatatcttggtgattgcttcattatctcttcaacaaaaaaaacctttaattttgccattgaaactgtagaactatgccatgcttttattagaagcagtgctctgtgttaacaacaagaatggtgtaattagaattgggatgtggatatttactgtatgacaacacatttacagttctgtaatgcaaggatgcagtttaaaaatgtgaagtagtgatggtttttgaaataagctttaaaatatagggatcttgaaggctccctggggtaactattttataacttagataaaatggctagtcatatctgtgtgtttgtaaagttatttttttaatattttaagattacaattttaacaaatgtagaaatgagccaaactatttaaattttaaaacagtaaaacaaaatgaaacttaatagctcacaaaattccagtccatgtttcatgacttattttagtcaatgaattttctatttatactaaacatatggacattttaaatgtgtttctaatatttttgattatctataatgtgcctgtcttcaattcacaagattgggttataacaattatttgccagattaacactagggaattatttgataaccagcttatcttatcagtagttttattgctgatcaggcaaaaatagttttccaaagttatttttaataaagtatatacaaaattcttatatattactagtcatgataaagtaaattaagcagtttttaaaacttagtgtgagtttgttcatcacaggtctgatatgagtttaagggatttcgcactccctgaatcagagaagtaagaccccttccttagattcctgttatacattttttaaaatgtagagtttgttttggagacattttcagtgcattgttattgccatatttatataatatgactattctaaaggctgtgaggccatggggtattggttaagttgcttgcttttgctttgtccattttcatcattttaaaatgggggataataacagaacttgtttcctagggccattgtaagtcacttgaataaaaaatagttttgaagcatgagagtcatacagagcggtccacctaaaaggcactcctgataataataaatgattttaaacaagt

SEQ ID NO: 1366 - DNA, 5124 bp, Homo sapiens
ggcttctgctgggcagggccggctgttaatctcgcctggcggagcggacaccggggcgtggtgggggagatgggccttataggtggcgtccgctggtgagaaacaccttgcgcaggtaaaagggtggcggcgagagggagttcccacccgtggctttcttagagaaatgaagtcttaagtcttaaatagacaacaaggaggggccgatcggtgtcttttggacgcgtctggagcccctccctccgccaaaggaaaagccccttggatgagaggcaggcgcttcagagaagctaagaaaagcacctctccgcgcgccccacctcctccgcctcgcgctcctcctgagcagcgggcccagactgcgctccggccgcggccctcgccccgcggagccctcctaccccggcccgacgctcggcccgcgacctgccccgagccctctccatggaggcagcccgcccctccggctcctggaacggagccctctgccggctgctcctgctgaccctcgcgatcttaatatttgccagtgatgcctgcaaaaatgtgacattacatgttccctccaaactagatgccgagaaacttgttggtagagttaacctgaaagagtgctttacagctgcaaatctaattcattcaagtgatcctgacttccaaattttggaggatggttcagtctatacaacaaatactattctattgtcctcggagaagagaagttttaccatattactttccaacactgagaaccaagaaaagaagaaaatatttgtctttttggagcatcaaacaaaggtcctaaagaaaagacatactaaagaaaaagttctaaggcgcgccaagagaagatgggctccaattccttgttcgatgctagaaaactccttgggtccttttccacttttccttcaacaggttcaatctgacacggcccaaaactataccatatactattccataagaggtcctggagttgaccaagaacctcggaatttattttatgtggagagagacactggaaacttgtattgtactcgtcctgtagatcgtgagcagtatgaatcttttgagataattgcctttgcaacaactccagatgggtatactccagaacttccactgcccctaataatcaaaatagaggatgaaaatgataactacccaatttttacagaagaaacttatacttttacaatttttgaaaattgcagagtgggcactactgtgggacaagtgtgtgctactgacaaagatgagcctgacacgatgcacacacgcctgaagtactccatcattgggcaggtgccaccatcacccaccctattttctatgcatccaactacaggcgtgatcaccacaacatcatctcagctagacagagagttaattgacaagtaccagttgaaaataaaagtacaagacatggatggtcagtattttggtctacagacaacttcaacttgtatcattaacattgatgatgtaaatgaccacttgccaacatttactcgtacttcttatgtgacatcagtggaagaaaatacagttgatgtggaaatcttacgagttactgttgaggataaggacttagtgaatactgctaactggagagctaattataccattttaaagggcaatgaaaatggcaattttaaaattgtaacagatgccaaaaccaatgaaggagttctttgtgtagttaagcctttgaattatgaagaaaagcaacagatgatcttgcaaattggtgtagttaatgaagctccattttccagagaggctagtccaagatcagccatgagcacagcaacagttactgttaatgtagaagatcaggatgagggccctgagtgtaaccctccaatacagactgttcgcatgaaagaaaatgcagaagtgggaacaacaagcaatggatataaagcatatgacccagaaacaagaagtagcagtggcataaggtataagaaattaactgatccaacagggtgggtcaccattgatgaaaatacaggatcaatcaaagttttcagaagcctggatagagaggcagagaccatcaaaaatggcatatataatattacagtccttgcatcagaccaaggagggagaacatgtacggggacactgggcattatacttcaagacgtgaatgataacagcccattcatacctaaaaagacagtgatcatctgcaaacccaccatgtcatctgcggagattgttgcggttgatcctgatgagcctatccatggcccaccctttgactttagtctggagagttctacttcagaagtacagagaatgtggagactgaaagcaattaatgatacagcagcacgtctttcctatcagaatgatcctccatttggctcatatgtagtacctataacagtgagagatagacttggcatgtctagtgtcacttcattggatgttacactgtgtgactgcattaccgaaaatgactgcacacatcgtgtagatccaaggattggcggtggaggagtacaacttggaaagtgggccatccttgcaatattgttgggcatagcattgctcttttgcatcctgtttacgctggtctgtggggcttctgggacgtctaaacaaccaaaagtaattcctgatgatttagcccagcagaacctaattgtatcaaacacagaagctcctggagatgacaaagtgtattctgcgaatggcttcacaacccaaactgtgggcgcttctgctcagggagtttgtggcaccgtgggatcaggaatcaaaaacggaggtcaggagaccatcgaaatggtgaaaggaggacaccagacctcggaatcctgccggggggctggccaccatcacaccctggactcctgcaggggaggacacacggaggtggacaactgcagatacacttactcggagtggcacagttttactcagccccgtcttggtgaaaaagtgtatctgtgtaatcaagatgaaaatcacaagcatgcccaagactatgtcctgacatataactatgaaggaagaggatcggtggctgggtctgtaggttgttgcagtgaacgacaagaagaagatgggcttgaatttttggataatttggagcccaaatttaggacactagcagaagcatgcatgaagagatgagtgtgttctaataagtctctgaaagccagtggctttatgacttttaaaaaaaattacaaaccaagaattttttaaagcagaagatgctatttgtgggggtttttctctcattatttggatggaatctctttggtcaaatgcacatttacagagagacactataaacaagtacacaaatttttcaatttttacatatttttaaattacttatcttctatccaaggaggtctacagagaaattaaagtctgccttatttgttacatttgggtataatgacaacagccaatttatagtgcaataaaatgtaattaattcaagtccttattatagactatttgaagcacaacctaatggaaaattgtagagaccttgctttaacattatctccagttaattaagtgttcatgtggtgcttggaaactgttgttttcctgaacatctaaagtgtgtagactgcattcttgctattattttattcttgtaatgtgaccttttcactgtgcaaagggagatttctagccaggcattgactattacaatttcattttggtggagtttagttttaggttttattgtatataaaatcctgcactgaatctgtgtctcctctgttacctacttttgccagtgaaatttaagttttaaaatactttcagaatgtatttttactactgcaagtttttggtctttaaaatgtcaagtagcatctctctctttctctctgtctctttctgtttctctctccagttttttttttttttttaatttccatatgggctaaagaatccaaatattttaaaaatctgtctctcttttcttctctcataaagtgaattattccttttttttgttttatgtaagtgtatatattcttagtttttcttgaaatcattgtaatgttaactttgttgtttcaaatatcttggtgattgcttcattatctcttcaacaaaaaaaacctttaattttgccattgaaactgtagaactatgccatgcttttattagaagcagtgctctgtgttaacaacaagaatggtgtaattagaattgggatgtggatatttactgtatgacaacacatttacagttctgtaatgcaaggatgcagtttaaaaatgtgaagtagtgatggtttttgaaataagctttaaaatatagggatcttgaaggctccctggggtaactattttataacttagataaaatggctagtcatatctgtgtgtttgtaaagttatttttttaatattttaagattacaattttaacaaatgtagaaatgagccaaactatttaaattttaaaacagtaaaacaaaatgaaacttaatagctcacaaaattccagtccatgtttcatgacttattttagtcaatgaattttctatttatactaaacatatggacattttaaatgtgtttctaatatttttgattatctataatgtgcctgtcttcaattcacaagattgggttataacaattatttgccagattaacactagggaattatttgataaccagcttatcttatcagtagttttattgctgatcaggcaaaaatagttttccaaagttatttttaataaagtatatacaaaattcttatatattactagtcatgataaagtaaattaagcagtttttaaaacttagtgtgagtttgttcatcacaggtctgatatgagtttaagggatttcgcactccctgaatcagagaagtaagaccccttccttagattcctgttatacattttttaaaatgtagagtttgttttggagacattttcagtgcattgttattgccatatttatataatatgactattctaaaggctgtgaggccatggggtattggttaagttgcttgcttttgctttgtccattttcatcattttaaaatgggggataataacagaacttgtttcctagggccattgtaagtcacttgaataaaaaatagttttgaagc

SEQ ID NO: 1367 - DNA, 3005 bp, Homo sapiens
agactgcgctccggccgcggccctcgccccgcggagccctcctaccccggcccgacgctcggcccgcgacctgccccgagccctctccatggaggcagcccgcccctccggctcctggaacggagccctctgccggctgctcctgctgaccctcgcgatcttaatatttgccagtgatgcctgcaaaaatgtgacattacatgttccctccaaactagatgccgagaaacttgttggtagagttaacctgaaagagtgctttacagctgcaaatctaattcattcaagtgatcctgacttccaaattttggaggatggttcagtctatacaacaaatactattctattgtcctcggagaagagaagttttaccatattactttccaacactgagaaccaagaaaagaagaaaatatttgtctttttggagcatcaaacaaagatctctctgttggttccctggctctgcctagttgctgaggtcctaaagaaaagacatactaaagaaaaagttctaaggcgcgccaagagaagatgggctccaattccttgttcgatgctagaaaactccttgggtccttttccacttttccttcaacaggttcaatctgacacggcccaaaactataccatatactattccataagaggtcctggagttgaccaagaacctcggaatttattttatgtggagagagacactggaaacttgtattgtactcgtcctgtagatcgtgagcagtatgaatcttttgagataattgcctttgcaacaactccagatgggtatactccagaacttccactgcccctaataatcaaaatagaggatgaaaatgataactacccaatttttacagaagaaacttatacttttacaatttttgaaaattgcagagtgggcactactgtgggacaagtgtgtgctactgacaaagatgagcctgacacgatgcacacacgcctgaagtactccatcattgggcaggtgccaccatcacccaccctattttctatgcatccaactacaggcgtgatcaccacaacatcatctcagctagacagagagttaattgacaagtaccagttgaaaataaaagtacaagacatggatggtcagtattttggtctacagacaacttcaacttgtatcattaacattgatgatgtaaatgaccacttgccaacatttactcgtacttcttatgtgacatcagtggaagaaaatacagttgatgtggaaatcttacgagttactgttgaggataaggacttagtgaatactgctaactggagagctaattataccattttaaagggcaatgaaaatggcaattttaaaattgtaacagatgccaaaaccaatgaaggagttctttgtgtagttaagcctttgaattatgaagaaaagcaacagatgatcttgcaaattggtgtagttaatgaagctccattttccagagaggctagtccaagatcagccatgagcacagcaacagttactgttaatgtagaagatcaggatgagggccctgagtgtaaccctccaatacagactgttcgcatgaaagaaaatgcagaagtgggaacaacaagcaatggatataaagcatatgacccagaaacaagaagtagcagtggcataaggtataagaaattaactgatccaacagggtgggtcaccattgatgaaaatacaggatcaatcaaagttttcagaagcctggatagagaggcagagaccatcaaaaatggcatatataatattacagtccttgcatcagaccaaggagggagaacatgtacggggacactgggcattatacttcaagacgtgaatgataacagcccattcatacctaaaaagacagtgatcatctgcaaacccaccatgtcatctgcggagattgttgcggttgatcctgatgagcctatccatggcccaccctttgactttagtctggagagttctacttcagaagtacagagaatgtggagactgaaagcaattaatgatacagcagcacgtctttcctatcagaatgatcctccatttggctcatatgtagtacctataacagtgagagatagacttggcatgtctagtgtcacttcattggatgttacactgtgtgactgcattaccgaaaatgactgcacacatcgtgtagatccaaggattggcggtggaggagtacaacttggaaagtgggccatccttgcaatattgttgggcatagcattgctcttttgcatcctgtttacgctggtctgtggggcttctgggacgtctaaacaaccaaaagtaattcctgatgatttagcccagcagaacctaattgtatcaaacacagaagctcctggagatgacaaagtgtattctgcgaatggcttcacaacccaaactgtgggcgcttctgctcagggagtttgtggcaccgtgggatcaggaatcaaaaacggaggtcaggagaccatcgaaatggtgaaaggaggacaccagacctcggaatcctgccggggggctggccaccatcacaccctggactcctgcaggggaggacacacggaggtggacaactgcagatacacttactcggagtggcacagttttactcagccccgtcttggtgaaaaagtgtatctgtgtaatcaagatgaaaatcacaagcatgcccaagactatgtcctgacatataactatgaaggaagaggatcggtggctgggtctgtaggttgttgcagtgaacgacaagaagaagatgggcttgaatttttggataatttggagcccaaatttaggacactagcagaagcatgcatgaagagatgagtgtgttctaataagtctctgaaagccagtggctttatgacttttaaaaaaaattacaaaccaagaattttttaaagcagaagatgctatttgtgggggtttttctctcattatttggatggaatctctttggtcaaatgcacatttacagagagacactataaacaagtac

SEQ ID NO: 1368 - DNA, 3999 bp, Homo sapiens
gcctcgggaacgtgcggctccctgtgcctcgggaacgtgcggctccctgtgcctcagcgcctgcccaggccacggaaaggggaaccgctgggcggccgggacggagagcgagtgtccttgggtgaaaaagggaactgctcgcctttctgggaattgtttactctgagagaagggcggggggaagtggcgggtgggggaggggatcttgaccctttgctcctgaggactgtcgaccggcgagccctagatcttaatatttgccagtgatgcctgcaaaaatgtgacattacatgttccctccaaactagatgccgagaaacttgttggtagagttaacctgaaagagtgctttacagctgcaaatctaattcattcaagtgatcctgacttccaaattttggaggatggttcagtctatacaacaaatactattctattgtcctcggagaagagaagttttaccatattactttccaacactgagaaccaagaaaagaagaaaatatttgtctttttggagcatcaaacaaaggtcctaaagaaaagacatactaaagaaaaagttctaaggcgcgccaagagaagatgggctccaattccttgttcgatgctagaaaactccttgggtccttttccacttttccttcaacaggttcaatctgacacggcccaaaactataccatatactattccataagaggtcctggagttgaccaagaacctcggaatttattttatgtggagagagacactggaaacttgtattgtactcgtcctgtagatcgtgagcagtatgaatcttttgagataattgcctttgcaacaactccagatgggtatactccagaacttccactgcccctaataatcaaaatagaggatgaaaatgataactacccaatttttacagaagaaacttatacttttacaatttttgaaaattgcagagtggggcactactgtgggacaagtgtgtgctactgacaaagatgagcctgacacgatgcacacacgcctgaagtactccatcattgggcaggtgccaccatcacccaccctattttctatgcatccaactacaggcgtgatcaccacaacatcatctcagctagacagagagttaattgacaagtaccagttgaaaataaaagtacaagacatggatggtcagtattttggtctacagacaacttcaacttgtatcattaacattgatgatgtaaatgaccacttgccaacatttactcgtacttcttatgtgacatcagtggaagaaaatacagttgatgtggaaatcttacgagttactgttgaggataaggacttagtgaatactgctaactggagagctaattataccattttaaagggcaatgaaaatggcaattttaaaattgtaacagatgccaaaaccaatgaaggagttctttgtgtagttaagcctttgaattatgaagaaaagcaacagatgatcttgcaaattggtgtagttaatgaagctccattttccagagaggctagtccaagatcagccatgagcacagcaacagttactgttaatgtagaagatcaggatgagggccctgagtgtaaccctccaatacagactgttcgcatgaaagaaaatgcagaagtgggaacaacaagcaatggatataaagcatatgacccagaaacaagaagtagcagtggcataaggtataagaaattaactgatccaacagggtgggtcaccattgatgaaaatacaggatcaatcaaagttttcagaagcctggatagagaggcagagaccatcaaaaatggcatatataatattacagtccttgcatcagaccaaggagggagaacatgtacggggacactgggcattatacttcaagacgtgaatgataacagcccattcatacctaaaaagacagtgatcatctgcaaacccaccatgtcatctgcggagattgttgcggttgatcctgatgagcctatccatggcccaccctttgactttagtctggagagttctacttcagaagtacagagaatgtggagactgaaagcaattaatgatacagcagcacgtctttcctatcagaatgatcctccatttggctcatatgtagtacctataacagtgagagatagacttggcatgtctagtgtcacttcattggatgttacactgtgtgactgcattaccgaaaatgactgcacacatcgtgtagatccaaggattggcggtggaggagtacaacttggaaagtgggccatccttgcaatattgttgggcatagcattgctcttttgcatcctgtttacgctggtctgtggggcttctgggacgtctaaacaaccaaaagtaattcctgatgatttagcccagcagaacctaattgtatcaaacacagaagctcctggagatgacaaagtgtattctgcgaatggcttcacaacccaaactgtgggcgcttctgctcagggagtttgtggcaccgtgggatcaggaatcaaaaacggaggtcaggagaccatcgaaatggtgaaaggaggacaccagacctcggaatcctgccggggggctggccaccatcacaccctggactcctgcaggggaggacacacggaggtggacaactgcagatacacttactcggagtggcacagttttactcagccccgtcttggtgaaaaagtgtatctgtgtaatcaagatgaaaatcacaagcatgcccaagactatgtcctgacatataactatgaaggaagaggatcggtggctgggtctgtaggttgttgcagtgaacgacaagaagaagatgggcttgaatttttggataatttggagcccaaatttaggacactagcagaagcatgcatgaagagatgagtgtgttctaataagtctctgaaagccagtggctttatgacttttaaaaaaaattacaaaccaagaattttttaaagcagaagatgctatttgtgggggtttttctctcattatttggatggaatctctttggtcaaatgcacatttacagagagacactataaacaagtacacaaatttttcaatttttacatatttttaaattacttatcttctatccaaggaggtctacagagaaattaaagtctgccttatttgttacatttgggtataatgacaacagccaatttatagtgcaataaaatgtaattaattcaagtccttattatagactatttgaagcacaacctaatggaaaattgtagagaccttgctttaacattatctccagttaattaagtgttcatgtggtgcttggaaactgttgttttcctgaacatctaaagtgtgtagactgcattcttgctattattttattcttgtaatgtgaccttttcactgtgcaaagggagatttctagccaggcattgactattacaatttcattttggtggagtttagttttaggttttattgtatataaaatcctgcactgaatctgtgtctcctctgttacctacttttgccagtgaaatttaagttttaaaatactttcagaatgtatttttactactgcaagtttttggtctttaaaatgtcaagtagcatctctctctttctctctgtctctttctgtttctctctccagttttttttttttttttaatttccatatgggctaaagaatccaaatattttaaaaatctgtctctcttttcttctctcataaagtgaattattccttttttttgttttatgtaagtgtatatattcttagtttttcttgaaatcattgtaatgttaactttgttgtttcaaatatcttggtgattgcttcattatctcttcaacaaaaaaaacctttaattttgccattgaaactgtagaactatgccatgcttttattagaagcagtgctctgtgttaacaacaagaatggtgtaattagaattgggatgtggatatttactgtatgacaacacatttacagttctgtaatgcaaggatgcagttt

SEQ ID NO: 1369 - DNA, 5525 bp, Homo sapiens
ttttcttagacatcaactgcagacggctggcaggatagaagcagcggctcacttggactttttcaccagggaaatcagagacaatgatggggctcttccccagaactacaggggctctggccatcttcgtggtggtcatattggttcatggagaattgcgaatagagactaaaggtcaatatgatgaagaagagatgactatgcaacaagctaaaagaaggcaaaaacgtgaatgggtgaaatttgccaaaccctgcagagaaggagaagataactcaaaaagaaacccaattgccaagattacttcagattaccaagcaacccagaaaatcacctaccgaatctctggagtgggaatcgatcagccgccttttggaatctttgttgttgacaaaaacactggagatattaacataacagctatagtcgaccgggaggaaactccaagcttcctgatcacatgtcgggctctaaatgcccaaggactagatgtagagaaaccacttatactaacggttaaaattttggatattaatgataatcctccagtattttcacaacaaattttcatgggtgaaattgaagaaaatagtgcctcaaactcactggtgatgatactaaatgccacagatgcagatgaaccaaaccacttgaattctaaaattgccttcaaaattgtctctcaggaaccagcaggcacacccatgttcctcctaagcagaaacactggggaagtccgtactttgaccaattctcttgaccgagagcaagctagcagctatcgtctggttgtgagtggtgcagacaaagatggagaaggactatcaactcaatgtgaatgtaatattaaagtgaaagatgtcaacgataacttcccaatgtttagagactctcagtattcagcacgtattgaagaaaatattttaagttctgaattacttcgatttcaagtaacagatttggatgaagagtacacagataattggcttgcagtatatttctttacctctgggaatgaaggaaattggtttgaaatacaaactgatcctagaactaatgaaggcatcctgaaagtggtgaaggctctagattatgaacaactacaaagcgtgaaacttagtattgctgtcaaaaacaaagctgaatttcaccaatcagttatctctcgataccgagttcagtcaaccccagtcacaattcaggtaataaatgtaagagaaggaattgcattccgtcctgcttccaagacatttactgtgcaaaaaggcataagtagcaaaaaattggtggattatatcctgggaacatatcaagccatcgatgaggacactaacaaagctgcctcaaatgtcaaatatgtcatgggacgtaacgatggtggatacctaatgattgattcaaaaactgctgaaatcaaatttgtcaaaaatatgaaccgagattctactttcatagttaacaaaacaatcacagctgaggttctggccatagatgaatacacgggtaaaacttctacaggcacggtatatgttagagtacccgatttcaatgacaattgtccaacagctgtcctcgaaaaagatgcagtttgcagttcttcaccttccgtggttgtctccgctagaacactgaataatagatacactggcccctatacatttgcactggaagatcaacctgtaaagttgcctgccgtatggagtatcacaaccctcaatgctacctcggccctcctcagagcccaggaacagatacctcctggagtataccacatctccctggtacttacagacagtcagaacaatcggtgtgagatgccacgcagcttgacactggaagtctgtcagtgtgacaacaggggcatctgtggaacttcttacccaaccacaagccctgggaccaggtatggcaggccgcactcagggaggctggggcctgccgccatcggcctgctgctccttggtctcctgctgctgctgttggccccccttctgctgttgacctgtgactgtggggcaggttctactgggggagtgacaggtggttttatcccagttcctgatggctcagaaggaacaattcatcagtggggaattgaaggagcccatcctgaagacaaggaaatcacaaatatttgtgtgcctcctgtaacagccaatggagccgatttcatggaaagttctgaagtttgtacaaatacgtatgccagaggcacagcggtggaaggcacttcaggaatggaaatgaccactaagcttggagcagccactgaatctggaggtgctgcaggctttgcaacagggacagtgtcaggagctgcttcaggattcggagcagccactggagttggcatctgttcctcagggcagtctggaaccatgagaacaaggcattccactggaggaaccaataaggactacgctgatggggcgataagcatgaattttctggactcctacttttctcagaaagcatttgcctgtgcggaggaagacgatggccaggaagcaaatgactgcttgttgatctatgataatgaaggcgcagatgccactggttctcctgtgggctccgtgggttgttgcagttttattgctgatgacctggatgacagcttcttggactcacttggacccaaatttaaaaaacttgcagagataagccttggtgttgatggtgaaggcaaagaagttcagccaccctctaaagacagcggttatgggattgaatcctgtggccatcccatagaagtccagcagacaggatttgttaagtgccagactttgtcaggaagtcaaggagcttctgctttgtccacctctgggtctgtccagccagctgtttccatccctgaccctctgcagcatggtaactatttagtaacggagacttactcggcttctggttccctcgtgcaaccttccactgcaggctttgatccacttctcacacaaaatgtgatagtgacagaaagggtgatctgtcccatttccagtgttcctggcaacctagctggcccaacgcagctacgagggtcacatactatgctctgtacagaggatccttgctcccgtctaatatgaccagaatgagctggaataccacactgaccaaatctggatctttggactaaagtattcaaaatagcatagcaaagctcactgtattgggctaataatttggcacttattagcttctctcataaactgatcacgattataaattaaatgtttgggttcataccccaaaagcaatatgttgtcactcctaattctcaagtactattcaaattgtagtaaatcttaaagtttttcaaaaccctaaaatcatattcgccaggaaattttcctaaacattcttaagcttctatttttcccctgccaaaggaaggtgtttatcattttaaaatgcaatgtgatttagtggattaagcaggagcgctggttcttgtctccattgccttttcttatatcattgataatgatgtaagaatcacaaggggccgggcgcggtggctcacgcctgtaatcccagcactttgggaggccgaggcaggtggatcatgaggtcaggagatcgagaccatcctggctaacaaggtgaaaccccgtctctactaaaaatacaaaaaattagccgggcgcagtggcgggcgcctgtagtcccagctactcgggaggctgaggcaggagaatggcatgaacccgggaagcggagcttgcagtgagccgagattgcgccactgcagtccgcagtccggcctgggcgacagagcgagactccgtctcaaaaaaaaaaaaaaaaaaagaatcacaaggtatttgctaaagcattttgagctgcttggaaaaagggaagtagttgcagtagagtttcttccatcttcttggtgctgggaagccatatatgtgtcttttactcaagctaaggggtataagcttatgtgttgaatttgctacatctatatttcacatattctcacaataagagaattttgaaatagaaatatcatagaacatttaagaaagtttagtataaataatattttgtgtgttttaatccctttgaagggatctatccaaagaaaatattttacactgagctccttcctacacgtctcagtaacagatcctgtgttagtctttgaaaatagctcattttttaaatgtcagtgagtagatgtagcatacatatgatgtataatgacgtgtattatgttaacaatgtctgcagattttgtaggaatacaaaacatggccttttttataagcaaaacgggccaatgactagaataacacatagggcaatctgtgaatatgtattataagcagcattccagaaaagtagttggtgaaataattttcaagtcaaaaagggatatggaaagggaattatgagtaacctctattttttaagccttgcttttaaattaaacagctacagccatttaagccttgaggataataaagcttgagagtaataatgttaggttagcaaaggtttagatgtatcacttcatgcatgctaccatgatagtaatgcagctcttcgagtcatttctggtcattcaagatattcacccttttgcccatagaaagcaccctacctcacctgcttactgacattgtcttagctgatcacaagatcattatcagcctccattattccttactgtatataaaatacagagttttatattttcctttcttcgtttttcaccatattcaaaacctaaatttgtttttgcagatggaatgcaaagtaatcaagtgtttgtgctttcacctagaagggtgtggtcctgaaggaaagaggtcccctaaatatcccccaccctggtgctcctccctctccctggtaccctgactaccaggaagtcaggtgctagagcagctggagaagtgcaggcagcctgtgcttccacagatgggggtgctgctgcaacaaggctttcaatgtgcccatcttaggtgggagaagctagatcctgtgcagcagcctggtaagtcctgaggaggttccattgctcttcctgctgctgtcctttgcttctcaacggtggctcgctctacagtctagagcacatgcagctaacttgtgcctctgcttatgcatgagggttaaattaacaaccataaccttcatttgaagttcaaaggtgtattcaggatcctcaaagcattttaaccttgccgcttaaaacccaatttaccgtgaaatgggaattttgctgcattgttaaactgtagtggaaaccatgctatagtaataaaggttatataagagagaaattgaaattaaatgtgtttttaaatttcaaaaaaaaatcaatctttaggatgacttaaaaattgatttgccatgtaaaatgtatctgcattttttacacaaaacttgttttaagcataaaattttaaaactgtactacttgatgtattatacattttgaaccatatgtattaaaccataaacagtataatgttgttataataaaacaggcaataaatttataaataaaagctgaa

SEQ ID NO: 1370 - DNA, 9796 bp, Homo sapiens
aagaaaccggccaggtgtggcctaggcgcccagtgccagcggggaggagactcgctccgccgccgaccaacaccaacacccagctccgacgcagctcctctgcgcccttgccgccctccgagccacagctttcctcccgctcctgcccccggcccgtcgccgtctccgcgctcgcagcggcctcgggagggcccaggtagcgagcagcgacctcgcgagccttccgcactcccgcccggttccccggccgtccgcctatccttggccccctccgctttctccgcgccggcccgcctcgcttatgcctcggcgctgagccgctctcccgattgcccgccgacatgagctgcaacggaggctcccacccgcggatcaacactctgggccgcatgatccgcgccgagtctggcccggacctgcgctacgaggtgaccagcggcggcgggggcaccagcaggatgtactattctcggcgcggcgtgatcaccgaccagaactcggacggctactgtcaaaccggcacgatgtccaggcaccagaaccagaacaccatccaggagctgctgcagaactgctccgactgcttgatgcgagcagagctcatcgtgcagcctgaattgaagtatggagatggaatacaactgactcggagtcgagaattggatgagtgttttgcccaggccaatgaccaaatggaaatcctcgacagcttgatcagagagatgcggcagatgggccagccctgtgatgcttaccagaaaaggcttcttcagctccaagagcaaatgcgagccctttataaagccatcagtgtccctcgagtccgcagggccagctccaagggtggtggaggctacacttgtcagagtggctctggctgggatgagttcaccaaacatgtcaccagtgaatgtttggggtggatgaggcagcaaagggcggagatggacatggtggcctggggtgtggacctggcctcagtggagcagcacattaacagccaccggggcatccacaactccatcggcgactatcgctggcagctggacaaaatcaaagccgacctgcgcgagaaatctgctatctaccagttggaggaggagtatgaaaacctgctgaaagcgtcctttgagaggatggatcacctgcgacagctgcagaacatcattcaggccacgtccagggagatcatgtggatcaatgactgcgaggaggaggagctgctgtacgactggagcgacaagaacaccaacatcgctcagaaacaggaggccttctccatacgcatgagtcaactggaagttaaagaaaaagagctcaataagctgaaacaagaaagtgaccaacttgtcctcaatcagcatccagcttcagacaaaattgaggcctatatggacactctgcagacgcagtggagttggattcttcagatcaccaagtgcattgatgttcatctgaaagaaaatgctgcctactttcagttttttgaagaggcgcagtctactgaagcatacctgaaggggctccaggactccatcaggaagaagtacccctgcgacaagaacatgcccctgcagcacctgctggaacagatcaaggagctggagaaagaacgagagaaaatccttgaatacaagcgtcaggtgcagaacttggtaaacaagtctaagaagattgtacagctgaagcctcgtaacccagactacagaagcaataaacccattattctcagagctctctgtgactacaaacaagatcagaaaatcgtgcataagggggatgagtgtatcctgaaggacaacaacgagcgcagcaagtggtacgtgacgggcccgggaggcgttgacatgcttgttccctctgtggggctgatcatccctcctccgaacccactggccgtggacctctcttgcaagattgagcagtactacgaagccatcttggctctgtggaaccagctctacatcaacatgaagagcctggtgtcctggcactactgcatgattgacatagagaagatcagggccatgacaatcgccaagctgaaaacaatgcggcaggaagattacatgaagacgatagccgaccttgagttacattaccaagagttcatcagaaatagccaaggctcagagatgtttggagatgatgacaagcggaaaatacagtctcagttcaccgatgcccagaagcattaccagaccctggtcattcagctccctggctatccccagcaccagacagtgaccacaactgaaatcactcatcatggaacctgccaagatgtcaaccataataaagtaattgaaaccaacagagaaaatgacaagcaagaaacatggatgctgatggagctgcagaagattcgcaggcagatagagcactgcgagggcaggatgactctcaaaaacctccctctagcagaccagggatcttctcaccacatcacagtgaaaattaacgagcttaagagtgtgcagaatgattcacaagcaattgctgaggttctcaaccagcttaaagatatgcttgccaacttcagaggttctgaaaagtactgctatttacagaatgaagtatttggactatttcagaaactggaaaatatcaatggtgttacagatggctacttaaatagcttatgcacagtaagggcactgctccaggctattctccaaacagaagacatgttaaaggtttatgaagccaggctcactgaggaggaaactgtctgcctggacctggataaagtggaagcttaccgctgtggactgaagaaaataaaaaatgacttgaacttgaagaagtcgttgttggccactatgaagacagaactacagaaagcccagcagatccactctcagacttcacagcagtatccactttatgatctggacttgggcaagttcggtgaaaaagtcacacagctgacagaccgctggcaaaggatagataaacagatcgactttaggttatgggacctggagaaacaaatcaagcaattgaggaattatcgtgataactatcaggctttctgcaagtggctctatgatgctaaacgccgccaggattccttagaatccatgaaatttggagattccaacacagtcatgcggtttttgaatgagcagaagaacttgcacagtgaaatatctggcaaacgagacaaatcagaggaagtacaaaaaattgctgaactttgcgccaattcaattaaggattatgagctccagctggcctcatacacctcaggactggaaactctgctgaacatacctatcaagaggaccatgattcagtccccttctggggtgattctgcaagaggctgcagatgttcatgctcggtacattgaactacttacaagatctggagactattacaggttcttaagtgagatgctgaagagtttggaagatctgaagctgaaaaataccaagatcgaagttttggaagaggagctcagactggcccgagatgccaactcggaaaactgtaataagaacaaattcctggatcagaacctgcagaaataccaggcagagtgttcccagttcaaagcgaagcttgcgagcctggaggagctgaagagacaggctgagctggatgggaagtcggctaagcaaaatctagacaagtgctacggccaaataaaagaactcaatgagaagatcacccgactgacttatgagattgaagatgaaaagagaagaagaaaatctgtggaagacagatttgaccaacagaagaatgactatgaccaactgcagaaagcaaggcaatgtgaaaaggagaaccttggttggcagaaattagagtctgagaaagccatcaaggagaaggagtacgagattgaaaggttgagggttctactgcaggaagaaggcacccggaagagagaatatgaaaatgagctggcaaaggtaagaaaccactataatgaggagatgagtaatttaaggaacaagtatgaaacagagattaacattacgaagaccaccatcaaggagatatccatgcaaaaagaggatgattccaaaaatcttagaaaccagcttgatagactttcaagggaaaatcgagatctgaaggatgaaattgtcaggctcaatgacagcatcttgcaggccactgagcagcgaaggcgagctgaagaaaacgcccttcagcaaaaggcctgtggctctgagataatgcagaagaagcagcatctggagatagaactgaagcaggtcatgcagcagcgctctgaggacaatgcccggcacaagcagtccctggaggaggctgccaagaccattcaggacaaaaataaggagatcgagagactcaaagctgagtttcaggaggaggccaagcgccgctgggaatatgaaaatgaactgagtaaggtaagaaacaattatgatgaggagatcattagcttaaaaaatcagtttgagaccgagatcaacatcaccaagaccaccatccaccagctcaccatgcagaaggaagaggataccagtggctaccgggctcagatagacaatctcacccgagaaaacaggagcttatctgaagaaataaagaggctgaagaacactctaacccagaccacagagaatctcaggagggtggaagaagacatccaacagcaaaaggccactggctctgaggtgtctcagaggaaacagcagctggaggttgagctgagacaagtcactcagatgcgaacagaggagagcgtaagatataagcaatctcttgatgatgctgccaaaaccatccaggataaaaacaaggagatagaaaggttaaaacaactgatcgacaaagaaacaaatgaccggaaatgcctggaagatgaaaacgcgagattacaaagggtccagtatgacctgcagaaagcaaacagtagtgcgacggagacaataaacaaactgaaggttcaggagcaagaactgacacgcctgaggatcgactatgaaagggtttcccaggagaggactgtgaaggaccaggatatcacgcggttccagaactctctgaaagagctgcagctgcagaagcagaaggtggaagaggagctgaatcggctgaagaggaccgcgtcagaagactcctgcaagaggaagaagctggaggaagagctggaaggcatgaggaggtcgctgaaggagcaagccatcaaaatcaccaacctgacccagcagctggagcaggcatccattgttaagaagaggagtgaggatgacctccggcagcagagggacgtgctggatggccacctgagggaaaagcagaggacccaggaagagctgaggaggctctcttctgaggtcgaggccctgaggcggcagttactccaggaacaggaaagtgtcaaacaagctcacttgaggaatgagcatttccagaaggcgatagaagataaaagcagaagcttaaatgaaagcaaaatagaaattgagaggctgcagtctctcacagagaacctgaccaaggagcacttgatgttagaagaagaactgcggaacctgaggctggagtacgatgacctgaggagaggacgaagcgaagcggacagtgataaaaatgcaaccatcttggaactaaggagccagctgcagatcagcaacaaccggaccctggaactgcaggggctgattaatgatttacagagagagagggaaaatttgagacaggaaattgagaaattccaaaagcaggctttagaggcatctaataggattcaggaatcaaagaatcagtgtactcaggtggtacaggaaagagagagccttctggtgaaaatcaaagtcctggagcaagacaaggcaaggctgcagaggctggaggatgagctgaatcgtgcaaaatcaactctagaggcagaaaccagggtgaaacagcgcctggagtgtgagaaacagcaaattcagaatgacctgaatcagtggaagactcaatattcccgcaaggaggaggctattaggaagatagaatcggaaagagaaaagagtgagagagagaagaacagtcttaggagtgagatcgaaagactccaagcagagatcaagagaattgaagagaggtgcaggcgtaagctggaggattctaccagggagacacagtcacagttagaaacagaacgctcccgatatcagagggagattgataaactcagacagcgcccatatgggtcccatcgagagacccagactgagtgtgagtggaccgttgacacctccaagctggtgtttgatgggctgaggaagaaggtgacagcaatgcagctctatgagtgtcagctgatcgacaaaacaaccttggacaaactattgaaggggaagaagtcagtggaagaagttgcttctgaaatccagccattccttcggggtgcaggatctatcgctggagcatctgcttctcctaaggaaaaatactctttggtagaggccaagagaaagaaattaatcagcccagaatccacagtcatgcttctggaggcccaggcagctacaggtggtataattgatccccatcggaatgagaagctgactgtcgacagtgccatagctcgggacctcattgacttcgatgaccgtcagcagatatatgcagcagaaaaagctatcactggttttgatgatccattttcaggcaagacagtatctgtttcagaagccatcaagaaaaatttgattgatagagaaaccggaatgcgcctgctggaagcccagattgcttcagggggtgtagtagaccctgtgaacagtgtctttttgccaaaagatgtcgccttggcccgggggctgattgatagagatttgtatcgatccctgaatgatccccgagatagtcagaaaaactttgtggatccagtcaccaaaaagaaggtcagttacgtgcagctgaaggaacggtgcagaatcgaaccacatactggtctgctcttgctttcagtacagaagagaagcatgtccttccaaggaatcagacaacctgtgaccgtcactgagctagtagattctggtatattgagaccgtccactgtcaatgaactggaatctggtcagatttcttatgacgaggttggtgagagaattaaggacttcctccagggttcaagctgcatagcaggcatatacaatgagaccacaaaacagaagcttggcatttatgaggccatgaaaattggcttagtccgacctggtactgctctggagttgctggaagcccaagcagctactggctttatagtggatcctgttagcaacttgaggttaccagtggaggaagcctacaagagaggtctggtgggcattgagttcaaagagaagctcctgtctgcagaacgagctgtcactgggtataatgatcctgaaacaggaaacatcatctctttgttccaagccatgaataaggaactcatcgaaaagggccacggtattcgcttattagaagcacagatcgcaaccggggggatcattgacccaaaggagagccatcgtttaccagttgacatagcatataagaggggctatttcaatgaggaactcagtgagattctctcagatccaagtgatgataccaaaggattttttgaccccaacactgaagaaaatcttacctatctgcaactaaaagaaagatgcattaaggatgaggaaacagggctctgtcttctgcctctgaaagaaaagaagaaacaggtgcagacatcacaaaagaataccctcaggaagcgtagagtggtcatagttgacccagaaaccaataaagaaatgtctgttcaggaggcctacaagaagggcctaattgattatgaaaccttcaaagaactgtgtgagcaggaatgtgaatgggaagaaataaccatcacgggatcagatggctccaccagggtggtcctggtagatagaaagacaggcagtcagtatgatattcaagatgctattgacaagggccttgttgacaggaagttctttgatcagtaccgatccggcagcctcagcctcactcaatttgctgacatgatctccttgaaaaatggtgtcggcaccagcagcagcatgggcagtggtgtcagcgatgatgtttttagcagctcccgacatgaatcagtaagtaagatttccaccatatccagcgtcaggaatttaaccataaggagcagctctttttcagacaccctggaagaatcgagccccattgcagccatctttgacacagaaaacctggagaaaatctccattacagaaggtatagagcggggcatcgttgacagcatcacgggtcagaggcttctggaggctcaggcctgcacaggtggcatcatccacccaaccacgggccagaagctgtcacttcaggacgcagtctcccagggtgtgattgaccaagacatggccaccaggctgaagcctgctcagaaagccttcataggcttcgagggtgtgaagggaaagaagaagatgtcagcagcagaggcagtgaaagaaaaatggctcccgtatgaggctggccagcgcttcctggagttccagtacctcacgggaggtcttgttgacccggaagtgcatgggaggataagcaccgaagaagccatccggaaggggttcatagatggccgcgccgcacagaggctgcaagacaccagcagctatgccaaaatcctgacctgccccaaaaccaaattaaaaatatcctataaggatgccataaatcgctccatggtagaagatatcactgggctgcgccttctggaagccgcctccgtgtcgtccaagggcttacccagcccttacaacatgtcttcggctccggggtcccgctccggctcccgctcgggatctcgctccggatctcgctccgggtcccgcagtgggtcccggagaggaagctttgacgccacagggaattcttcctactcttattcctactcatttagcagtagttctattgggcactagtagtcagttgggagtggttgctataccttgacttcatttatatgaatttccactttattaaataatagaaaagaaaatcccggtgcttgcagtagagtgataggacattctatgcttacagaaaatatagccatgattgaaatcaaatagtaaaggctgttctggctttttatcttcttagctcatcttaaataagcagtacacttggatgcagtgcgtctgaagtgctaatcagttgtaacaatagcacaaatcgaacttaggatttgtttcttctcttctgtgtttcgatttttgatcaattctttaattttggaagcctataatacagttttctattcttggagataaaaattaaatggatcactgatattttagtcattctgcttctcatctaaatatttccatattctgtattaggagaaaattaccctcccagcaccagcccccctctcaaacccccaacccaaaaccaagcattttggaatgagtctcctttagtttcagagtgtggattgtataacccatatactcttcgatgtacttgtttggtttggtattaatttgactgtgcatgacagcggcaatcttttctttggtcaaagttttctgtttattttgcttgtcatattcgatgtactttaaggtgtctttatgaagtttgctattctggcaataaacttttagacttttgaagtgtttgtgttttaatttaatatgtttataagcatgtataaacatttagcatatttttatcataggtctaaaaatatttgtttactaaatacctgtgaagaaataccattaaaaaactatttggttctgaattcttactagaa

SEQ ID NO: 1371 - DNA, 6928 bp, Homo sapiens
caacaacaaagggcggagatggacatggtggcctggggtgtggacctggcctcagtggagcagcacattaacagccaccggggcatccacaactccatcggcgactatcgctggcagctggacaaaatcaaagccgacctgcgcgagaaatctgctatctaccagttggaggaggagtatgaaaacctgctgaaagcgtcctttgagaggatggatcacctgcgacagctgcagaacatcattcaggccacgtccagggagatcatgtggatcaatgactgcgaggaggaggagctgctgtacgactggagcgacaagaacaccaacatcgctcagaaacaggaggccttctccatacgcatgagtcaactggaagttaaagaaaaagagctcaataagctgaaacaagaaagtgaccaacttgtcctcaatcagcatccagcttcagacaaaattgaggcctatatggacactctgcagacgcagtggagttggattcttcagatcaccaagtgcattgatgttcatctgaaagaaaatgctgcctactttcagttttttgaagaggcgcagtctactgaagcatacctgaaggggctccaggactccatcaggaagaagtacccctgcgacaagaacatgcccctgcagcacctgctggaacagatcaaggagctggagaaagaacgagagaaaatccttgaatacaagcgtcaggtgcagaacttggtaaacaagtctaagaagattgtacagctgaagcctcgtaacccagactacagaagcaataaacccattattctcagagctctctgtgactacaaacaagatcagaaaatcgtgcataagggggatgagtgtatcctgaaggacaacaacgagcgcagcaagtggtacgtgacgggcccgggaggcgttgacatgcttgttccctctgtggggctgatcatccctcctccgaacccactggccgtggacctctcttgcaagattgagcagtactacgaagccatcttggctctgtggaaccagctctacatcaacatgaagagcctggtgtcctggcactactgcatgattgacatagagaagatcagggccatgacaatcgccaagctgaaaacaatgcggcaggaagattacatgaagacgatagccgaccttgagttacattaccaagagttcatcagaaatagccaaggctcagagatgtttggagatgatgacaagcggaaaatacagtctcagttcaccgatgcccagaagcattaccagaccctggtcattcagctccctggctatccccagcaccagacagtgaccacaactgaaatcactcatcatggaacctgccaagatgtcaaccataataaagtaattgaaaccaacagagaaaatgacaagcaagaaacatggatgctgatggagctgcagaagattcgcaggcagatagagcactgcgagggcaggatgactctcaaaaacctccctctagcagaccagggatcttctcaccacatcacagtgaaaattaacgagcttaagagtgtgcagaatgattcacaagcaattgctgaggttctcaaccagcttaaagatatgcttgccaacttcagaggttctgaaaagtactgctatttacagaatgaagtatttggactatttcagaaactggaaaatatcaatggtgttacagatggctacttaaatagcttatgcacagtaagggcactgctccaggctattctccaaacagaagacatgttaaaggtttatgaagccaggctcactgaggaggaaactgtctgcctggacctggataaagtggaagcttaccgctgtggactgaagaaaataaaaaatgacttgaacttgaagaagtcgttgttggccactatgaagacagaactacagaaagcccagcagatccactctcagacttcacagcagtatccactttatgatctggacttgggcaagttcggtgaaaaagtcacacagctgacagaccgctggcaaaggatagataaacagatcgactttaggttatgggacctggagaaacaaatcaagcaattgaggaattatcgtgataactatcaggctttctgcaagtggctctatgatgctaaacgccgccaggattccttagaatccatgaaatttggagattccaacacagtcatgcggtttttgaatgagcagaagaacttgcacagtgaaatatctggcaaacgagacaaatcagaggaagtacaaaaaattgctgaactttgcgccaattcaattaaggattatgagctccagctggcctcatacacctcaggactggaaactctgctgaacatacctatcaagaggaccatgattcagtccccttctggggtgattctgcaagaggctgcagatgttcatgctcggtacattgaactacttacaagatctggagactattacaggttcttaagtgagatgctgaagagtttggaagatctgaagctgaaaaataccaagatcgaagttttggaagaggagctcagactggcccgagatgccaactcggaaaactgtaataagaacaaattcctggatcagaacctgcagaaataccaggcagagtgttcccagttcaaagcgaagcttgcgagcctggaggagctgaagagacaggctgagctggatgggaagtcggctaagcaaaatctagacaagtgctacggccaaataaaagaactcaatgagaagatcacccgactgacttatgagattgaagatgaaaagagaagaagaaaatctgtggaagacagatttgaccaacagaagaatgactatgaccaactgcagaaagcaaggcaatgtgaaaaggagaaccttggttggcagaaattagagtctgagaaagccatcaaggagaaggagtacgagattgaaaggttgagggttctactgcaggaagaaggcacccggaagagagaatatgaaaatgagctggcaaaggcatctaataggattcaggaatcaaagaatcagtgtactcaggtggtacaggaaagagagagccttctggtgaaaatcaaagtcctggagcaagacaaggcaaggctgcagaggctggaggatgagctgaatcgtgcaaaatcaactctagaggcagaaaccagggtgaaacagcgcctggagtgtgagaaacagcaaattcagaatgacctgaatcagtggaagactcaatattcccgcaaggaggaggctattaggaagatagaatcggaaagagaaaagagtgagagagagaagaacagtcttaggagtgagatcgaaagactccaagcagagatcaagagaattgaagagaggtgcaggcgtaagctggaggattctaccagggagacacagtcacagttagaaacagaacgctcccgatatcagagggagattgataaactcagacagcgcccatatgggtcccatcgagagacccagactgagtgtgagtggaccgttgacacctccaagctggtgtttgatgggctgaggaagaaggtgacagcaatgcagctctatgagtgtcagctgatcgacaaaacaaccttggacaaactattgaaggggaagaagtcagtggaagaagttgcttctgaaatccagccattccttcggggtgcaggatctatcgctggagcatctgcttctcctaaggaaaaatactctttggtagaggccaagagaaagaaattaatcagcccagaatccacagtcatgcttctggaggcccaggcagctacaggtggtataattgatccccatcggaatgagaagctgactgtcgacagtgccatagctcgggacctcattgacttcgatgaccgtcagcagatatatgcagcagaaaaagctatcactggttttgatgatccattttcaggcaagacagtatctgtttcagaagccatcaagaaaaatttgattgatagagaaaccggaatgcgcctgctggaagcccagattgcttcagggggtgtagtagaccctgtgaacagtgtctttttgccaaaagatgtcgccttggcccgggggctgattgatagagatttgtatcgatccctgaatgatccccgagatagtcagaaaaactttgtggatccagtcaccaaaaagaaggtcagttacgtgcagctgaaggaacggtgcagaatcgaaccacatactggtctgctcttgctttcagtacagaagagaagcatgtccttccaaggaatcagacaacctgtgaccgtcactgagctagtagattctggtatattgagaccgtccactgtcaatgaactggaatctggtcagatttcttatgacgaggttggtgagagaattaaggacttcctccagggttcaagctgcatagcaggcatatacaatgagaccacaaaacagaagcttggcatttatgaggccatgaaaattggcttagtccgacctggtactgctctggagttgctggaagcccaagcagctactggctttatagtggatcctgttagcaacttgaggttaccagtggaggaagcctacaagagaggtctggtgggcattgagttcaaagagaagctcctgtctgcagaacgagctgtcactgggtataatgatcctgaaacaggaaacatcatctctttgttccaagccatgaataaggaactcatcgaaaagggccacggtattcgcttattagaagcacagatcgcaaccggggggatcattgacccaaaggagagccatcgtttaccagttgacatagcatataagaggggctatttcaatgaggaactcagtgagattctctcagatccaagtgatgataccaaaggattttttgaccccaacactgaagaaaatcttacctatctgcaactaaaagaaagatgcattaaggatgaggaaacagggctctgtcttctgcctctgaaagaaaagaagaaacaggtgcagacatcacaaaagaataccctcaggaagcgtagagtggtcatagttgacccagaaaccaataaagaaatgtctgttcaggaggcctacaagaagggcctaattgattatgaaaccttcaaagaactgtgtgagcaggaatgtgaatgggaagaaataaccatcacgggatcagatggctccaccagggtggtcctggtagatagaaagacaggcagtcagtatgatattcaagatgctattgacaagggccttgttgacaggaagttctttgatcagtaccgatccggcagcctcagcctcactcaatttgctgacatgatctccttgaaaaatggtgtcggcaccagcagcagcatgggcagtggtgtcagcgatgatgtttttagcagctcccgacatgaatcagtaagtaagatttccaccatatccagcgtcaggaatttaaccataaggagcagctctttttcagacaccctggaagaatcgagccccattgcagccatctttgacacagaaaacctggagaaaatctccattacagaaggtatagagcggggcatcgttgacagcatcacgggtcagaggcttctggaggctcaggcctgcacaggtggcatcatccacccaaccacgggccagaagctgtcacttcaggacgcagtctcccagggtgtgattgaccaagacatggccaccaggctgaagcctgctcagaaagccttcataggcttcgagggtgtgaagggaaagaagaagatgtcagcagcagaggcagtgaaagaaaaatggctcccgtatgaggctggccagcgcttcctggagttccagtacctcacgggaggtcttgttgacccggaagtgcatgggaggataagcaccgaagaagccatccggaaggggttcatagatggccgcgccgcacagaggctgcaagacaccagcagctatgccaaaatcctgacctgccccaaaaccaaattaaaaatatcctataaggatgccataaatcgctccatggtagaagatatcactgggctgcgccttctggaagccgcctccgtgtcgtccaagggcttacccagcccttacaacatgtcttcggctccggggtcccgctccggctcccgctcgggatctcgctccggatctcgctccgggtcccgcagtgggtcccggagaggaagctttgacgccacagggaattcttcctactcttattcctactcatttagcagtagttctattgggcactagtagtcagttgggagtggttgctataccttgacttcatttatatgaatttccactttattaaataatagaaaagaaaatcccggtgcttgcagtagagtgataggacattctatgcttacagaaaatatagccatgattgaaatcaaatagtaaaggctgttctggctttttatcttcttagctcatcttaaataagcagtacacttggatgcagtgcgtctgaagtgctaatcagttgtaacaatagcacaaatcgaacttaggatttgtttcttctcttctgtgtttcgatttttgatcaattctttaattttggaagcctataatacagttttctattcttggagataaaaattaaatggatcactgatattttagtcattctgcttctcatctaaatatttccatattctgtattaggagaaaattaccctcccagcaccagcccccctctcaaacccccaacccaaaaccaagcattttggaatgagtctcctttagtttcagagtgtggattgtataacccatatactcttcgatgtacttgtttggtttggtattaatttgactgtgcatgacagcggcaatcttttctttggtcaaagttttctgtttattttgcttgtcatattcgatgtactttaaggtgtctttatgaagtttgctattctggcaataaacttttagacttttg

SEQ ID NO: 1372 - DNA, 7812 bp, Homo sapiens
ggaggagactcgctccgccgccgaccaacaccaacacccagctccgacgcagctcctctgcgcccttgccgccctccgagccacagctttcctcccgctcctgcccccggcccgtcgccgtctccgcgctcgcagcggcctcgggagggcccaggtagcgagcagcgacctcgcgagccttccgcactcccgcccggttccccggccgtccgcctatccttggccccctccgctttctccgcgccggcccgcctcgcttatgcctcggcgctgagccgctctcccgattgcccgccgacatgagctgcaacggaggctcccacccgcggatcaacactctgggccgcatgatccgcgccgagtctggcccggacctgcgctacgaggtgaccagcggcggcgggggcaccagcaggatgtactattctcggcgcggcgtgatcaccgaccagaactcggacggctactgtcaaaccggcacgatgtccaggcaccagaaccagaacaccatccaggagctgctgcagaactgctccgactgcttgatgcgagcagagctcatcgtgcagcctgaattgaagtatggagatggaatacaactgactcggagtcgagaattggatgagtgttttgcccaggccaatgaccaaatggaaatcctcgacagcttgatcagagagatgcggcagatgggccagccctgtgatgcttaccagaaaaggcttcttcagctccaagagcaaatgcgagccctttataaagccatcagtgtccctcgagtccgcagggccagctccaagggtggtggaggctacacttgtcagagtggctctggctgggatgagttcaccaaacatgtcaccagtgaatgtttggggtggatgaggcagcaaagggcggagatggacatggtggcctggggtgtggacctggcctcagtggagcagcacattaacagccaccggggcatccacaactccatcggcgactatcgctggcagctggacaaaatcaaagccgacctgcgcgagaaatctgctatctaccagttggaggaggagtatgaaaacctgctgaaagcgtcctttgagaggatggatcacctgcgacagctgcagaacatcattcaggccacgtccagggagatcatgtggatcaatgactgcgaggaggaggagctgctgtacgactggagcgacaagaacaccaacatcgctcagaaacaggaggccttctccatacgcatgagtcaactggaagttaaagaaaaagagctcaataagctgaaacaagaaagtgaccaacttgtcctcaatcagcatccagcttcagacaaaattgaggcctatatggacactctgcagacgcagtggagttggattcttcagatcaccaagtgcattgatgttcatctgaaagaaaatgctgcctactttcagttttttgaagaggcgcagtctactgaagcatacctgaaggggctccaggactccatcaggaagaagtacccctgcgacaagaacatgcccctgcagcacctgctggaacagatcaaggagctggagaaagaacgagagaaaatccttgaatacaagcgtcaggtgcagaacttggtaaacaagtctaagaagattgtacagctgaagcctcgtaacccagactacagaagcaataaacccattattctcagagctctctgtgactacaaacaagatcagaaaatcgtgcataagggggatgagtgtatcctgaaggacaacaacgagcgcagcaagtggtacgtgacgggcccgggaggcgttgacatgcttgttccctctgtggggctgatcatccctcctccgaacccactggccgtggacctctcttgcaagattgagcagtactacgaagccatcttggctctgtggaaccagctctacatcaacatgaagagcctggtgtcctggcactactgcatgattgacatagagaagatcagggccatgacaatcgccaagctgaaaacaatgcggcaggaagattacatgaagacgatagccgaccttgagttacattaccaagagttcatcagaaatagccaaggctcagagatgtttggagatgatgacaagcggaaaatacagtctcagttcaccgatgcccagaagcattaccagaccctggtcattcagctccctggctatccccagcaccagacagtgaccacaactgaaatcactcatcatggaacctgccaagatgtcaaccataataaagtaattgaaaccaacagagaaaatgacaagcaagaaacatggatgctgatggagctgcagaagattcgcaggcagatagagcactgcgagggcaggatgactctcaaaaacctccctctagcagaccagggatcttctcaccacatcacagtgaaaattaacgagcttaagagtgtgcagaatgattcacaagcaattgctgaggttctcaaccagcttaaagatatgcttgccaacttcagaggttctgaaaagtactgctatttacagaatgaagtatttggactatttcagaaactggaaaatatcaatggtgttacagatggctacttaaatagcttatgcacagtaagggcactgctccaggctattctccaaacagaagacatgttaaaggtttatgaagccaggctcactgaggaggaaactgtctgcctggacctggataaagtggaagcttaccgctgtggactgaagaaaataaaaaatgacttgaacttgaagaagtcgttgttggccactatgaagacagaactacagaaagcccagcagatccactctcagacttcacagcagtatccactttatgatctggacttgggcaagttcggtgaaaaagtcacacagctgacagaccgctggcaaaggatagataaacagatcgactttaggttatgggacctggagaaacaaatcaagcaattgaggaattatcgtgataactatcaggctttctgcaagtggctctatgatgctaaacgccgccaggattccttagaatccatgaaatttggagattccaacacagtcatgcggtttttgaatgagcagaagaacttgcacagtgaaatatctggcaaacgagacaaatcagaggaagtacaaaaaattgctgaactttgcgccaattcaattaaggattatgagctccagctggcctcatacacctcaggactggaaactctgctgaacatacctatcaagaggaccatgattcagtccccttctggggtgattctgcaagaggctgcagatgttcatgctcggtacattgaactacttacaagatctggagactattacaggttcttaagtgagatgctgaagagtttggaagatctgaagctgaaaaataccaagatcgaagttttggaagaggagctcagactggcccgagatgccaactcggaaaactgtaataagaacaaattcctggatcagaacctgcagaaataccaggcagagtgttcccagttcaaagcgaagcttgcgagcctggaggagctgaagagacaggctgagctggatgggaagtcggctaagcaaaatctagacaagtgctacggccaaataaaagaactcaatgagaagatcacccgactgacttatgagattgaagatgaaaagagaagaagaaaatctgtggaagacagatttgaccaacagaagaatgactatgaccaactgcagaaagcaaggcaatgtgaaaaggagaaccttggttggcagaaattagagtctgagaaagccatcaaggagaaggagtacgagattgaaaggttgagggttctactgcaggaagaaggcacccggaagagagaatatgaaaatgagctggcaaaggcatctaataggattcaggaatcaaagaatcagtgtactcaggtggtacaggaaagagagagccttctggtgaaaatcaaagtcctggagcaagacaaggcaaggctgcagaggctggaggatgagctgaatcgtgcaaaatcaactctagaggcagaaaccagggtgaaacagcgcctggagtgtgagaaacagcaaattcagaatgacctgaatcagtggaagactcaatattcccgcaaggaggaggctattaggaagatagaatcggaaagagaaaagagtgagagagagaagaacagtcttaggagtgagatcgaaagactccaagcagagatcaagagaattgaagagaggtgcaggcgtaagctggaggattctaccagggagacacagtcacagttagaaacagaacgctcccgatatcagagggagattgataaactcagacagcgcccatatgggtcccatcgagagacccagactgagtgtgagtggaccgttgacacctccaagctggtgtttgatgggctgaggaagaaggtgacagcaatgcagctctatgagtgtcagctgatcgacaaaacaaccttggacaaactattgaaggggaagaagtcagtggaagaagttgcttctgaaatccagccattccttcggggtgcaggatctatcgctggagcatctgcttctcctaaggaaaaatactctttggtagaggccaagagaaagaaattaatcagcccagaatccacagtcatgcttctggaggcccaggcagctacaggtggtataattgatccccatcggaatgagaagctgactgtcgacagtgccatagctcgggacctcattgacttcgatgaccgtcagcagatatatgcagcagaaaaagctatcactggttttgatgatccattttcaggcaagacagtatctgtttcagaagccatcaagaaaaatttgattgatagagaaaccggaatgcgcctgctggaagcccagattgcttcagggggtgtagtagaccctgtgaacagtgtctttttgccaaaagatgtcgccttggcccgggggctgattgatagagatttgtatcgatccctgaatgatccccgagatagtcagaaaaactttgtggatccagtcaccaaaaagaaggtcagttacgtgcagctgaaggaacggtgcagaatcgaaccacatactggtctgctcttgctttcagtacagaagagaagcatgtccttccaaggaatcagacaacctgtgaccgtcactgagctagtagattctggtatattgagaccgtccactgtcaatgaactggaatctggtcagatttcttatgacgaggttggtgagagaattaaggacttcctccagggttcaagctgcatagcaggcatatacaatgagaccacaaaacagaagcttggcatttatgaggccatgaaaattggcttagtccgacctggtactgctctggagttgctggaagcccaagcagctactggctttatagtggatcctgttagcaacttgaggttaccagtggaggaagcctacaagagaggtctggtgggcattgagttcaaagagaagctcctgtctgcagaacgagctgtcactgggtataatgatcctgaaacaggaaacatcatctctttgttccaagccatgaataaggaactcatcgaaaagggccacggtattcgcttattagaagcacagatcgcaaccggggggatcattgacccaaaggagagccatcgtttaccagttgacatagcatataagaggggctatttcaatgaggaactcagtgagattctctcagatccaagtgatgataccaaaggattttttgaccccaacactgaagaaaatcttacctatctgcaactaaaagaaagatgcattaaggatgaggaaacagggctctgtcttctgcctctgaaagaaaagaagaaacaggtgcagacatcacaaaagaataccctcaggaagcgtagagtggtcatagttgacccagaaaccaataaagaaatgtctgttcaggaggcctacaagaagggcctaattgattatgaaaccttcaaagaactgtgtgagcaggaatgtgaatgggaagaaataaccatcacgggatcagatggctccaccagggtggtcctggtagatagaaagacaggcagtcagtatgatattcaagatgctattgacaagggccttgttgacaggaagttctttgatcagtaccgatccggcagcctcagcctcactcaatttgctgacatgatctccttgaaaaatggtgtcggcaccagcagcagcatgggcagtggtgtcagcgatgatgtttttagcagctcccgacatgaatcagtaagtaagatttccaccatatccagcgtcaggaatttaaccataaggagcagctctttttcagacaccctggaagaatcgagccccattgcagccatctttgacacagaaaacctggagaaaatctccattacagaaggtatagagcggggcatcgttgacagcatcacgggtcagaggcttctggaggctcaggcctgcacaggtggcatcatccacccaaccacgggccagaagctgtcacttcaggacgcagtctcccagggtgtgattgaccaagacatggccaccaggctgaagcctgctcagaaagccttcataggcttcgagggtgtgaagggaaagaagaagatgtcagcagcagaggcagtgaaagaaaaatggctcccgtatgaggctggccagcgcttcctggagttccagtacctcacgggaggtcttgttgacccggaagtgcatgggaggataagcaccgaagaagccatccggaaggggttcatagatggccgcgccgcacagaggctgcaagacaccagcagctatgccaaaatcctgacctgccccaaaaccaaattaaaaatatcctataaggatgccataaatcgctccatggtagaagatatcactgggctgcgccttctggaagccgcctccgtgtcgtccaagggcttacccagcccttacaacatgtcttcggctccggggtcccgctccggctcccgctcgggatctcgctccggatctcgctccgggtcccgcagtgggtcccggagaggaagctttgacgccacagggaattcttcctactcttattcctactcatttagcagtagttctattgggcactagtagtcagttgggagtggttgctataccttgacttcatttatatgaatttccactttattaaataatagaaaagaaaatcccggtgcttgcagtagagtgataggacattctatgcttacagaaaatatagccatgattgaaatcaaatagtaaaggctgttctggctttttatcttcttagctcatcttaaataagcagtacacttggatgcagtgcgtctgaagtgctaatcagttgtaacaatagcacaaatcgaacttaggatttgtttcttctcttctgtgtttcgatttttgatcaattctttaattttggaagcctataatacagttttctattcttggagataaaaattaaatggatcactgatattttagtcattctgcttctcatctaaatatttccatattctgtattaggagaaaattaccctcccagcaccagcccccctctcaaacccccaacccaaaaccaagcattttggaatgagtctcctttagtttcagagtgtggattgtataacccatatactcttcgatgtacttgtttggtttggtattaatttgactgtgcatgacagcggcaatcttttctttggtcaaagttttctgtttattttgcttgtcatattcgatgtactttaaggtgtctttatgaagtttgctattctggcaataaacttttagacttttg

SEQ ID NO: 1373 - DNA, 3833 bp, Homo sapiens
caaaagtgcatccctgcccccgccccctcttccgtgtgggccctccctgtcccctctctgtcacctcacagtagtcgttgccggtagcgggtgtgggggcgcgagcagcgcagggcggcctctcccccacccctcagcccgggcccgggctcggtccccccctctccctccgcttcgcactcccgtcgggtacgggaaggtccaagccgctgccgggtgcccgagggccgtcgtggccgccgtcgccacgggtcccaatggagccgccgaatctctatccggtgaagctctacgtgtacgacctgtccaaaggcctggcccggcggctcagccccatcatgctggggaaacaactggaaggcatctggcacacatccatagttgtgcacaaggatgagttcttcttcggcagtggtggtatctccagctgccccccgggagggacattgcttgggcctccagactctgtggttgatgtggggagtacagaagtcacagaagaaatctttctggagtacctctcctccctgggggagtccctgttccgaggtgaggcctacaacctctttgaacacaattgtaacaccttcagcaacgaagtggcacagttcctgactgggcggaagattccttcttacatcacagacctgccctctgaagttctctccacgccctttggacaggcacttcggcccctcctggactccattcagatccagcctccaggagggagctccgtgggcagacccaacggccagagctaacaggactgcctgggaccgccctgcctcaccagggcttttcctttttaaacaaaacaaaccctaccagatttctattttataattttacatcagagctaacaaccaggggacggctttttaaatttcccagggaaggagaccgtcaggccgcatgtagacaatgctgctaagaaacagaacaaaatgccaccccttctaatagtattatactaatttattaaggctgtcttgtctgtgcgttcacttcggatgctgtttcctaagcgtcctccacactggagaaagggaggggctttgtttaaacagaaagcgagtcacagtttgcgggagccccaacctagaactctttccagagaacactcacgctctacccaagttgccaacacctgtgggacccaggtgagttttagaacatccgtgacccagaaagttactctagtgttaaatgaaccaaaggatttggtgtacatgggaccggtttcaggatgactaacctaacctaagtgaactctttagccacaaccctcaccttccctcccttaccccaagcaaggccagtgctggagcagccattgcctccggatcaagggagtaacagcaagtatcaggccggagaaaacaggataaagccattcctccttccacctagatggattgccaatcttctgccatcaattttgggaaacctgcctttgtgcccccgaggctgcctttcctcagcatagctgacttgtcatagtggatgaggtctgggctggagcagtagaagccaaggccttttttctgcaagtaatgatgtaggttatttgcagtctctgtaaccaccatccaggccagtacgcagtatttagctggggaccaagggatgggattccctactctaagaaaatacctttattttaattattattattttttgagacggagtctcgctctaccacccaggctggtgtgcagtggcatgatctcggctcacagaaacctctgcctcccgggttcaagtggttctcctgcctcagcctcctgagtagctgggattacaggtgcgtgccaccacgccaggctaatttttgtattttcagtagagacagggttttgccatgttggccaggctggtctggaactcctgacctcgggtgatccacctcccttggcctcccaaagtgctgggattacaggcgtgagccaccgctgcctggccagaaaatacctttgatatggaaagaataatgatgtgaggcctggcgcggtggctcacgcctgtaatcccagcactttgggaggccgaggcaggcagatcacttgaggtcaggacttcaagaccagcctggccaacatggtgaaaccccgtctctactaaaaatacaaaattagccgggcatggtggcgcatgcctgtagtcccagctactcgggaggctgaggcaggagaatcgcttgaacccgggaggcagagattgcgatgagccgagatcgtaccagtgcactccagcctgggcgacagagtgagactccatctcaaaaaaataaaataatgaagtggaatcaaggtggcaagaaaatttagaatcgtttctgatagggactttcccttatcctaaatgtgttttgaaggcacacgttatttccattgtcattctgactttagaaaggcaggttggggcatgagtgggcattttcctaatgacttgctgctaggaggttataggcagggaacagtctgggagtctctaatccagagagactttcagattccctctcttcacatgaacctccattagttagattttgggaaagtgagcatgaagaagggactcagagctgccaggtacccgagtctcaggtctgacatccttgggccccttctgccacaacttcttgccacttcacggacttgaattatgttgcttcttcctggaagtctggcctgcagcacaggcctttcctctccaaaaagctgctgctcatttctggccccatctgctgctatctttgccatcagccatcacagtttggcatcatcagagtctcagctagaggagctgtcattctgccttagtgtttgcctgcgacctgaccaggggcatgaccagctgggatgtcaagtgacatttgggaacttgtagaggccaaatgattgaaagtttaattcttctcaagacccactgatttgccagtgtgcatggaaataatagattagagcagaaactagcagggactgttgtataatcgtgatctactagcagaattgggcccaaagagaaagaatttctgaggctgggtttcttctgggagggtagcaggttggtcttggccagtgctctgtttcccaccagtgttgttcccttttccagcttgcctggcccggctctgtcttccagggtcctgctccagacccctctgcctggggtctcccctccatccagggggttctgggcatcacagctcctttttttcctttctcctcttccagatccagtttcagctggtttgcttcttccagcaggcacccttaggcccaggagcagctcccctgagagaatttgagtcactcatttccttgaacagcacccccctttatactagcagccatttgtgccattgcctgtgccctagggtttgtggggagagagcgagggatcactgagcagttttcccagagctccatgggaaggcaagctctccctcccaatgggagccccactgtcactaactgtaaactcaggctcaggcttcaactgcctacccccatcctcatatttctgtctgtcccagcacctcaggagcattctcattgtggccggctaactccgcctggatgtgaacaggcaagcacagtgggaaatgagtcacgtacttgtattgcacagtggacacctctagaggtccattggtttaaagggatagggaaggaggagggatgagaccatcaccccctcccagaagtaaatctagtatctgagttttctttatgcccttgagtcaaactaataactgtctagtacggaggtgtttgctggttttcttcggtgttttttctaatgcaataaactcatttctgcctgctgca

SEQ ID NO: 1374 - DNA, 1316 bp, Homo sapiens
acttccggcgtgtgcgtctggcgtccgcgcgctgcacaatggcggctctgaagagttggctgtcgcgcagcgtaacttcattcttcaggttcctgcttggctcgagtttgagtttacagcccctgcaagtaaatccaagagcctgttacagattggcggtcgtgccttatgaaatctgacttctacttccagaaatcagagcctcattcccttagtagtgaagcattgatgaggagagcagtgtctttggtaacagatagcacctctacctttctctctcagaccacatatgcgttgattgaagctattactgaatatactaaggctgtttataccttaacttctctttaccgacaatatacaagtttacttgggaaaatgaattcagaggaggaagatgaagtgtggcaggtgatcataggagccagagctgagatgacttcaaaacaccaagagtacttgaagctggaaaccacttggatgactgcagttggtctttcagagatggcagcagaagctgcatatcaaactggcgcagatcaggcctctataaccgccaggaatcacattcagctggtgaaactgcaggtggaagaggtgcaccagctctcccggaaagcagaaaccaagctggcagaagcacagatagaagagctccgtcagaaaacacaggaggaaggggaggagcgggctgagtcggagcaggaggcctacctgcgtgaggattgagggcctgagcacactgccctgtctccccactcagtggggaaagcaggggcagatgccaccctgcccagggttggcatgactgtctgtgcaccgagaagaggcggcagatcctgccctggccaatcaggcgagacgcctttgtgagctgtgagtgcctcctgtggtctcaggcttgcgctggacctggttcttagcccttgggcactgcaccctgtttaacatttcaccccactctgtacagctgctcttacccattttttttacctcacacccaaagcattttgcctacctgggtcagagagaggagtcctttttgtcatgcccttaagttcagcaactgtttaacctgttttcagtcttatttacgtcgtcaaaaatgatttagtacttgttccctctgttgggatgccagttgtggcagggggaggggaacctgtccagtttgtacgatttctttgtatgtatttctgatgtgttctctgatctgcccccactgtcctgtgaggacagctgaggccaaggagtgaaaaacctattactactaagagaaggggtgcagagtgtttacctggtgctctcaacaggac

SEQ ID NO: 1375 - DNA, 1338 bp, Homo sapiens
acttccggcgtgtgcgtctggcgtccgcgcgctgcacaatggcggctctgaagagttggctgtcgcgcagcgtaacttcattcttcaggtacagacagtgtttgtgtgttcctgttgtggctaactttaagaagcggtgtttctcagaattgataagaccatggcacaaaactgtgacgattggctttggagtaaccctgtgtgcggttcctattgcacaggctgtttataccttaacttctctttaccgacaatatacaagtttacttgggaaaatgaattcagaggaggaagatgaagtgtggcaggtgatcataggagccagagctgagatgacttcaaaacaccaagagtacttgaagctggaaaccacttggatgactgcagttggtctttcagagatggcagcagaagctgcatatcaaactggcgcagatcaggcctctataaccgccaggaatcacattcagctggtgaaactgcaggtggaagaggtgcaccagctctcccggaaagcagaaaccaagctggcagaagcacagatagaagagctccgtcagaaaacacaggaggaaggggaggagcgggctgagtcggagcaggaggcctacctgcgtgaggattgagggcctgagcacactgccctgtctccccactcagtggggaaagcaggggcagatgccaccctgcccagggttggcatgactgtctgtgcaccgagaagaggcggcagatcctgccctggccaatcaggcgagacgcctttgtgagctgtgagtgcctcctgtggtctcaggcttgcgctggacctggttcttagcccttgggcactgcaccctgtttaacatttcaccccactctgtacagctgctcttacccattttttttacctcacacccaaagcattttgcctacctgggtcagagagaggagtcctttttgtcatgcccttaagttcagcaactgtttaacctgttttcagtcttatttacgtcgtcaaaaatgatttagtacttgttccctctgttgggatgccagttgtggcagggggaggggaacctgtccagtttgtacgatttctttgtatgtatttctgatgtgttctctgatctgcccccactgtcctgtgaggacagctgaggccaaggagtgaaaaacctattactactaagagaaggggtgcagagtgtttacctggtgctctcaacaggacttaacatcaacaggacttaacacaggcctcttgttccttcctttctttccgtttctctattgtatccaaaggagaagagtgtaagattttgtttgcatctgaaagagaaaatgcgtctctcctgg

SEQ ID NO: 1376 - DNA, 2111 bp, Homo sapiens
acgcggaggttgtaattggtctctagaccacacctagttgttgagtgccgctgcttgaaaatctcagttctgccgagatcgcagaatacacacaagctacctttgggcaccagagcagacagaaccgcggagcttcagggtggaagattcgtggaaactttgccaaggccaggacctcgtgtgttcccgtccgcccctctgggacggcgccagcccggcaggccgccgaccgtcctggggctcccgcgcagcgcgatgccggcctcgtccaccgtccacgtgctgcagctgctgcgggagctgctcgccttcgtgctcctcagctacacggtgctcatcggggcgctgctgctggccggctggaccacttacttcctggtgctgaagtgacagcgccgtcgccgcgcccggccccgcctcccgcccggccccgcctcccgcccggccccgcctccctaactcaccaggaaattcccttcaagccctggcccgaactgagtccccgcccacccgccagcgtcacggcgcccgactcagctccgcgccggacccacctccgcgccctcaggccctgcatatgccccgccccgcgcggaagttccggcggttggttgccttgcgcggccgttacagcctttgccctaagcctcgccccctttccccctgcctgcccaatcccgactgcttccttgggtgggggcgtggctatggggcgaggcgctctcaggtggaggccgtgccccgctccgcgctcacgaagctgcgtcacttccggcgtgtgcgtctggcgtccgcgcgctgcacaatggcggctctgaagagttggctgtcgcgcagcgtaacttcattcttcaggtacagacagtgtttgtgtgttcctgttgtggctaactttaagaagcggtgtttctcagaattgataagaccatggcacaaaactgtgacgattggctttggagtaaccctgtgtgcggttcctattgcacaggctgtttataccttaacttctctttaccgacaatatacaagtttacttgggaaaatgaattcagaggaggaagatgaagtgtggcaggtgatcataggagccagagctgagatgacttcaaaacaccaagagtacttgaagctggaaaccacttggatgactgcagttggtctttcagagatggcagcagaagctgcatatcaaactggcgcagatcaggcctctataaccgccaggaatcacattcagctggtgaaactgcaggtggaagaggtgcaccagctctcccggaaagcagaaaccaagctggcagaagcacagatagaagagctccgtcagaaaacacaggaggaaggggaggagcgggctgagtcggagcaggaggcctacctgcgtgaggattgagggcctgagcacactgccctgtctccccactcagtggggaaagcaggggcagatgccaccctgcccagggttggcatgactgtctgtgcaccgagaagaggcggcagatcctgccctggccaatcaggcgagacgcctttgtgagctgtgagtgcctcctgtggtctcaggcttgcgctggacctggttcttagcccttgggcactgcaccctgtttaacatttcaccccactctgtacagctgctcttacccattttttttacctcacacccaaagcattttgcctacctgggtcagagagaggagtcctttttgtcatgcccttaagttcagcaactgtttaacctgttttcagtcttatttacgtcgtcaaaaatgatttagtacttgttccctctgttgggatgccagttgtggcagggggaggggaacctgtccagtttgtacgatttctttgtatgtatttctgatgtgttctctgatctgcccccactgtcctgtgaggacagctgaggccaaggagtgaaaaacctattactactaagagaaggggtgcagagtgtttacctggtgctctcaacaggacttaacatcaacaggacttaacacaggcctcttgttccttcctttctttccgtttctctattgtatccaaaggagaagagtgtaagattttgtttgcatctgaaagagaaaatgcgtctctcctggggtcct

SEQ ID NO: 1377 - DNA, 2250 bp, Homo sapiens
gagctcggggaccacgcggaggttgtaattggtctctagaccacacctagttgttgagtgccgctgcttgaaaatctcagttctgccgagatcgcagaatacacacaagctacctttgggcaccagagcagacagaaccgcggagcttcagggtggaagattcgtggaaactttgccaaggccaggacctcgtgtgttcccgtccgcccctctgggacggcgccagcccggcaggccgccgaccgtcctggggctcccgcgcagcgcgatgccggcctcgtccaccgtccacgtgctgcagctgctgcgggagctgctcgccttcgtgctcctcagctacacggtgctcatcggggcgctgctgctggccggctggaccacttacttcctggtgctgaagtgacagcgccgtcgccgcgcccggccccgcctcccgcccggccccgcctcccgcccggccccgcctccctaactcaccaggaaattcccttcaagccctggcccgaactgagtccccgcccacccgccagcgtcacggcgcccgactcagctccgcgccggacccacctccgcgccctcaggccctgcatatgccccgccccgcgcggaagttccggcggttggttgccttgcgcggccgttacagcctttgccctaagcctcgccccctttccccctgcctgcccaatcccgactgcttccttgggtgggggcgtggctatggggcgaggcgctctcaggtggaggccgtgccccgctccgcgctcacgaagctgcgtcacttccggcgtgtgcgtctggcgtccgcgcgctgcacaatggcggctctgaagagttggctgtcgcgcagcgtaacttcattcttcaggtacagacagtgtttgtgtgttcctgttgtggctaactttaagaagcggtgtttctcagaattgataagaccatggcacaaaactgtgacgattggctttggagtaaccctgtgtgcggttcctattgcacagaaatcagagcctcattcccttagtagtgaagcattgatgaggagagcagtgtctttggtaacagatagcacctctacctttctctctcagaccacatatgcgttgattgaagctattactgaatatactaaggctgtttataccttaacttctctttaccgacaatatacaagtttacttgggaaaatgaattcagaggaggaagatgaagtgtggcaggtgatcataggagccagagctgagatgacttcaaaacaccaagagtacttgaagctggaaaccacttggatgactgcagttggtctttcagagatggcagcagaagctgcatatcaaactggcgcagatcaggcctctataaccgccaggaatcacattcagctggtgaaactgcaggtggaagaggtgcaccagctctcccggaaagcagaaaccaagctggcagaagcacagatagaagagctccgtcagaaaacacaggaggaaggggaggagcgggctgagtcggagcaggaggcctacctgcgtgaggattgagggcctgagcacactgccctgtctccccactcagtggggaaagcaggggcagatgccaccctgcccagggttggcatgactgtctgtgcaccgagaagaggcggcagatcctgccctggccaatcaggcgagacgcctttgtgagctgtgagtgcctcctgtggtctcaggcttgcgctggacctggttcttagcccttgggcactgcaccctgtttaacatttcaccccactctgtacagctgctcttacccattttttttacctcacacccaaagcattttgcctacctgggtcagagagaggagtcctttttgtcatgcccttaagttcagcaactgtttaacctgttttcagtcttatttacgtcgtcaaaaatgatttagtacttgttccctctgttgggatgccagttgtggcagggggaggggaacctgtccagtttgtacgatttctttgtatgtatttctgatgtgttctctgatctgcccccactgtcctgtgaggacagctgaggccaaggagtgaaaaacctattactactaagagaaggggtgcagagtgtttacctggtgctctcaacaggacttaacatcaacaggacttaacacaggcctcttgttccttcctttctttccgtttctctattgtatccaaaggagaagagtgtaagattttgtttgcatctgaaagagaaaatgcgtctctcctgg

SEQ ID NO: 1378 - DNA, 2569 bp, Homo sapiens
aagctgcgtcacttccggcgtgtgcgtctggcgtccgcgcgctgcacaatggcggctctgaagagttggctgtcgcgcagcgtaacttcattcttcaggtaccgctgcggccgcgtagaggggacaggaccagagggagggaccgacgcggacagcgctgtggcccggcccacggcgcccgccttccttacgcgctcatctctcgtccgcccagctgggtcgcggcgtctcgctccggtcgggaggactgaggacagccccgcctccgccccctgggtcaagcccggcttccttttcagttcgtccatcttctagaaacgagtccccgagaccccgggctgccttcttggggctgctccgcctcctgaccagccctcgtcagccactcgaagtccctgaggagacgtggagaggaggagggacacggcatggggggagtccgggaagggagacgagcgtctgaagacgtcctcccgagggcagaaggggccgggggagctggcgcagggctctctacctagcgctgcaggctcctgggcgattgtagcgggaccgtcacacacaactggcacccaggccaggggtccagagctaaattctgcctgcaggagcggttattgtggcatccgtttctaaaaagtttaaaggcaacattttattttattttaatttttttgagacaagatctgcctctgtcgcccaggctggagtgcagtggcgagatctcagctcactgcaacctgtgcctcccggcttcaagcgattctcagcctcagcctcccgagtagctgggattgcaggcgcccgccaccacgcccggctaatttttttttttctttttgttttgtttgagactcagtctcgctctgttgcccaggctgaagtgcagtggggcgctctcggctcactgcaacctctgcctcccaggttcaagcgattctcctgcctcagcctcccgagtagctgggattacaggagcgtgccaccactccgggctaatttttgtgttttaagtagagatggggtttcaccatgttggtcaggcagatttcgaattcctgacctcaagtgatccacccgcctcggcctttatttacttatttttttttaatagacacggggtcatgttgccagccatgttgcccaggctggtcgtgaactcctgggctcaagtgatcctcccgccttgcccttggccttccaagtgctaggattacaggcgtgagccaccaacaccctgcctgaggcaacattttaaacttggtgtatgttgaaaatttcaaaacccctcagctgtcctgcatcctcatttaggttcctgcttggctcgagtttgagtttacagcccctgcaagtaaatccaagagcctgttacagattggcggtcgtgccttatgaaatctgacttctacttccagaaatcagagcctcattcccttagtagtgaagcattgatgaggagagcagtgtctttggtaacagatagcacctctacctttctctctcagaccacatatgcgttgattgaagctattactgaatatactaaggctgtttataccttaacttctctttaccgacaatatacaagtttacttgggaaaatgaattcagaggaggaagatgaagtgtggcaggtgatcataggagccagagctgagatgacttcaaaacaccaagagtacttgaagctggaaaccacttggatgactgcagttggtctttcagagatggcagcagaagctgcatatcaaactggcgcagatcaggcctctataaccgccaggaatcacattcagctggtgaaactgcaggtggaagaggtgcaccagctctcccggaaagcagaaaccaagctggcagaagcacagatagaagagctccgtcagaaaacacaggaggaaggggaggagcgggctgagtcggagcaggaggcctacctgcgtgaggattgagggcctgagcacactgccctgtctccccactcagtggggaaagcaggggcagatgccaccctgcccagggttggcatgactgtctgtgcaccgagaagaggcggcagatcctgccctggccaatcaggcgagacgcctttgtgagctgtgagtgcctcctgtggtctcaggcttgcgctggacctggttcttagcccttgggcactgcaccctgtttaacatttcaccccactctgtacagctgctcttacccattttttttacctcacacccaaagcattttgcctacctgggtcagagagaggagtcctttttgtcatgcccttaagttcagcaactgtttaacctgttttcagtcttatttacgtcgtcaaaaatgatttagtacttgttccctctgttgggatgccagttgtggcagggggaggggaacctgtccagtttgtacgatttctttgtatgtatttctgatgtgttctctgatctgcccccactgtcctgtgaggacagctgaggccaaggagtgaaaaacctattactactaagagaaggggtgcagagtgtttacctggtgctctcaacaggacttaacatcaacaggacttaacacaggc

SEQ ID NO: 1379 - DNA, 5792 bp, Homo sapiens
attcatgaggcgcgcgcagcccggcatgctaatgaggcggggcgcggcggctggctaaagagcgactgggcggcggcgggcgcggagctgccaggcgggagcggcgtaggcgcggggtcgccggccagcgtgaaccgggacatggagccgcccggcgggagcctggggcccggccgcgggacccgggacaagaagaagggccggagcccagatgagctgccctcggcgggcggcgacggcggcaaatctaagaaatttactctgaagcggctcatggcagatgagctggagagatttaccagcatgagaattaagaaggagaaggaaaagcccaattctgctcatagaaattcttctgcatcatatggggatgatcccacagcacagtcattgcaagatgtttcagatgaacaagtgctggttctctttgaacagatgctgctggatatgaacctgaatgaggagaaacagcaacctttgagggagaaggacatcatcatcaagagggagatggtgtcccaatacttgtacacctccaaggctggcatgagccagaaggagagctctaagtctgccatgatgtatattcaggagttgaggtcaggcttgcgggatatgcctctgctcagctgcctggagtcccttcgtgtgtctctcaacaacaaccctgtcagttgggtgcaaacatttggtgctgaaggcttggcctccttattggacattcttaaacgacttcatgatgagaaagaagagactgctgggagttacgatagccggaacaagcatgagatcattcgctgcttgaaagcttttatgaacaacaagtttggaatcaagaccatgttggagacagaagaaggaatcctactgctggtcagagccatggatcctgctgttcccaacatgatgattgatgcagctaagctgctttctgctctttgtattctaccgcagccagaggacatgaatgaaagggttttggaggcaatgacagaaagagctgagatggatgaagtggaacgtttccagccgctgctggatggattaaaaagtggaaccactattgcactgaaggttggatgcctacagctgatcaatgctctcatcacaccagcggaggaacttgacttccgagttcacatcagaagtgaactgatgcgtttggggctacatcaggtgttgcaggaccttcgagagattgaaaatgaagatatgagagtgcaactaaatgtgtttgatgaacaaggggaagaggattcctatgacctgaagggacggctggatgacattcgcatggagatggatgactttaatgaagtctttcagattctcttaaacacagtgaaggattcaaaggcagagccacacttcctttccatcctgcagcacttactcttggtccgaaatgactatgaggccagacctcagtactataagttgattgaagaatgtatttcccagatagttctgcacaagaacggggctgatcctgacttcaagtgccggcacctccagattgagattgagggattaattgatcaaatgattgataagacaaaggtggagaaatctgaagccaaagctgcagagctggaaaagaagttggactcagagttaacagcccgacatgagctacaggtggaaatgaaaaagatggaaagtgactttgagcagaagcttcaagatcttcagggagaaaaagatgcactgcattctgaaaagcagcaaattgccacagagaaacaggacctggaagcagaggtgtcccagctcacaggagaggttgccaagctgacaaaggaactggaagatgccaagaaagaaatggcttccctctctgcggcagctattactgtacctccttctgttcctagtcgtgctcctgttccccctgcccctcctttacctggtgactctggcactattattccaccaccacctgctcctggggatagtaccactcctcctcctcctcctcctcctcctcctcctccacctcctttgcctgggggtgtttgcatctcctcacccccttctttacctggaggtactgctatctctccaccccctcctttgtctggggatgctaccatccctccaccccctcctttgcctgagggtgttggcatcccttcaccctcttctttgcctggaggtactgccatccccccacctcctcctttgcctgggagtgctagaatccccccaccaccacctcctttgcctgggagtgctggaattccccccccacctcctcccttgcctggagaagcaggaatgccacctcctcctccccctcttcctggtggtcctggaatccctccacctcctccatttcccggaggccctggcattcctccacctccacccggaatgggtatgcctccacctcccccatttggatttggagttcctgcagccccagttctgccatttggattaacccccaaaaagctttataagccagaggtgcagctccggaggccaaactggtccaagcttgtggctgaggacctctcccaggactgcttctggacaaaggtgaaggaggaccgctttgagaacaatgaacttttcgccaaacttacccttaccttctctgcccagaccaagagaacaaagaaggccaagaaggatcaagaaggtggagaagaaaagaaatctgtgcaaaagaaaaaagtaaaagagttaaaggtgttggattcaaagacagcccagaatctctcaatctttttgggttccttccgcatgccctatcaagagattaagaatgtcatcctggaggtgaatgaggctgttctgactgagtctatgatccagaacctcattaagcaaatgccagagccagagcagttaaaaatgctttctgaactgaaggatgaatatgatgacctggctgagtcagagcagtttggcgtggtgatgggcactgtgccccgactgcggcctcgcctcaatgccattctcttcaagctacaattcagcgagcaagtggagaatatcaagccagagattgtgtctgtcactgctgcatgtgaggagttacgtaagagtgagagcttttccaatctcctagagattaccttgcttgttggaaattacatgaatgctggctccagaaatgctggtgcttttggcttcaatatcagcttcctctgtaagcttcgagacaccaagtccacagatcagaagatgacgttgttacacttcttggctgagttgtgtgagaatgactatcccgatgtcctcaagtttccagacgagcttgcccatgtggagaaagccagccgagtttctgctgaaaacttgcaaaagaacctagatcagatgaagaaacaaatttctgatgtggaacgtgatgttcagaatttcccagctgccacagatgaaaaagacaagtttgttgaaaaaatgaccatctttgtgaaggatgcacaggaacagtataacaagctgcggatgatgcattctaacatggagaccctctataaggagctgggcgagtacttcctctttgaccccaagaagttgtctgttgaagaatttttcatggatcttcacaattttcggaatatgtttttgcaagcagtcaaggagaaccagaagcggcgggagacagaagaaaagatgaggcgagcaaaactagccaaggagaaggcagagaaggagcggctagagaagcagcagaagagagagcaactcatagacatgaatgcagagggcgatgagacaggtgtgatggacagtcttctagaagccctgcagtcaggggcagcattccgacggaagagagggccccgtcaagccaacaggaaggccgggtgtgcagtcacatctctgctagcttcggagctgaccaaggatgatgccatggctgctgttcctgccaaggtgtccaagaacagtgagacattccccacaatccttgaggaagccaaggagttggttggccgtgcaagctaatgtgggtcctgtgaccgcggcagctcctcagcggagccgcagactgtcctgccctgcagcatgtgcctaaaggctcaaggggatattcctctggggtggccactcccaccaccctgaccctgtctttctctctggcctgctgctctctcaacatcacatacagcttcagctgcctggaggccagaaggaaagggcagtgcaggggaggcctgagcccgacttagccagccctggctgttgtattaccaaagcagggtccatgtttgctgccttaaccctgtctcctctctgttactcagagggcctcatctcagacaaggcccagcctgctttttctcagccctgactttctaatgggctttcccccctaggtcagtcttgctggatttgtgcttttcttttgtggtttctctggccctgagaatagcatggggcttgtaaacctttgggctagatccctcctttcattgctgttgtctctgctcttccctctcctggctgtggttatttattattagtggtgtggcactgggagctgctcctaaggaagcagggagcaaatcccacctttaccccaccttcctgggaaaggcctccaaagcaaaggatctggaccagtttccctgctgtgctgtggcccaggccagagcctgtgggcaggcaggcagggcatagcgacagtgtgggacctgcccccagcttctgccacgctttatgcccttgcctctctggacgctctgcaccaaccccaggctactgagccaccttccctcctcatgccttccctgagctttggtgcatctcatctggactatgggttgtactgtgaccatcccaacacctcaccctctgtctacaaggaaatgggaggtggagcctcctggctgagaaattgttttgcaaatggatctatttttgtatgaaaaaaaaaatttttttaaagaaaactgttccttccccctttcccctccataatgtaagaagctttggtggcaggttacagagttctgggatttcttctcacaggcccaatcctgaatgtgcccctggaccttctggacccttgagtccaaggcagatcctctctcccagggaatccgacacaggaggaaccccttctctggttgagctgggccaggcctaagagtagcaggaactctaagaccacagagttttttataaatgtataaatgtatcaagccaaatgtgcagatgctaactggacattctggggaactgggcaccaggagtgccttcatacactgtaccccagctctcttctaaaagagaagtgggtgggcacactgaactgtttggtggccccaaccacaggaagctgcaattctctggcttagggtgatacttttgccctccttgtgcccctctcagctttccatccccagctaggaagaaagaatggcactcttgggcttggcccagaattagagttattagagcaagagagagcttaggaagcatgagggcaactatagtgaggccttattgccaggagggagggttttggttgctggcgcttgtgtataaaggggcaagagcagctcctttggactattcctgggaggactctgatgcagggcgtctgttgctcccctgggtcacctcctccctgctcgctgacatctggggctttgaccctttcttttttaatctacttttgctaagatgcatttaataaaaaaaaagagagagagagagaggtgtgagggacaaaatgcaaacctatttcccttgcctcataggcttctgggatgtcatcacctccagtttgttggttttgtttccaactgttaataaagcattgaaacagt

SEQ ID NO: 1380 - DNA, 5786 bp, Homo sapiens
attcatgaggcgcgcgcagcccggcatgctaatgaggcggggcgcggcggctggctaaagagcgactgggcggcggcgggcgcggagctgccaggcgggagcggcgtaggcgcggggtcgccggccagcgtgaaccgggacatggagccgcccggcgggagcctggggcccggccgcgggacccgggacaagaagaagggccggagcccagatgagctgccctcggcgggcggcgacggcggcaaatctaagaaatttactctgaagcggctcatggcagatgagctggagagatttaccagcatgagaattaagaaggagaaggaaaagcccaattctgctcatagaaattcttctgcatcatatggggatgatcccacagcacagtcattgcaagatgtttcagatgaacaagtgctggttctctttgaacagatgctgctggatatgaacctgaatgaggagaaacagcaacctttgagggagaaggacatcatcatcaagagggagatggtgtcccaatacttgtacacctccaaggctggcatgagccagaaggagagctctaagtctgccatgatgtatattcaggagttgaggtcaggcttgcgggatatgcctctgctcagctgcctggagtcccttcgtgtgtctctcaacaacaaccctgtcagttgggtgcaaacatttggtgctgaaggcttggcctccttattggacattcttaaacgacttcatgatgagaaagaagagactgctgggagttacgatagccggaacaagcatgagatcattcgctgcttgaaagcttttatgaacaacaagtttggaatcaagaccatgttggagacagaagaaggaatcctactgctggtcagagccatggatcctgctgttcccaacatgatgattgatgcagctaagctgctttctgctctttgtattctaccgcagccagaggacatgaatgaaagggttttggaggcaatgacagaaagagctgagatggatgaagtggaacgtttccagccgctgctggatggattaaaaagtggaaccactattgcactgaaggttggatgcctacagctgatcaatgctctcatcacaccagcggaggaacttgacttccgagttcacatcagaagtgaactgatgcgtttggggctacatcaggtgttgcaggaccttcgagagattgaaaatgaagatatgagagtgcaactaaatgtgtttgatgaacaaggggaagaggattcctatgacctgaagggacggctggatgacattcgcatggagatggatgactttaatgaagtctttcagattctcttaaacacagtgaaggattcaaaggcagagccacacttcctttccatcctgcagcacttactcttggtccgaaatgactatgaggccagacctcagtactataagttgattgaagaatgtatttcccagatagttctgcacaagaacggggctgatcctgacttcaagtgccggcacctccagattgagattgagggattaattgatcaaatgattgataagacaaaggtggagaaatctgaagccaaagctgcagagctggaaaagaagttggactcagagttaacagcccgacatgagctacaggtggaaatgaaaaagatggaaagtgactttgagcagaagcttcaagatcttcagggagaaaaagatgcactgcattctgaaaagcagcaaattgccacagagaaacaggacctggaagcagaggtgtcccagctcacaggagaggttgccaagctgacaaaggaactggaagatgccaagaaagaaatggcttccctctctgcggcagctattactgtacctccttctgttcctagtcgtgctcctgttccccctgcccctcctttacctggtgactctggcactattattccaccaccacctgctcctggggatagtaccactcctcctcctcctcctcctcctcctcctcctccacctcctttgcctgggggtgtttgcatctcctcacccccttctttacctggaggtactgctatctctccaccccctcctttgtctggggatgctaccatccctccaccccctcctttgcctgagggtgttggcatcccttcaccctcttctttgcctggaggtactgccatccccccacctcctcctttgcctgggagtgctagaatccccccaccaccacctcctttgcctgggagtgctggaattccccccccacctcctcccttgcctggagaagcaggaatgccacctcctcctccccctcttcctggtggtcctggaatccctccacctcctccatttcccggaggccctggcattcctccacctccacccggaatgggtatgcctccacctcccccatttggatttggagttcctgcagccccagttctgccatttggattaacccccaaaaagctttataagccagaggtgcagctccggaggccaaactggtccaagcttgtggctgaggacctctcccaggactgcttctggacaaaggtgaaggaggaccgctttgagaacaatgaacttttcgccaaacttacccttaccttctctgcccagaccaagaccaagaaggatcaagaaggtggagaagaaaagaaatctgtgcaaaagaaaaaagtaaaagagttaaaggtgttggattcaaagacagcccagaatctctcaatctttttgggttccttccgcatgccctatcaagagattaagaatgtcatcctggaggtgaatgaggctgttctgactgagtctatgatccagaacctcattaagcaaatgccagagccagagcagttaaaaatgctttctgaactgaaggatgaatatgatgacctggctgagtcagagcagtttggcgtggtgatgggcactgtgccccgactgcggcctcgcctcaatgccattctcttcaagctacaattcagcgagcaagtggagaatatcaagccagagattgtgtctgtcactgctgcatgtgaggagttacgtaagagtgagagcttttccaatctcctagagattaccttgcttgttggaaattacatgaatgctggctccagaaatgctggtgcttttggcttcaatatcagcttcctctgtaagcttcgagacaccaagtccacagatcagaagatgacgttgttacacttcttggctgagttgtgtgagaatgactatcccgatgtcctcaagtttccagacgagcttgcccatgtggagaaagccagccgagtttctgctgaaaacttgcaaaagaacctagatcagatgaagaaacaaatttctgatgtggaacgtgatgttcagaatttcccagctgccacagatgaaaaagacaagtttgttgaaaaaatgaccagctttgtgaaggatgcacaggaacagtataacaagctgcggatgatgcattctaacatggagaccctctataaggagctgggcgagtacttcctctttgaccccaagaagttgtctgttgaagaatttttcatggatcttcacaattttcggaatatgtttttgcaagcagtcaaggagaaccagaagcggcgggagacagaagaaaagatgaggcgagcaaaactagccaaggagaaggcagagaaggagcggctagagaagcagcagaagagagagcaactcatagacatgaatgcagagggcgatgagacaggtgtgatggacagtcttctagaagccctgcagtcaggggcagcattccgacggaagagagggccccgtcaagccaacaggaaggccgggtgtgcagtcacatctctgctagcttcggagctgaccaaggatgatgccatggctgctgttcctgccaaggtgtccaagaacagtgagacattccccacaatccttgaggaagccaaggagttggttggccgtgcaagctaatgtgggtcctgtgaccgcggcagctcctcagcggagccgcagactgtcctgccctgcagcatgtgcctaaaggctcaaggggatattcctctggggtggccactcccaccaccctgaccctgtctttctctctggcctgctgctctctcaacatcacatacagcttcagctgcctggaggccagaaggaaagggcagtgcaggggaggcctgagcccgacttagccagccctggctgttgtattaccaaagcagggtccatgtttgctgccttaaccctgtctcctctctgttactcagagggcctcatctcagacaaggcccagcctgctttttctcagccctgactttctaatgggctttcccccctaggtcagtcttgctggatttgtgcttttcttttgtggtttctctggccctgagaatagcatggggcttgtaaacctttgggctagatccctcctttcattgctgttgtctctgctcttccctctcctggctgtggttatttattattagtggtgtggcactgggagctgctcctaaggaagcagggagcaaatcccacctttaccccaccttcctgggaaaggcctccaaagcaaaggatctggaccagtttccctgctgtgctgtggcccaggccagagcctgtgggcaggcaggcagggcatagcgacagtgtgggacctgcccccagcttctgccacgctttatgcccttgcctctctggacgctctgcaccaaccccaggctactgagccaccttccctcctcatgccttccctgagctttggtgcatctcatctggactatgggttgtactgtgaccatcccaacacctcaccctctgtctacaaggaaatgggaggtggagcctcctggctgagaaattgttttgcaaatggatctatttttgtatgaaaaaaaaaatttttttaaagaaaactgttccttccccctttcccctccataatgtaagaagctttggtggcaggttacagagttctgggatttcttctcacaggcccaatcctgaatgtgcccctggaccttctggacccttgagtccaaggcagatcctctctcccagggaatccgacacaggaggaaccccttctctggttgagctgggccaggcctaagagtagcaggaactctaagaccacagagttttttataaatgtataaatgtatcaagccaaatgtgcagatgctaactggacattctggggaactgggcaccaggagtgccttcatacactgtaccccagctctcttctaaaagagaagtgggtgggcacactgaactgtttggtggccccaaccacaggaagctgcaattctctggcttagggtgatacttttgccctccttgtgcccctctcagctttccatccccagctaggaagaaagaatggcactcttgggcttggcccagaattagagttattagagcaagagagagcttaggaagcatgagggcaactatagtgaggccttattgccaggagggagggttttggttgctggcgcttgtgtataaaggggcaagagcagctcctttggactattcctgggaggactctgatgcagggcgtctgttgctcccctgggtcacctcctccctgctcgctgacatctggggctttgaccctttcttttttaatctacttttgctaagatgcatttaataaaaaaaaagagagagagagagaggtgtgagggacaaaatgcaaacctatttcccttgcctcataggcttctgggatgtcatcacctccagtttgttggttttgtttccaactgttaataaagcattgaaacagtactgcc

SEQ ID NO: 1381 - DNA, 5762 bp, Homo sapiens
attcatgaggcgcgcgcagcccggcatgctaatgaggcggggcgcggcggctggctaaagagcgactgggcggcggcgggcgcggagctgccaggcgggagcggcgtaggcgcggggtcgccggccagcgtgaaccgggacatggagccgcccggcgggagcctggggcccggccgcgggacccgggacaagaagaagggccggagcccagatgagctgccctcggcgggcggcgacggcggcaaatctaagaaatttctggagagatttaccagcatgagaattaagaaggagaaggaaaagcccaattctgctcatagaaattcttctgcatcatatggggatgatcccacagcacagtcattgcaagatgtttcagatgaacaagtgctggttctctttgaacagatgctgctggatatgaacctgaatgaggagaaacagcaacctttgagggagaaggacatcatcatcaagagggagatggtgtcccaatacttgtacacctccaaggctggcatgagccagaaggagagctctaagtctgccatgatgtatattcaggagttgaggtcaggcttgcgggatatgcctctgctcagctgcctggagtcccttcgtgtgtctctcaacaacaaccctgtcagttgggtgcaaacatttggtgctgaaggcttggcctccttattggacattcttaaacgacttcatgatgagaaagaagagactgctgggagttacgatagccggaacaagcatgagatcattcgctgcttgaaagcttttatgaacaacaagtttggaatcaagaccatgttggagacagaagaaggaatcctactgctggtcagagccatggatcctgctgttcccaacatgatgattgatgcagctaagctgctttctgctctttgtattctaccgcagccagaggacatgaatgaaagggttttggaggcaatgacagaaagagctgagatggatgaagtggaacgtttccagccgctgctggatggattaaaaagtggaaccactattgcactgaaggttggatgcctacagctgatcaatgctctcatcacaccagcggaggaacttgacttccgagttcacatcagaagtgaactgatgcgtttggggctacatcaggtgttgcaggaccttcgagagattgaaaatgaagatatgagagtgcaactaaatgtgtttgatgaacaaggggaagaggattcctatgacctgaagggacggctggatgacattcgcatggagatggatgactttaatgaagtctttcagattctcttaaacacagtgaaggattcaaaggcagagccacacttcctttccatcctgcagcacttactcttggtccgaaatgactatgaggccagacctcagtactataagttgattgaagaatgtatttcccagatagttctgcacaagaacggggctgatcctgacttcaagtgccggcacctccagattgagattgagggattaattgatcaaatgattgataagacaaaggtggagaaatctgaagccaaagctgcagagctggaaaagaagttggactcagagttaacagcccgacatgagctacaggtggaaatgaaaaagatggaaagtgactttgagcagaagcttcaagatcttcagggagaaaaagatgcactgcattctgaaaagcagcaaattgccacagagaaacaggacctggaagcagaggtgtcccagctcacaggagaggttgccaagctgacaaaggaactggaagatgccaagaaagaaatggcttccctctctgcggcagctattactgtacctccttctgttcctagtcgtgctcctgttccccctgcccctcctttacctggtgactctggcactattattccaccaccacctgctcctggggatagtaccactcctcctcctcctcctcctcctcctcctcctccacctcctttgcctgggggtgtttgcatctcctcacccccttctttacctggaggtactgctatctctccaccccctcctttgtctggggatgctaccatccctccaccccctcctttgcctgagggtgttggcatcccttcaccctcttctttgcctggaggtactgccatccccccacctcctcctttgcctgggagtgctagaatccccccaccaccacctcctttgcctgggagtgctggaattccccccccacctcctcccttgcctggagaagcaggaatgccacctcctcctccccctcttcctggtggtcctggaatccctccacctcctccatttcccggaggccctggcattcctccacctccacccggaatgggtatgcctccacctcccccatttggatttggagttcctgcagccccagttctgccatttggattaacccccaaaaagctttataagccagaggtgcagctccggaggccaaactggtccaagcttgtggctgaggacctctcccaggactgcttctggacaaaggtgaaggaggaccgctttgagaacaatgaacttttcgccaaacttacccttaccttctctgcccagaccaagacttccaaagccaagaaggatcaagaaggtggagaagaaaagaaatctgtgcaaaagaaaaaagtaaaagagttaaaggtgttggattcaaagacagcccagaatctctcaatctttttgggttccttccgcatgccctatcaagagattaagaatgtcatcctggaggtgaatgaggctgttctgactgagtctatgatccagaacctcattaagcaaatgccagagccagagcagttaaaaatgctttctgaactgaaggatgaatatgatgacctggctgagtcagagcagtttggcgtggtgatgggcactgtgccccgactgcggcctcgcctcaatgccattctcttcaagctacaattcagcgagcaagtggagaatatcaagccagagattgtgtctgtcactgctgcatgtgaggagttacgtaagagtgagagcttttccaatctcctagagattaccttgcttgttggaaattacatgaatgctggctccagaaatgctggtgcttttggcttcaatatcagcttcctctgtaagcttcgagacaccaagtccacagatcagaagatgacgttgttacacttcttggctgagttgtgtgagaatgactatcccgatgtcctcaagtttccagacgagcttgcccatgtggagaaagccagccgagtttctgctgaaaacttgcaaaagaacctagatcagatgaagaaacaaatttctgatgtggaacgtgatgttcagaatttcccagctgccacagatgaaaaagacaagtttgttgaaaaaatgaccagctttgtgaaggatgcacaggaacagtataacaagctgcggatgatgcattctaacatggagaccctctataaggagctgggcgagtacttcctctttgaccccaagaagttgtctgttgaagaatttttcatggatcttcacaattttcggaatatgtttttgcaagcagtcaaggagaaccagaagcggcgggagacagaagaaaagatgaggcgagcaaaactagccaaggagaaggcagagaaggagcggctagagaagcagcagaagagagagcaactcatagacatgaatgcagagggcgatgagacaggtgtgatggacagtcttctagaagccctgcagtcaggggcagcattccgacggaagagagggccccgtcaagccaacaggaaggccgggtgtgcagtcacatctctgctagcttcggagctgaccaaggatgatgccatggctgctgttcctgccaaggtgtccaagaacagtgagacattccccacaatccttgaggaagccaaggagttggttggccgtgcaagctaatgtgggtcctgtgaccgcggcagctcctcagcggagccgcagactgtcctgccctgcagcatgtgcctaaaggctcaaggggatattcctctggggtggccactcccaccaccctgaccctgtctttctctctggcctgctgctctctcaacatcacatacagcttcagctgcctggaggccagaaggaaagggcagtgcaggggaggcctgagcccgacttagccagccctggctgttgtattaccaaagcagggtccatgtttgctgccttaaccctgtctcctctctgttactcagagggcctcatctcagacaaggcccagcctgctttttctcagccctgactttctaatgggctttcccccctaggtcagtcttgctggatttgtgcttttcttttgtggtttctctggccctgagaatagcatggggcttgtaaacctttgggctagatccctcctttcattgctgttgtctctgctcttccctctcctggctgtggttatttattattagtggtgtggcactgggagctgctcctaaggaagcagggagcaaatcccacctttaccccaccttcctgggaaaggcctccaaagcaaaggatctggaccagtttccctgctgtgctgtggcccaggccagagcctgtgggcaggcaggcagggcatagcgacagtgtgggacctgcccccagcttctgccacgctttatgcccttgcctctctggacgctctgcaccaaccccaggctactgagccaccttccctcctcatgccttccctgagctttggtgcatctcatctggactatgggttgtactgtgaccatcccaacacctcaccctctgtctacaaggaaatgggaggtggagcctcctggctgagaaattgttttgcaaatggatctatttttgtatgaaaaaaaaaatttttttaaagaaaactgttccttccccctttcccctccataatgtaagaagctttggtggcaggttacagagttctgggatttcttctcacaggcccaatcctgaatgtgcccctggaccttctggacccttgagtccaaggcagatcctctctcccagggaatccgacacaggaggaaccccttctctggttgagctgggccaggcctaagagtagcaggaactctaagaccacagagttttttataaatgtataaatgtatcaagccaaatgtgcagatgctaactggacattctggggaactgggcaccaggagtgccttcatacactgtaccccagctctcttctaaaagagaagtgggtgggcacactgaactgtttggtggccccaaccacaggaagctgcaattctctggcttagggtgatacttttgccctccttgtgcccctctcagctttccatccccagctaggaagaaagaatggcactcttgggcttggcccagaattagagttattagagcaagagagagcttaggaagcatgagggcaactatagtgaggccttattgccaggagggagggttttggttgctggcgcttgtgtataaaggggcaagagcagctcctttggactattcctgggaggactctgatgcagggcgtctgttgctcccctgggtcacctcctccctgctcgctgacatctggggctttgaccctttcttttttaatctacttttgctaagatgcatttaataaaaaaaaagagagagagagagaggtgtgagggacaaaatgcaaacctatttcccttgcctcataggcttctgggatgtcatcacctccagtttgttggttttgtttccaactgttaataaagcattgaaacagt

SEQ ID NO: 1382 - DNA, 5789 bp, Homo sapiens
attcatgaggcgcgcgcagcccggcatgctaatgaggcggggcgcggcggctggctaaagagcgactgggcggcggcgggcgcggagctgccaggcgggagcggcgtaggcgcggggtcgccggccagcgtgaaccgggacatggagccgcccggcgggagcctggggcccggccgcgggacccgggacaagaagaagggccggagcccagatgagctgccctcggcgggcggcgacggcggcaaatctaagaaatttactctgaagcggctcatggcagatgagctggagagatttaccagcatgagaattaagaaggagaaggaaaagcccaattctgctcatagaaattcttctgcatcatatggggatgatcccacagcacagtcattgcaagatgtttcagatgaacaagtgctggttctctttgaacagatgctgctggatatgaacctgaatgaggagaaacagcaacctttgagggagaaggacatcatcatcaagagggagatggtgtcccaatacttgtacacctccaaggctggcatgagccagaaggagagctctaagtctgccatgatgtatattcaggagttgaggtcaggcttgcgggatatgcctctgctcagctgcctggagtcccttcgtgtgtctctcaacaacaaccctgtcagttgggtgcaaacatttggtgctgaaggcttggcctccttattggacattcttaaacgacttcatgatgagaaagaagagactgctgggagttacgatagccggaacaagcatgagatcattcgctgcttgaaagcttttatgaacaacaagtttggaatcaagaccatgttggagacagaagaaggaatcctactgctggtcagagccatggatcctgctgttcccaacatgatgattgatgcagctaagctgctttctgctctttgtattctaccgcagccagaggacatgaatgaaagggttttggaggcaatgacagaaagagctgagatggatgaagtggaacgtttccagccgctgctggatggattaaaaagtggaaccactattgcactgaaggttggatgcctacagctgatcaatgctctcatcacaccagcggaggaacttgacttccgagttcacatcagaagtgaactgatgcgtttggggctacatcaggtgttgcaggaccttcgagagattgaaaatgaagatatgagagtgcaactaaatgtgtttgatgaacaaggggaagaggattcctatgacctgaagggacggctggatgacattcgcatggagatggatgactttaatgaagtctttcagattctcttaaacacagtgaaggattcaaaggcagagccacacttcctttccatcctgcagcacttactcttggtccgaaatgactatgaggccagacctcagtactataagttgattgaagaatgtatttcccagatagttctgcacaagaacggggctgatcctgacttcaagtgccggcacctccagattgagattgagggattaattgatcaaatgattgataagacaaaggtggagaaatctgaagccaaagctgcagagctggaaaagaagttggactcagagttaacagcccgacatgagctacaggtggaaatgaaaaagatggaaagtgactttgagcagaagcttcaagatcttcagggagaaaaagatgcactgcattctgaaaagcagcaaattgccacagagaaacaggacctggaagcagaggtgtcccagctcacaggagaggttgccaagctgacaaaggaactggaagatgccaagaaagaaatggcttccctctctgcggcagctattactgtacctccttctgttcctagtcgtgctcctgttccccctgcccctcctttacctggtgactctggcactattattccaccaccacctgctcctggggatagtaccactcctcctcctcctcctcctcctcctcctcctccacctcctttgcctgggggtgtttgcatctcctcacccccttctttacctggaggtactgctatctctccaccccctcctttgtctggggatgctaccatccctccaccccctcctttgcctgagggtgttggcatcccttcaccctcttctttgcctggaggtactgccatccccccacctcctcctttgcctgggagtgctagaatccccccaccaccacctcctttgcctgggagtgctggaattccccccccacctcctcccttgcctggagaagcaggaatgccacctcctcctccccctcttcctggtggtcctggaatccctccacctcctccatttcccggaggccctggcattcctccacctccacccggaatgggtatgcctccacctcccccatttggatttggagttcctgcagccccagttctgccatttggattaacccccaaaaagctttataagccagaggtgcagctccggaggccaaactggtccaagcttgtggctgaggacctctcccaggactgcttctggacaaaggtgaaggaggaccgctttgagaacaatgaacttttcgccaaacttacccttaccttctctgcccagaccaagacttccaaagccaagaaggatcaagaaggtggagaagaaaagaaatctgtgcaaaagaaaaaagtaaaagagttaaaggtgttggattcaaagacagcccagaatctctcaatctttttgggttccttccgcatgccctatcaagagattaagaatgtcatcctggaggtgaatgaggctgttctgactgagtctatgatccagaacctcattaagcaaatgccagagccagagcagttaaaaatgctttctgaactgaaggatgaatatgatgacctggctgagtcagagcagtttggcgtggtgatgggcactgtgccccgactgcggcctcgcctcaatgccattctcttcaagctacaattcagcgagcaagtggagaatatcaagccagagattgtgtctgtcactgctgcatgtgaggagttacgtaagagtgagagcttttccaatctcctagagattaccttgcttgttggaaattacatgaatgctggctccagaaatgctggtgcttttggcttcaatatcagcttcctctgtaagcttcgagacaccaagtccacagatcagaagatgacgttgttacacttcttggctgagttgtgtgagaatgactatcccgatgtcctcaagtttccagacgagcttgcccatgtggagaaagccagccgagtttctgctgaaaacttgcaaaagaacctagatcagatgaagaaacaaatttctgatgtggaacgtgatgttcagaatttcccagctgccacagatgaaaaagacaagtttgttgaaaaaatgaccagctttgtgaaggatgcacaggaacagtataacaagctgcggatgatgcattctaacatggagaccctctataaggagctgggcgagtacttcctctttgaccccaagaagttgtctgttgaagaatttttcatggatcttcacaattttcggaatatgtttttgcaagcagtcaaggagaaccagaagcggcgggagacagaagaaaagatgaggcgagcaaaactagccaaggagaaggcagagaaggagcggctagagaagcagcagaagagagagcaactcatagacatgaatgcagagggcgatgagacaggtgtgatggacagtcttctagaagccctgcagtcaggggcagcattccgacggaagagagggccccgtcaagccaacaggaaggccgggtgtgcagtcacatctctgctagcttcggagctgaccaaggatgatgccatggctgctgttcctgccaaggtgtccaagaacagtgagacattccccacaatccttgaggaagccaaggagttggttggccgtgcaagctaatgtgggtcctgtgaccgcggcagctcctcagcggagccgcagactgtcctgccctgcagcatgtgcctaaaggctcaaggggatattcctctggggtggccactcccaccaccctgaccctgtctttctctctggcctgctgctctctcaacatcacatacagcttcagctgcctggaggccagaaggaaagggcagtgcaggggaggcctgagcccgacttagccagccctggctgttgtattaccaaagcagggtccatgtttgctgccttaaccctgtctcctctctgttactcagagggcctcatctcagacaaggcccagcctgctttttctcagccctgactttctaatgggctttcccccctaggtcagtcttgctggatttgtgcttttcttttgtggtttctctggccctgagaatagcatggggcttgtaaacctttgggctagatccctcctttcattgctgttgtctctgctcttccctctcctggctgtggttatttattattagtggtgtggcactgggagctgctcctaaggaagcagggagcaaatcccacctttaccccaccttcctgggaaaggcctccaaagcaaaggatctggaccagtttccctgctgtgctgtggcccaggccagagcctgtgggcaggcaggcagggcatagcgacagtgtgggacctgcccccagcttctgccacgctttatgcccttgcctctctggacgctctgcaccaaccccaggctactgagccaccttccctcctcatgccttccctgagctttggtgcatctcatctggactatgggttgtactgtgaccatcccaacacctcaccctctgtctacaaggaaatgggaggtggagcctcctggctgagaaattgttttgcaaatggatctatttttgtatgaaaaaaaaaatttttttaaagaaaactgttccttccccctttcccctccataatgtaagaagctttggtggcaggttacagagttctgggatttcttctcacaggcccaatcctgaatgtgcccctggaccttctggacccttgagtccaaggcagatcctctctcccagggaatccgacacaggaggaaccccttctctggttgagctgggccaggcctaagagtagcaggaactctaagaccacagagttttttataaatgtataaatgtatcaagccaaatgtgcagatgctaactggacattctggggaactgggcaccaggagtgccttcatacactgtaccccagctctcttctaaaagagaagtgggtgggcacactgaactgtttggtggccccaaccacaggaagctgcaattctctggcttagggtgatacttttgccctccttgtgcccctctcagctttccatccccagctaggaagaaagaatggcactcttgggcttggcccagaattagagttattagagcaagagagagcttaggaagcatgagggcaactatagtgaggccttattgccaggagggagggttttggttgctggcgcttgtgtataaaggggcaagagcagctcctttggactattcctgggaggactctgatgcagggcgtctgttgctcccctgggtcacctcctccctgctcgctgacatctggggctttgaccctttcttttttaatctacttttgctaagatgcatttaataaaaaaaaagagagagagagagaggtgtgagggacaaaatgcaaacctatttcccttgcctcataggcttctgggatgtcatcacctccagtttgttggttttgtttccaactgttaataaagcattgaaacagt

SEQ ID NO: 1383 - DNA, 5717 bp, Homo sapiens
attcatgaggcgcgcgcagcccggcatgctaatgaggcggggcgcggcggctggctaaagagcgactgggcggcggcgggcgcggagctgccaggcgggagcggcgtaggcgcggggtcgccggccagcgtgaaccgggacatggagccgcccggcgggagcctggggcccggccgcgggacccgggacaagaagaagggccggagcccagatgagctgccctcggcgggcggcgacggcggcaaatctaagaaatttctggagagatttaccagcatgagaattaagaaggagaaggaaaagcccaattctgctcatagaaattcttctgcatcatatggggatgatcccacagcacagtcattgcaagatgtttcagatgaacaagtgctggttctctttgaacagatgctgctggatatgaacctgaatgaggagaaacagcaacctttgagggagaaggacatcatcatcaagagggagatggtgtcccaatacttgtacacctccaaggctggcatgagccagaaggagagctctaagtctgccatgatgtatattcaggagttgaggtcaggcttgcgggatatgcctctgctcagctgcctggagtcccttcgtgtgtctctcaacaacaaccctgtcagttgggtgcaaacatttggtgctgaaggcttggcctccttattggacattcttaaacgacttcatgatgagaaagaagagactgctgggagttacgatagccggaacaagcatgagatcattcgctgcttgaaagcttttatgaacaacaagtttggaatcaagaccatgttggagacagaagaaggaatcctactgctggtcagagccatggatcctgctgttcccaacatgatgattgatgcagctaagctgctttctgctctttgtattctaccgcagccagaggacatgaatgaaagggttttggaggcaatgacagaaagagctgagatggatgaagtggaacgtttccagccgctgctggatggattaaaaagtggaaccactattgcactgaaggttggatgcctacagctgatcaatgctctcatcacaccagcggaggaacttgacttccgagttcacatcagaagtgaactgatgcgtttggggctacatcaggtgttgcaggaccttcgagagattgaaaatgaagatatgagagtgcaactaaatgtgtttgatgaacaaggggaagaggattcctatgacctgaagggacggctggatgacattcgcatggagatggatgactttaatgaagtctttcagattctcttaaacacagtgaaggattcaaaggcagagccacacttcctttccatcctgcagcacttactcttggtccgaaatgactatgaggccagacctcagtactataagttgattgaagaatgtatttcccagatagttctgcacaagaacggggctgatcctgacttcaagtgccggcacctccagattgagattgagggattaattgatcaaatgattgataagacaaaggtggagaaatctgaagccaaagctgcagagctggaaaagaagttggactcagagttaacagcccgacatgagctacaggtggaaatgaaaaagatggaaagtgactttgagcagaagcttcaagatcttcagggagaaaaagatgcactgcattctgaaaagcagcaaattgccacagagaaacaggacctggaagcagaggtgtcccagctcacaggagaggttgccaagctgacaaaggaactggaagatgccaagaaagaaatggcttccctctctgcggcagctattactgtacctccttctgttcctagtcgtgctcctgttccccctgcccctcctttacctggtgactctggcactattattccaccaccacctgctcctggggatagtaccactcctcctcctcctcctcctcctcctcctcctccacctcctttgcctgggggtactgctatctctccaccccctcctttgtctggggatgctaccatccctccaccccctcctttgcctgagggtgttggcatcccttcaccctcttctttgcctggaggtactgccatccccccacctcctcctttgcctgggagtgctagaatccccccaccaccacctcctttgcctgggagtgctggaattccccccccacctcctcccttgcctggagaagcaggaatgccacctcctcctccccctcttcctggtggtcctggaatccctccacctcctccatttcccggaggccctggcattcctccacctccacccggaatgggtatgcctccacctcccccatttggatttggagttcctgcagccccagttctgccatttggattaacccccaaaaagctttataagccagaggtgcagctccggaggccaaactggtccaagcttgtggctgaggacctctcccaggactgcttctggacaaaggtgaaggaggaccgctttgagaacaatgaacttttcgccaaacttacccttaccttctctgcccagaccaagaccaagaaggatcaagaaggtggagaagaaaagaaatctgtgcaaaagaaaaaagtaaaagagttaaaggtgttggattcaaagacagcccagaatctctcaatctttttgggttccttccgcatgccctatcaagagattaagaatgtcatcctggaggtgaatgaggctgttctgactgagtctatgatccagaacctcattaagcaaatgccagagccagagcagttaaaaatgctttctgaactgaaggatgaatatgatgacctggctgagtcagagcagtttggcgtggtgatgggcactgtgccccgactgcggcctcgcctcaatgccattctcttcaagctacaattcagcgagcaagtggagaatatcaagccagagattgtgtctgtcactgctgcatgtgaggagttacgtaagagtgagagcttttccaatctcctagagattaccttgcttgttggaaattacatgaatgctggctccagaaatgctggtgcttttggcttcaatatcagcttcctctgtaagcttcgagacaccaagtccacagatcagaagatgacgttgttacacttcttggctgagttgtgtgagaatgactatcccgatgtcctcaagtttccagacgagcttgcccatgtggagaaagccagccgagtttctgctgaaaacttgcaaaagaacctagatcagatgaagaaacaaatttctgatgtggaacgtgatgttcagaatttcccagctgccacagatgaaaaagacaagtttgttgaaaaaatgaccatctttgtgaaggatgcacaggaacagtataacaagctgcggatgatgcattctaacatggagaccctctataaggagctgggcgagtacttcctctttgaccccaagaagttgtctgttgaagaatttttcatggatcttcacaattttcggaatatgtttttgcaagcagtcaaggagaaccagaagcggcgggagacagaagaaaagatgaggcgagcaaaactagccaaggagaaggcagagaaggagcggctagagaagcagcagaagagagagcaactcatagacatgaatgcagagggcgatgagacaggtgtgatggacagtcttctagaagccctgcagtcaggggcagcattccgacggaagagagggccccgtcaagccaacaggaaggccgggtgtgcagtcacatctctgctagcttcggagctgaccaaggatgatgccatggctgctgttcctgccaaggtgtccaagaacagtgagacattccccacaatccttgaggaagccaaggagttggttggccgtgcaagctaatgtgggtcctgtgaccgcggcagctcctcagcggagccgcagactgtcctgccctgcagcatgtgcctaaaggctcaaggggatattcctctggggtggccactcccaccaccctgaccctgtctttctctctggcctgctgctctctcaacatcacatacagcttcagctgcctggaggccagaaggaaagggcagtgcaggggaggcctgagcccgacttagccagccctggctgttgtattaccaaagcagggtccatgtttgctgccttaaccctgtctcctctctgttactcagagggcctcatctcagacaaggcccagcctgctttttctcagccctgactttctaatgggctttcccccctaggtcagtcttgctggatttgtgcttttcttttgtggtttctctggccctgagaatagcatggggcttgtaaacctttgggctagatccctcctttcattgctgttgtctctgctcttccctctcctggctgtggttatttattattagtggtgtggcactgggagctgctcctaaggaagcagggagcaaatcccacctttaccccaccttcctgggaaaggcctccaaagcaaaggatctggaccagtttccctgctgtgctgtggcccaggccagagcctgtgggcaggcaggcagggcatagcgacagtgtgggacctgcccccagcttctgccacgctttatgcccttgcctctctggacgctctgcaccaaccccaggctactgagccaccttccctcctcatgccttccctgagctttggtgcatctcatctggactatgggttgtactgtgaccatcccaacacctcaccctctgtctacaaggaaatgggaggtggagcctcctggctgagaaattgttttgcaaatggatctatttttgtatgaaaaaaaaaatttttttaaagaaaactgttccttccccctttcccctccataatgtaagaagctttggtggcaggttacagagttctgggatttcttctcacaggcccaatcctgaatgtgcccctggaccttctggacccttgagtccaaggcagatcctctctcccagggaatccgacacaggaggaaccccttctctggttgagctgggccaggcctaagagtagcaggaactctaagaccacagagttttttataaatgtataaatgtatcaagccaaatgtgcagatgctaactggacattctggggaactgggcaccaggagtgccttcatacactgtaccccagctctcttctaaaagagaagtgggtgggcacactgaactgtttggtggccccaaccacaggaagctgcaattctctggcttagggtgatacttttgccctccttgtgcccctctcagctttccatccccagctaggaagaaagaatggcactcttgggcttggcccagaattagagttattagagcaagagagagcttaggaagcatgagggcaactatagtgaggccttattgccaggagggagggttttggttgctggcgcttgtgtataaaggggcaagagcagctcctttggactattcctgggaggactctgatgcagggcgtctgttgctcccctgggtcacctcctccctgctcgctgacatctggggctttgaccctttcttttttaatctacttttgctaagatgcatttaataaaaaaaaagagagagagagagaggtgtgagggacaaaatgcaaacctatttcccttgcctcataggcttctgggatgtcatcacctccagtttgttggttttgtttccaactgttaataaagcattgaaacagt

SEQ ID NO: 1384 - DNA, 5765 bp, Homo sapiens
attcatgaggcgcgcgcagcccggcatgctaatgaggcggggcgcggcggctggctaaagagcgactgggcggcggcgggcgcggagctgccaggcgggagcggcgtaggcgcggggtcgccggccagcgtgaaccgggacatggagccgcccggcgggagcctggggcccggccgcgggacccgggacaagaagaagggccggagcccagatgagctgccctcggcgggcggcgacggcggcaaatctaagaaatttctggagagatttaccagcatgagaattaagaaggagaaggaaaagcccaattctgctcatagaaattcttctgcatcatatggggatgatcccacagcacagtcattgcaagatgtttcagatgaacaagtgctggttctctttgaacagatgctgctggatatgaacctgaatgaggagaaacagcaacctttgagggagaaggacatcatcatcaagagggagatggtgtcccaatacttgtacacctccaaggctggcatgagccagaaggagagctctaagtctgccatgatgtatattcaggagttgaggtcaggcttgcgggatatgcctctgctcagctgcctggagtcccttcgtgtgtctctcaacaacaaccctgtcagttgggtgcaaacatttggtgctgaaggcttggcctccttattggacattcttaaacgacttcatgatgagaaagaagagactgctgggagttacgatagccggaacaagcatgagatcattcgctgcttgaaagcttttatgaacaacaagtttggaatcaagaccatgttggagacagaagaaggaatcctactgctggtcagagccatggatcctgctgttcccaacatgatgattgatgcagctaagctgctttctgctctttgtattctaccgcagccagaggacatgaatgaaagggttttggaggcaatgacagaaagagctgagatggatgaagtggaacgtttccagccgctgctggatggattaaaaagtggaaccactattgcactgaaggttggatgcctacagctgatcaatgctctcatcacaccagcggaggaacttgacttccgagttcacatcagaagtgaactgatgcgtttggggctacatcaggtgttgcaggaccttcgagagattgaaaatgaagatatgagagtgcaactaaatgtgtttgatgaacaaggggaagaggattcctatgacctgaagggacggctggatgacattcgcatggagatggatgactttaatgaagtctttcagattctcttaaacacagtgaaggattcaaaggcagagccacacttcctttccatcctgcagcacttactcttggtccgaaatgactatgaggccagacctcagtactataagttgattgaagaatgtatttcccagatagttctgcacaagaacggggctgatcctgacttcaagtgccggcacctccagattgagattgagggattaattgatcaaatgattgataagacaaaggtggagaaatctgaagccaaagctgcagagctggaaaagaagttggactcagagttaacagcccgacatgagctacaggtggaaatgaaaaagatggaaagtgactttgagcagaagcttcaagatcttcagggagaaaaagatgcactgcattctgaaaagcagcaaattgccacagagaaacaggacctggaagcagaggtgtcccagctcacaggagaggttgccaagctgacaaaggaactggaagatgccaagaaagaaatggcttccctctctgcggcagctattactgtacctccttctgttcctagtcgtgctcctgttccccctgcccctcctttacctggtgactctggcactattattccaccaccacctgctcctggggatagtaccactcctcctcctcctcctcctcctcctcctcctccacctcctttgcctgggggtgtttgcatctcctcacccccttctttacctggaggtactgctatctctccaccccctcctttgtctggggatgctaccatccctccaccccctcctttgcctgagggtgttggcatcccttcaccctcttctttgcctggaggtactgccatccccccacctcctcctttgcctgggagtgctagaatccccccaccaccacctcctttgcctgggagtgctggaattccccccccacctcctcccttgcctggagaagcaggaatgccacctcctcctccccctcttcctggtggtcctggaatccctccacctcctccatttcccggaggccctggcattcctccacctccacccggaatgggtatgcctccacctcccccatttggatttggagttcctgcagccccagttctgccatttggattaacccccaaaaagctttataagccagaggtgcagctccggaggccaaactggtccaagcttgtggctgaggacctctcccaggactgcttctggacaaaggtgaaggaggaccgctttgagaacaatgaacttttcgccaaacttacccttaccttctctgcccagaccaagagaacaaagaaggccaagaaggatcaagaaggtggagaagaaaagaaatctgtgcaaaagaaaaaagtaaaagagttaaaggtgttggattcaaagacagcccagaatctctcaatctttttgggttccttccgcatgccctatcaagagattaagaatgtcatcctggaggtgaatgaggctgttctgactgagtctatgatccagaacctcattaagcaaatgccagagccagagcagttaaaaatgctttctgaactgaaggatgaatatgatgacctggctgagtcagagcagtttggcgtggtgatgggcactgtgccccgactgcggcctcgcctcaatgccattctcttcaagctacaattcagcgagcaagtggagaatatcaagccagagattgtgtctgtcactgctgcatgtgaggagttacgtaagagtgagagcttttccaatctcctagagattaccttgcttgttggaaattacatgaatgctggctccagaaatgctggtgcttttggcttcaatatcagcttcctctgtaagcttcgagacaccaagtccacagatcagaagatgacgttgttacacttcttggctgagttgtgtgagaatgactatcccgatgtcctcaagtttccagacgagcttgcccatgtggagaaagccagccgagtttctgctgaaaacttgcaaaagaacctagatcagatgaagaaacaaatttctgatgtggaacgtgatgttcagaatttcccagctgccacagatgaaaaagacaagtttgttgaaaaaatgaccatctttgtgaaggatgcacaggaacagtataacaagctgcggatgatgcattctaacatggagaccctctataaggagctgggcgagtacttcctctttgaccccaagaagttgtctgttgaagaatttttcatggatcttcacaattttcggaatatgtttttgcaagcagtcaaggagaaccagaagcggcgggagacagaagaaaagatgaggcgagcaaaactagccaaggagaaggcagagaaggagcggctagagaagcagcagaagagagagcaactcatagacatgaatgcagagggcgatgagacaggtgtgatggacagtcttctagaagccctgcagtcaggggcagcattccgacggaagagagggccccgtcaagccaacaggaaggccgggtgtgcagtcacatctctgctagcttcggagctgaccaaggatgatgccatggctgctgttcctgccaaggtgtccaagaacagtgagacattccccacaatccttgaggaagccaaggagttggttggccgtgcaagctaatgtgggtcctgtgaccgcggcagctcctcagcggagccgcagactgtcctgccctgcagcatgtgcctaaaggctcaaggggatattcctctggggtggccactcccaccaccctgaccctgtctttctctctggcctgctgctctctcaacatcacatacagcttcagctgcctggaggccagaaggaaagggcagtgcaggggaggcctgagcccgacttagccagccctggctgttgtattaccaaagcagggtccatgtttgctgccttaaccctgtctcctctctgttactcagagggcctcatctcagacaaggcccagcctgctttttctcagccctgactttctaatgggctttcccccctaggtcagtcttgctggatttgtgcttttcttttgtggtttctctggccctgagaatagcatggggcttgtaaacctttgggctagatccctcctttcattgctgttgtctctgctcttccctctcctggctgtggttatttattattagtggtgtggcactgggagctgctcctaaggaagcagggagcaaatcccacctttaccccaccttcctgggaaaggcctccaaagcaaaggatctggaccagtttccctgctgtgctgtggcccaggccagagcctgtgggcaggcaggcagggcatagcgacagtgtgggacctgcccccagcttctgccacgctttatgcccttgcctctctggacgctctgcaccaaccccaggctactgagccaccttccctcctcatgccttccctgagctttggtgcatctcatctggactatgggttgtactgtgaccatcccaacacctcaccctctgtctacaaggaaatgggaggtggagcctcctggctgagaaattgttttgcaaatggatctatttttgtatgaaaaaaaaaatttttttaaagaaaactgttccttccccctttcccctccataatgtaagaagctttggtggcaggttacagagttctgggatttcttctcacaggcccaatcctgaatgtgcccctggaccttctggacccttgagtccaaggcagatcctctctcccagggaatccgacacaggaggaaccccttctctggttgagctgggccaggcctaagagtagcaggaactctaagaccacagagttttttataaatgtataaatgtatcaagccaaatgtgcagatgctaactggacattctggggaactgggcaccaggagtgccttcatacactgtaccccagctctcttctaaaagagaagtgggtgggcacactgaactgtttggtggccccaaccacaggaagctgcaattctctggcttagggtgatacttttgccctccttgtgcccctctcagctttccatccccagctaggaagaaagaatggcactcttgggcttggcccagaattagagttattagagcaagagagagcttaggaagcatgagggcaactatagtgaggccttattgccaggagggagggttttggttgctggcgcttgtgtataaaggggcaagagcagctcctttggactattcctgggaggactctgatgcagggcgtctgttgctcccctgggtcacctcctccctgctcgctgacatctggggctttgaccctttcttttttaatctacttttgctaagatgcatttaataaaaaaaaagagagagagagagaggtgtgagggacaaaatgcaaacctatttcccttgcctcataggcttctgggatgtcatcacctccagtttgttggttttgtttccaactgttaataaagcattgaaacagt

SEQ ID NO: 1385 - DNA, 2676 bp, Homo sapiens
attcatgaggcgcgcgcagcccggcatgctaatgaggcggggcgcggcggctggctaaagagcgactgggcggcggcgggcgcggagctgccaggcgggagcggcgtaggcgcggggtcgccggccagcgtgaaccgggacatggagccgcccggcgggagcctggggcccggccgcgggacccgggacaagaagaagggccggagcccagatgagctgccctcggcgggcggcgacggcggcaaatctaagaaatttactctgaagcggctcatggcagatgagctggagagatttaccagcatgagaattaagaaggagaaggaaaagcccaattctgctcatagaaattcttctgcatcatatggggatgatcccacagcacagtcattgcaagatgtttcagatgaacaagtgctggttctctttgaacagatgctgctggatatgaacctgaatgaggagaaacagcaacctttgagggagaaggacatcatcatcaagagggagatggtgtcccaatacttgtacacctccaaggctggcatgagccagaaggagagctctaagtctgccatgatgtatattcaggagttgaggtcaggcttgcgggatatgcctctgctcagctgcctggagtcccttcgtgtgtctctcaacaacaaccctgtcagttgggtgcaaacatttggtgctgaaggcttggcctccttattggacattcttaaacgacttcatgatgagaaagaagagactgctgggagttacgatagccggaacaagcatgagatcattcgctgcttgaaagcttttatgaacaacaagtttggaatcaagaccatgttggagacagaagaaggaatcctactgctggtcagagccatggatcctgctgttcccaacatgatgattgatgcagctaagctgctttctgctctttgtattctaccgcagccagaggacatgaatgaaagggttttggaggcaatgacagaaagagctgagatggatgaagtggaacgtttccagccgctgctggatggattaaaaagtggaaccactattgcactgaaggttggatgcctacagctgatcaatgctctcatcacaccagcggaggaacttgacttccgagttcacatcagaagtgaactgatgcgtttggggctacatcaggtgttgcaggaccttcgagagattgaaaatgaagatatgagagtgcaactaaatgtgtttgatgaacaaggggaagaggattcctatgacctgaagggacggctggatgacattcgcatggagatggatgactttaatgaagtctttcagattctcttaaacacagtgaaggattcaaaggcagagccacacttcctttccatcctgcagcacttactcttggtccgaaatgactatgaggccagacctcagtactataagttgattgaagaatgtatttcccagatagttctgcacaagaacggggctgatcctgacttcaagtgccggcacctccagattgagattgagggattaattgatcaaatgattgataagacaaaggtggagaaatctgaagccaaagctgcagagctggaaaagaagttggactcagagttaacagcccgacatgagctacaggtggaaatgaaaaagatggaaagtgactttgagcagaagcttcaagatcttcagggagaaaaagatgcactgcattctgaaaagcagcaaattgccacagagaaacaggacctggaagcagaggtgtcccagctcacaggagaggttgccaagctgacaaaggaactggaagatgccaagaaagaaatggcttccctctctgcggcagctattactgtacctccttctgttcctagtcgtgctcctgttccccctgcccctcctttacctggtgactctggcactattattccaccaccacctgctcctggggatagtaccactcctcctcctcctcctcctcctcctcctcctccacctcctttgcctgggggtgtttgcatctcctcacccccttctttacctggaggtactgctatctctccaccccctcctttgtctggggatgctaccatccctccaccccctcctttgcctgagggtgttggcatcccttcaccctcttctttgcctggaggtactgccatccccccacctcctcctttgcctgggagtgctagaatccccccaccaccacctcctttgcctgggagtgctggaattccccccccacctcctcccttgcctggagaagcaggaatgccacctcctcctccccctcttcctggtggtcctggaatccctccacctcctccatttcccggaggccctggcattcctccacctccacccggaatgggtatgcctccacctcccccatttggatttggagttcctgcagccccagttctgccatttggattaacccccaaaaagctttataagccagaggtgcagctccggaggccaaactggtccaagcttgtggctgaggacctctcccaggactgcttctggacaaaggtgaaggaggaccgctttgagaacaatgaacttttcgccaaacttacccttaccttctctgcccagaccaagagtgaaaaggccaagaaggatcaagaaggtggagaagaaaagaaatctgtgcaaaagaaaaaa

SEQ ID NO: 1386 - DNA, 1206 bp, Homo sapiens
ggcggagagggagcctggtgggcgggcggggcgcgtcttgcgggctccctcgggtaccggcgctgccgcaccccgccgcgctcccgcacccgcggcccgcccaccgcgccgctcccgcatctgcacccgcagcccggcggcctcccggcgggagcgagcagatccagtccggcccgcagcgcaactcggtccagtcggggcggcggctgcgggcgcagagcggagatgcagcggcttggggccaccctgctgtgcctgctgctggcggcggcggtccccacggcccccgcgcccgctccgacggcgacctcggctccagtcaagcccggcccggctctcagctacccgcaggaggaggccaccctcaatgagatgttccgcgaggttgaggaactgatggaggacacgcagcacaaattgcgcagcgcggtggaagagatggaggcagaagaagctgctgctaaagcatcatcagaagtgaacctggcaaacttacctcccagctatcacaatgagaccaacacagacacgaaggttggaaataataccatccatgtgcaccgagaaattcacaagataaccaacaaccagactggacaaatggtcttttcagagacagttatcacatctgtgggagacgaagaaggcagaaggagccacgagtgcatcatcgacgaggactgtgggcccagcatgtactgccagtttgccagcttccagtacacctgccagccatgccggggccagaggatgctctgcacccgggacagtgagtgctgtggagaccagctgtgtgtctggggtcactgcaccaaaatggccaccaggggcagcaatgggaccatctgtgacaaccagagggactgccagccggggctgtgctgtgccttccagagaggcctgctgttccctgtgtgcacacccctgcccgtggagggcgagctttgccatgaccccgccagccggcttctggacctcatcacctgggagctagagcctgatggagccttggaccgatgcccttgtgccagtggcctcctctgccagccccacagccacagcctggtgtatgtgtgcaagccgaccttcgtggggagccgtgaccaagatggggagatcctgctgcccagagaggtccccgatgagtatttggcagcttcatggaggaggtgcgccaggagctggaggacctggagaggagcctga

SEQ ID NO: 1387 - DNA, 2636 bp, Homo sapiens
ggcggagagggagcctggtgggcgggcggggcgcgtcttgcgggctccctcgggtaccggcgctgccgcaccccgccgcgctcccgcacccgcggcccgcccaccgcgccgctcccgcatctgcacccgcagcccggcggcctcccggcgggagcgagcagatccagtccggcccgcagcgcaactcggtccagtcggggcggcggctgcgggcgcagagcggagatgcagcggcttggggccaccctgctgtgcctgctgctggcggcggcggtccccacggcccccgcgcccgctccgacggcgacctcggctccagtcaagcccggcccggctctcagctacccgcaggaggaggccaccctcaatgagatgttccgcgaggttgaggaactgatggaggacacgcagcacaaattgcgcagcgcggtggaagagatggaggcagaagaagctgctgctaaagcatcatcagaagtgaacctggcaaacttacctcccagctatcacaatgagaccaacacagacacgaaggttggaaataataccatccatgtgcaccgagaaattcacaagataaccaacaaccagactggacaaatggtcttttcagagacagttatcacatctgtgggagacgaagaaggcagaaggagccacgagtgcatcatcgacgaggactgtgggcccagcatgtactgccagtttgccagcttccagtacacctgccagccatgccggggccagaggatgctctgcacccgggacagtgagtgctgtggagaccagctgtgtgtctggggtcactgcaccaaaatggccaccaggggcagcaatgggaccatctgtgacaaccagagggactgccagccggggctgtgctgtgccttccagagaggcctgctgttccctgtgtgcacacccctgcccgtggagggcgagctttgccatgaccccgccagccggcttctggacctcatcacctgggagctagagcctgatggagccttggaccgatgcccttgtgccagtggcctcctctgccagccccacagccacagcctggtgtatgtgtgcaagccgaccttcgtggggagccgtgaccaagatggggagatcctgctgcccagagaggtccccgatgagtatgaagttggcagcttcatggaggaggtgcgccaggagctggaggacctggagaggagcctgactgaagagatggcgctgagggagcctgcggctgccgccgctgcactgctgggaggggaagagatttagatctggaccaggctgtgggtagatgtgcaatagaaatagctaatttatttccccaggtgtgtgctttaggcgtgggctgaccaggcttcttcctacatcttcttcccagtaagtttcccctctggcttgacagcatgaggtgttgtgcatttgttcagctcccccaggctgttctccaggcttcacagtctggtgcttgggagagtcaggcagggttaaactgcaggagcagtttgccacccctgtccagattattggctgctttgcctctaccagttggcagacagccgtttgttctacatggctttgataattgtttgaggggaggagatggaaacaatgtggagtctccctctgattggttttggggaaatgtggagaagagtgccctgctttgcaaacatcaacctggcaaaaatgcaacaaatgaattttccacgcagttctttccatgggcataggtaagctgtgccttcagctgttgcagatgaaatgttctgttcaccctgcattacatgtgtttattcatccagcagtgttgctcagctcctacctctgtgccagggcagcattttcatatccaagatcaattccctctctcagcacagcctggggagggggtcattgttctcctcgtccatcagggatctcagaggctcagagactgcaagctgcttgcccaagtcacacagctagtgaagaccagagcagtttcatctggttgtgactctaagctcagtgctctctccactaccccacaccagccttggtgccaccaaaagtgctccccaaaaggaaggagaatgggatttttcttttgaggcatgcacatctggaattaaggtcaaactaattctcacatccctctaaaagtaaactactgttaggaacagcagtgttctcacagtgtggggcagccgtccttctaatgaagacaatgatattgacactgtccctctttggcagttgcattagtaactttgaaaggtatatgactgagcgtagcatacaggttaacctgcagaaacagtacttaggtaattgtagggcgaggattataaatgaaatttgcaaaatcacttagcagcaactgaagacaattatcaaccacgtggagaaaatcaaaccgagcagggctgtgtgaaacatggttgtaatatgcgactgcgaacactgaactctacgccactccacaaatgatgttttcaggtgtcatggactgttgccaccatgtattcatccagagttcttaaagtttaaagttgcacatgattgtataagcatgctttctttgagttttaaattatgtataaacataagttgcatttagaaatcaagcataaatcacttcaactgct

SEQ ID NO: 1388 - DNA, 2426 bp, Homo sapiens
gatcgcgttccgggacacacaggcggcggctgcgggcgcagagcggagatgcagcggcttggggccaccctgctgtgcctgctgctggcggcggcggtccccacggcccccgcgcccgctccgacggcgacctcggctccagtcaagcccggcccggctctcagctacccgcaggttgaggaactgatggaggacacgcagcacaaattgcgcagcgcggtggaagagatggaggcagaagaagctgctgctaaagcatcatcagaagtgaacctggcaaacttacctcccagctatcacaatgagaccaacacagacacgaaggttggaaataataccatccatgtgcaccgagaaattcacaagataaccaacaaccagactggacaaatggtcttttcagagacagttatcacatctgtgggagacgaagaaggcagaaggagccacgagtgcatcatcgacgaggactgtgggcccagcatgtactgccagtttgccagcttccagtacacctgccagccatgccggggccagaggatgctctgcacccgggacagtgagtgctgtggagaccagctgtgtgtctggggtcactgcaccaaaatggccaccaggggcagcaatgggaccatctgtgacaaccagagggactgccagccggggctgtgctgtgccttccagagaggcctgctgttccctgtgtgcacacccctgcccgtggagggcgagctttgccatgaccccgccagccggcttctggacctcatcacctgggagctagagcctgatggagccttggaccgatgcccttgtgccagtggcctcctctgccagccccacagccacagcctggtgtatgtgtgcaagccgaccttcgtggggagccgtgaccaagatggggagatcctgctgcccagagaggtccccgatgagtatgaagttggcagcttcatggaggaggtgcgccaggagctggaggacctggagaggagcctgactgaagagatggcgctgagggagcctgcggctgccgccgctgcactgctgggaggggaagagatttagatctggaccaggctgtgggtagatgtgcaatagaaatagctaatttatttccccaggtgtgtgctttaggcgtgggctgaccaggcttcttcctacatcttcttcccagtaagtttcccctctggcttgacagcatgaggtgttgtgcatttgttcagctcccccaggctgttctccaggcttcacagtctggtgcttgggagagtcaggcagggttaaactgcaggagcagtttgccacccctgtccagattattggctgctttgcctctaccagttggcagacagccgtttgttctacatggctttgataattgtttgaggggaggagatggaaacaatgtggagtctccctctgattggttttggggaaatgtggagaagagtgccctgctttgcaaacatcaacctggcaaaaatgcaacaaatgaattttccacgcagttctttccatgggcataggtaagctgtgccttcagctgttgcagatgaaatgttctgttcaccctgcattacatgtgtttattcatccagcagtgttgctcagctcctacctctgtgccagggcagcattttcatatccaagatcaattccctctctcagcacagcctggggagggggtcattgttctcctcgtccatcagggatctcagaggctcagagactgcaagctgcttgcccaagtcacacagctagtgaagaccagagcagtttcatctggttgtgactctaagctcagtgctctctccactaccccacaccagccttggtgccaccaaaagtgctccccaaaaggaaggagaatgggatttttcttttgaggcatgcacatctggaattaaggtcaaactaattctcacatccctctaaaagtaaactactgttaggaacagcagtgttctcacagtgtggggcagccgtccttctaatgaagacaatgatattgacactgtccctctttggcagttgcattagtaactttgaaaggtatatgactgagcgtagcatacaggttaacctgcagaaacagtacttaggtaattgtagggcgaggattataaatgaaatttgcaaaatcacttagcagcaactgaagacaattatcaaccacgtggagaaaatcaaaccgagcagggctgtgtgaaacatggttgtaatatgcgactgcgaacactgaactctacgccactccacaaatgatgttttcaggtgtcatggactgttgccaccatgtattcatccagagttcttaaagtttaaagttgcacatgattgtataagcatgctttctttgagttttaaattatgtataaacataagttgcatttagaaatcaagcataaatcacttcaactgct

SEQ ID NO: 1389 - DNA, 2650 bp, Homo sapiens
cgacgccaaggggagggggctgacctgtgcttggtccaccccaggtaggggctgagagaggcttgaggtggaagtgggggtcgggcactctgacctggtcgaggaggggctagggtttgaaccggggacagagtctaggtgagctggggcttgggagctattagcgtagaggatccgggttcggttgctctggcgagggctccagcatcacaggcggcggctgcgggcgcagagcggagatgcagcggcttggggccaccctgctgtgcctgctgctggcggcggcggtccccacggcccccgcgcccgctccgacggcgacctcggctccagtcaagcccggcccggctctcagctacccgcaggaggaggccaccctcaatgagatgttccgcgaggttgaggaactgatggaggacacgcagcacaaattgcgcagcgcggtggaagagatggaggcagaagaagctgctgctaaagcatcatcagaagtgaacctggcaaacttacctcccagctatcacaatgagaccaacacagacacgaaggttggaaataataccatccatgtgcaccgagaaattcacaagataaccaacaaccagactggacaaatggtcttttcagagacagttatcacatctgtgggagacgaagaaggcagaaggagccacgagtgcatcatcgacgaggactgtgggcccagcatgtactgccagtttgccagcttccagtacacctgccagccatgccggggccagaggatgctctgcacccgggacagtgagtgctgtggagaccagctgtgtgtctggggtcactgcaccaaaatggccaccaggggcagcaatgggaccatctgtgacaaccagagggactgccagccggggctgtgctgtgccttccagagaggcctgctgttccctgtgtgcacacccctgcccgtggagggcgagctttgccatgaccccgccagccggcttctggacctcatcacctgggagctagagcctgatggagccttggaccgatgcccttgtgccagtggcctcctctgccagccccacagccacagcctggtgtatgtgtgcaagccgaccttcgtggggagccgtgaccaagatggggagatcctgctgcccagagaggtccccgatgagtatgaagttggcagcttcatggaggaggtgcgccaggagctggaggacctggagaggagcctgactgaagagatggcgctgagggagcctgcggctgccgccgctgcactgctgggaggggaagagatttagatctggaccaggctgtgggtagatgtgcaatagaaatagctaatttatttccccaggtgtgtgctttaggcgtgggctgaccaggcttcttcctacatcttcttcccagtaagtttcccctctggcttgacagcatgaggtgttgtgcatttgttcagctcccccaggctgttctccaggcttcacagtctggtgcttgggagagtcaggcagggttaaactgcaggagcagtttgccacccctgtccagattattggctgctttgcctctaccagttggcagacagccgtttgttctacatggctttgataattgtttgaggggaggagatggaaacaatgtggagtctccctctgattggttttggggaaatgtggagaagagtgccctgctttgcaaacatcaacctggcaaaaatgcaacaaatgaattttccacgcagttctttccatgggcataggtaagctgtgccttcagctgttgcagatgaaatgttctgttcaccctgcattacatgtgtttattcatccagcagtgttgctcagctcctacctctgtgccagggcagcattttcatatccaagatcaattccctctctcagcacagcctggggagggggtcattgttctcctcgtccatcagggatctcagaggctcagagactgcaagctgcttgcccaagtcacacagctagtgaagaccagagcagtttcatctggttgtgactctaagctcagtgctctctccactaccccacaccagccttggtgccaccaaaagtgctccccaaaaggaaggagaatgggatttttcttttgaggcatgcacatctggaattaaggtcaaactaattctcacatccctctaaaagtaaactactgttaggaacagcagtgttctcacagtgtggggcagccgtccttctaatgaagacaatgatattgacactgtccctctttggcagttgcattagtaactttgaaaggtatatgactgagcgtagcatacaggttaacctgcagaaacagtacttaggtaattgtagggcgaggattataaatgaaatttgcaaaatcacttagcagcaactgaagacaattatcaaccacgtggagaaaatcaaaccgagcagggctgtgtgaaacatggttgtaatatgcgactgcgaacactgaactctacgccactccacaaatgatgttttcaggtgtcatggactgttgccaccatgtattcatccagagttcttaaagtttaaagttgcacatgattgtataagcatgctttctttgagttttaaattatgtataaacataagttgcatttagaaatcaagcataaatcacttcaactgct

SEQ ID NO: 1390 - DNA, 1003 bp, Homo sapiens
gatgcagcggcttggggccaccctgctgtgcctgctgctggcggcggcggtccccacggcccccgcgcccgctccgacggcgacctcggctccagtcaagcccggcccggctctcagctacccgcaggaggaggccaccctcaatgagatgttccgcgaggttgaggaactgatggaggacacgcagcacaaattgcgcagcgcggtggaagagatggaggcagaagaagctgctgctaaagcatcatcagaagtgaacctggcaaacttacctcccagctatcacaatgagaccaacacagacacgaaggttggaaataataccatccatgtgcaccgagaaattcacaaggagtgcatcatcgacgaggactgtgggcccagcatgtactgccagtttgccagcttccagtacacctgccagccatgccggggccagaggatgctctgcacccgggacagtgagtgctgtggagaccagctgtgtgtctggggtcactgcaccaaaatggccaccaggggcagcaatgggaccatctgtgacaaccagagggactgccagccggggctgtgctgtgccttccagagaggcctgctgttccctgtgtgcacacccctgcccgtggagggcgagctttgccatgaccccgccagccggcttctggacctcatcacctgggagctagagcctgatggagccttggaccgatgcccttgtgccagtggcctcctctgccagccccacagccacagcctggtgtatgtgtgcaagccgaccttcgtggggagccgtgaccaagatggggagatcctgctgcccagagaggtccccgatgagtatgaagttggcagcttcatggaggaggtgcgccaggagctggaggacctggagaggagcctgactgaagagatggcgctgagggagcctgcggctgccgccgctgcactgctgggaggggaagagatttagatctggaccaggctgtgggtagatgtgcaatag

SEQ ID NO: 1391 - DNA, 903 bp, Homo sapiens
agatccagtccggcccgcagcgcaactcggtccagtcggggtgggtgaggggcggcggcgggggaggggacgactctgctgagctcagcctctcttggtggatgtggggcggggcgctcgagtaggacccgacgccaaggggagggggctgacctgtgcttggtccaccccaggcggcggctgcgggcgcagagcggagatgcagcggcttggggccaccctgctgtgcctgctgctggcggcggcggtccccacggcccccgcgcccgctccgacggcgacctcggctccagtcaagcccggcccggctctcagctacccgcaggaggaggccaccctcaatgagatgttccgcgaggttgaggaactgatggaggacacgcagcacaaattgcgcagcgcggtggaagagatggaggcagaagaagctgctgctaaagcatcatcagaagtgaacctggcaaacttacctcccagctatcacaatgagaccaacacagacacgaaggttggaaataataccatccatgtgcaccgagaaattcacaagataaccaacaaccagactggacaaatggtcttttcagagacagttatcacatctgtgggagacgaagaaggcagaaggagccacgagtgcatcatcgacgaggactgtgggcccagcatgtactgccagtttgccagcttccagtacacctgccagccatgccggggccagaggatgctctgcacccgggacagtgagtgctgtggagaccagctgtgtgtctggggtcactgcaccaaaatggccaccaggggcagcaatgggaccatctgtgacaaccagagggactgccagccggggctgtgctgtgccttccagagaggcctgctgttccctgtgtgcacacccctgcc

SEQ ID NO: 1392 - DNA, 3904 bp, Homo sapiens
ctttcactggcaagagacggagtcctgggtttcagttccagttgcctgcggtgggctgtgtgagtttgccaaagtcccctgccctctctgggtctcggttccctcgcctgtccacgtgaggttggaggagctgaacgccgacgtcatttttagctaagagggagcagggtccccgagtcgccggcccagggtctgcgcatccgaggccgcgcgccctttcccctcccccacggctcctccgggccccgcactctgcgccccggctgccgcccagcgccctacaccgccctcagggggccctcgcgggctccccccggccgggatgccagtgccccgcgccacgcgcgcctgctcccgcgccgcctgccctgcagcctgcccgcggcgcctttatacccagcgggctcggcgctcactaatgtttaactcggggccgaaacttgccagcggcgagtgactccaccgcccggagcagcggtgcaggacgcgcgtctccgccgcccgcggtgacttctgcctgcgctccttctctgaacgctcacttccgaggagacgccgacgatgaagacaccgtggaaggttcttctgggactgctgggtgctgctgcgcttgtcaccatcatcaccgtgcccgtggttctgctgaacaaaggcacagatgatgctacagctgacagtcgcaaaacttacactctaactgattacttaaaaaatacttatagactgaagttatactccttaagatggatttcagatcatgaatatctctacaaacaagaaaataatatcttggtattcaatgctgaatatggaaacagctcagttttcttggagaacagtacatttgatgagtttggacattctatcaatgattattcaatatctcctgatgggcagtttattctcttagaatacaactacgtgaagcaatggaggcattcctacacagcttcatatgacatttatgatttaaataaaaggcagctgattacagaagagaggattccaaacaacacacagtgggtcacatggtcaccagtgggtcataaattggcatatgtttggaacaatgacatttatgttaaaattgaaccaaatttaccaagttacagaatcacatggacggggaaagaagatataatatataatggaataactgactgggtttatgaagaggaagtcttcagtgcctactctgctctgtggtggtctccaaacggcacttttttagcatatgcccaatttaacgacacagaagtcccacttattgaatactccttctactctgatgagtcactgcagtacccaaagactgtacgggttccatatccaaaggcaggagctgtgaatccaactgtaaagttctttgttgtaaatacagactctctcagctcagtcaccaatgcaacttccatacaaatcactgctcctgcttctatgttgataggggatcactacttgtgtgatgtgacatgggcaacacaagaaagaatttctttgcagtggctcaggaggattcagaactattcggtcatggatatttgtgactatgatgaatccagtggaagatggaactgcttagtggcacggcaacacattgaaatgagtactactggctgggttggaagatttaggccttcagaacctcattttacccttgatggtaatagcttctacaagatcatcagcaatgaagaaggttacagacacatttgctatttccaaatagataaaaaagactgcacatttattacaaaaggcacctgggaagtcatcgggatagaagctctaaccagtgattatctatactacattagtaatgaatataaaggaatgccaggaggaaggaatctttataaaatccaacttagtgactatacaaaagtgacatgcctcagttgtgagctgaatccggaaaggtgtcagtactattctgtgtcattcagtaaagaggcgaagtattatcagctgagatgttccggtcctggtctgcccctctatactctacacagcagcgtgaatgataaagggctgagagtcctggaagacaattcagctttggataaaatgctgcagaatgtccagatgccctccaaaaaactggacttcattattttgaatgaaacaaaattttggtatcagatgatcttgcctcctcattttgataaatccaagaaatatcctctactattagatgtgtatgcaggcccatgtagtcaaaaagcagacactgtcttcagactgaactgggccacttaccttgcaagcacagaaaacattatagtagctagctttgatggcagaggaagtggttaccaaggagataagatcatgcatgcaatcaacagaagactgggaacatttgaagttgaagatcaaattgaagcagccagacaattttcaaaaatgggatttgtggacaacaaacgaattgcaatttggggctggtcatatggagggtacgtaacctcaatggtcctgggatcgggaagtggcgtgttcaagtgtggaatagccgtggcgcctgtatcccggtgggagtactatgactcagtgtacacagaacgttacatgggtctcccaactccagaagacaaccttgaccattacagaaattcaacagtcatgagcagagctgaaaattttaaacaagttgagtacctccttattcatggaacagcagatgataacgttcactttcagcagtcagctcagatctccaaagccctggtcgatgttggagtggatttccaggcaatgtggtatactgatgaagaccatggaatagctagcagcacagcacaccaacatatatatacccacatgagccacttcataaaacaatgtttctctttaccttagcacctcaaaataccatgccatttaaagcttattaaaactcatttttgttttcattatctcaaaactgcactgtcaagatgatgatgatctttaaaatacacactcaaatcaagaaacttaaggttacctttgttcccaaatttcatacctatcatcttaagtagggacttctgtcttcacaacagattattaccttacagaagtttgaattatccggtcgggttttattgtttaaaatcatttctgcatcagctgctgaaacaacaaataggaattgtttttatggaggctttgcatagattccctgagcaggattttaatctttttctaactggactggttcaaatgttgttctcttctttaaagggatggcaagatgtgggcagtgatgtcactagggcagggacaggataagagggattagggagagaagatagcagggcatggctgggaacccaagtccaagcataccaacacgagcaggctactgtcagctcccctcggagaagagctgttcacagccagactggcacagttttctgagaaagactattcaaacagtctcaggaaatcaaatatgcaaagcactgacttctaagtaaaaccacagcagttgaaaagactccaaagaaatgtaagggaaactgccagcaacgcaggcccccaggtgccagttatggctataggtgctacaaaaacacagcaagggtgatgggaaagcattgtaaatgtgcttttaaaaaaaaatactgatgttcctagtgaaagaggcagcttgaaactgagatgtgaacacatcagcttgccctgttaaaagatgaaaatatttgtatcacaaatcttaacttgaaggagtccttgcatcaatttttcttatttcatttctttgagtgtcttaattaaaagaatattttaacttccttggactcattttaaaaaatggaacataaaatacaatgttatgtattattattcccattctacatactatggaatttctcccagtcatttaataaatgtgccttcattttttcagaagtaa

SEQ ID NO: 1393 - DNA, 2371 bp, Homo sapiens
gcccctcgtcgccctctgtaggcctgctccctccccgcccttccaccctcaccctgcgccccgccccggccccttggtcctcgccccgccctcctcgtttggcgccaaaccctgtggtcaacggcgcgcgggtctccaggctccgtgttctaggcccgagttagaatcctgtcagctgaggaggtcgggcggggcagaggggcttcaccttgaaaatctcggggagactgtgggtacgagggggaagtgattatttttctgttgcccacttttcaatatgaaggaggatcaagttgtggcggaagaaccaggattccaagatgaagaggaatctttgtttcaagatattgacctgttacagaaacatggaattaacgtggctgacattaagaaactgaaatcagtaggaatctgtaccatcaaaggtatacagatgacaacaagaagagctctatgcaatgtcaaaggactctcagaagccaaagtagacaagattaaagaggcagcgaacaaactaattgaaccaggattcttgactgcatttgagtatagtgaaaagaggaaaatggttttccatatcaccaccgggagccaggaatttgataagttactaggaggtggaattgaaagtatggcaattacagaagcttttggagaatttcgtactggaaaaacccagctttctcataccctctgtgtgacagctcaacttccaggagctggtggctacccaggaggaaagattatcttcattgatacagaaaatactttccgtccagatcgccttagggacattgctgatcgctttaatgtagaccatgatgcagtactggacaacgtactttatgcacgtgcatatactagtgaacatcagatggagctacttgattatgtagcagcaaagttccatgaagaagctggcatcttcaagctattgattatcgattcaataatggcactttttcgagtggatttcagtggccgtggggagttggccgaacggcagcaaaaattggcccagatgttgtcacgactccaaaaaatctcagaagaatataacgtggctgtttttgtgaccaatcaaatgactgccgatccaggagcaactatgacctttcaggcagatcccaaaaaacccattgggggacacattctggctcatgcttcaacaacaagaataagcttgcgaaagggaagaggagagctcagaattgccaagatttatgacagtcctgagatgcctgaaaatgaagccaccttcgcaataactgctggaggaattggggatgccaaggagtaggtggtgaattgatgcaaattgcttcttagtgcttattaggagctgaagaaatggaaaagcagtctccaatttcacatcttgaaatagaggttttttcccacatgttactaaagaaaagtcagcaaagagatttaaatcttatatttatcttaaaagtccctgatttatgataactatacattgtatgtaaattcagggatatgtatatgtatgtttgtgtgtgtgtgtgtttgtgtgtgtatacctgacatatatagtagatatatatacctattgaaattctctcactctgtgtatgtatatatacctatggaaaactagttgttgggaaaggagtacgtgattccctccctttcacttttcaaagtgagccactaaacagaaagtctaagagttcagaaatgtcccattctcctaaggactttcccttcaccatttttctagggtatagtgccactgacttacatagctagatgtttttccacaagaggatttaagggaggaatgtttataggacacacacacaaaagctctttctatttataatatcaaactgcatattcacctttatagcaacagaaaacagacattaaattaagccaaattttaaatcatttgactttgacaagcagaaattacttttaaaaaatgtatttatggctgggcgtggtggctcacacctgtaatcccagcactttgggaggccgaggcaggtggatcacttgaggtcaggagttcaagaccagcctggccaacatggagaaaccccatctctactaaaaatacaaaaattagccaagtgcagtggcatgtgcttgtaatcccagctactctggaggctgaggcaggagaattgcttgaacccaggaggcagagattgcggtgagccaagatggcaccactgcactccagcctaggtgacagagtgagactccgtctcaaaaaaaaaaaaaaaacttttttaaaatgttaaaattaatttaaatgtaaaatttctgaatactaatcttagaaatgtgtaaaagatattattttgattgttaaacaaataaaatcctgttttcaaaatgc

SEQ ID NO: 1394 - DNA, 1595 bp, Homo sapiens
cgccaaaccctgtggtcaacggcgcgcgggtctccaggctccgtgttctaggcccgagttagaatcctgtcagctgaggaggtcgggcggggcagaggggcttcaccttgaaaatctcggggagactgtgggtacgagggggaagtgattatttttctgttgcccacttttcaatatgaaggaggatcaagttgtggcggaagaaccaggattccaagatgaagaggaatctttgtttcaagatattgacctgttacagaaacatggaattaacgtggctgacattaagaaactgaaatcagtaggaatctgtaccatcaaaggtatacagatgacaacaagaagagctctatgcaatgtcaaaggactctcagaagccaaagtagacaagattaaagaggcagcgaacaaactaattgaaccaggattcttgactgcatttgagtatagtgaaaagaggaaaatggttttccatatcaccaccgggagccaggaatttgataagttactaggaggtggaattgaaagtatggcaattacagaagcttttggagaatttcgtactggaaaaacccagctttctcataccctctgtgtgacagctcaacttccaggagctggtggctacccaggaggaaagattatcttcattgatacagaaaatactttgtaacctttttatttaaagttgctaacataatagtgtgatataggaatgttaccactgaagagtttgtctgagatatacaatctttgtagtcattccataaaccagtagtaatgagacaaaccaaagggaaaacaattactgtttaagttctccaatcactttgtatttaatgaggtttcacttcttcatatgggtttatgagacaaaacaaatacatgagaggaaattatatcatcatttttaatcctcttacttctctaaagatgttgcttaatagttagaaaaaagatttttttttttttgagacggaatctccctgttgcccaggctggagtccagtggggcaatctcggctcactgcaacctccatctcttgggttcaatcaattctcctgcctcagcctaccgagtagctgggattacaggtgtgtgccaccacacctggctaatttttttgtatttttagtagagacagggttttgacatgttgaccaggctgttctggaactcctgacctcaggtgatccacctgcctcagcctcccacagtgctaggattacaggcgtgagccacgatgcccggcctgcaatttggattttactaagaacaataggaatacttaggagctaagtcatatgcaagagagagtggagaagaacagctgggtgggggtgcagggcactgtggcaagggccacattggagtgttctcattctttccgtgtctcatacttatactgctgtctcttgatagttttctttttatatgtttatattttgcctccttaattatgttttaaatttacctagggcataggttgtcttaggactccttatatcctccataatgctttgccttggtaattgattaatatggtaattaattccatatggtaattggttaataaatatttataattgatctg

SEQ ID NO: 1395 - DNA, 569 bp, Homo sapiens
ctcatctttccaagctaaatgcttctcttactgtccttctagtccttgttgactttgaaatgaaatcagaggcccctggacaaaggactacttcttacataatatttcttattttcccagaagtgattatttttctgttgcccacttttcaatatgaaggaggatcaagttgtggcggaagaaccaggattccaagatgaagaggaatctttgtttcaagatattgacctgttacagaaacatggaattaacgtggctgacattaagaaactgaaatcagtaggaatctgtaccatcaaaggtatacagatgacaacaagaagagctctatgcaatgtcaaaggactctcagaagccaaagtagacaagattaaagaggcagcgaacaaactaattgaaccaggattcttgactgcatttgagtatagtgaaaagaggaaaatggttttccatatcaccaccgggagccaggaatttgataagttactaggaggtggaattgaaagtatggcaattacagaagcttttggagaatttcgtactggaaaaacccagctttctcataccct

SEQ ID NO: 1396 - DNA, 1056 bp, Homo sapiens
ctcatctttccaagctaaatgcttctcttactgtccttctagtccttgttgactttgaaatgaaatcagaggcccctggacaaaggactacttcttacataatatttcttattttcccagaagtgattatttttctgttgcccacttttcaatatgaaggaggatcaagttgtggcggaagaaccaggattccaagatgaagaggaatctttgtttcaagatattgacctgttacagaaacatggaattaacgtggctgacattaagaaactgaaatcagtaggaatctgtaccatcaaaggtatacagatgacaacaagaagagctctatgcaatgtcaaaggactctcagaagccaaagtagacaagattaaagaggcagcgaacaaactaattgaaccaggattcttgactgcatttgagtatagtgaaaagaggaaaatggttttccatatcaccaccgggagccaggaatttgataagttactaggaggtggaattgaaagtatggcaattacagaagcttttggagaatttcgtactggaaaaacccagctttctcataccctctgtggtgaacatcagatggagctacttgattatgtagcagcaaagttccatgaagaagctggcatcttcaagctattgattatcgattcaataatggcactttttcgagtggatttcagtggccgtggggagttggccgaacggcagcaaaaattggcccagatgttgtcacgactccaaaaaatctcagaagaatataacgtggctgtttttgtgaccaatcaaatgactgccgatccaggagcaactatgacctttcaggcagatcccaaaaaacccattgggggacacattctggctcatgcttcaacaacaagaataagcttgcgaaagggaagaggagagctcagaattgccaagatttatgacagtcctgagatgcctgaaaatgaagccaccttcgcaataactgctggaggaattggggatgccaaggagtaggtggtgaattgatgcaaattgcttcttagtgcttattaggagctg

SEQ ID NO: 1397 - DNA, 721 bp, Homo sapiens
ccgagttagaatcctgtcagctgaggaggtcgggcggggcagaggggcttcaccttgaaaatctcggggagactgtggaagtgattatttttctgttgcccacttttcaatatgaaggaggatcaagttgtggcggaagaaccaggattccaagatgaagaggaatctttgtttcaagatattgacctgttacagaaacatggaattaacgtggctgacattaagaaactgaaatcagtaggaatctgtaccatcaaaggtatacagatgacaacaagaagagctctatgcaatgtcaaaggactctcagaagccaaagtagacaagattaaagaggcagcgaacaaactaattgaaccaggattcttgactgcatttgagtatagtgaaaagaggaaaatggttttccatatcaccaccgggagccaggaatttgataagttactaggaggtggaattgaaagtatggcaattacagaagcttttggagaatttcgtactggaaaaacccagctttctcataccctctgtggtgaacatcagatggagctacttgattatgtagcagcaaagttccatgaagaagctggcatcttcaagctattgattatcgattcaataatggcactttttcgagtggatttcagtggccgtggggagttggccgaacggcagcaaaaattggcccagatgttgtcacgactccaaaaaatctcagaag

SEQ ID NO: 1398 - DNA, 3940 bp, Homo sapiens
accaaacagaagaccgctgccggtctccccgcgagcgagcgctaagcgtagtcccgactccgaccttaggatgcccttcccccaacctctcactctccaggcgcagctgcgcggctccctctggtggagctgcggcgggcaatcggaaatcggctactttggcctgtctcctccctgcagcgcgcgctttgagtgcccggctcggcctccgctcccgcgcggttgggagtgtccagcgccctccgcgatttgggctccagcgggcagggtgacttcctttttctgcccactctggtaacttattgctctgctgggctctttcccttagggtctctggccctgttcttgccccagcatgacttttatcgggacgccgttgtggaagcctcacgcaggagccctgcccccgtggagaagatcccactggtgactccaaccctaccaccatgaatggggtcctgatcccccatacgcccatcgcagtggacttctggagcctgcgccgggctggcaccgcacgtctcttcttcttgtctcacatgcactcggaccacaccgtgggcctgtctagcacctgggcccggcccctctactgctccccaattacagcccacctcttgcatcgtcacctacaggtatctaagcaatggatccaagccctggaggttggtgagagccatgtattacccctagatgaaattggacaagagaccatgaccgtaaccctcctcgatgccaatcactgtcctggttctgtcatgtttctctttgaaggatattttggaaccatcctctacacaggtgattttcgatacacaccatccatgctaaaggagccagccctgacactggggaaacagatccatactttatacctagacaacaccaattgcaatccagccctggttcttccttcccgacaagaagctgcccaccagattgtccagctcattcgaaaacacccacaacataacataaagattggactctacagcctgggaaaggaatcactgctggagcagctggccctggagtttcagacctgggtggtattgagtcctcggcgcctggagttggtacagctactgggcctggcagatgtgttcacagtggaggagaaggctggccgcatccatgcagtagaccatatggagatctgccattccaacatgctgcgttggaaccagacccaccctacgattgctatccttcccacaagccgaaaaatccacagctcccaccctgatatccacgtcatcccttactctgaccattcctcttactccgagcttcgtgcctttgtcgcagcactgaagccttgccaggtggtgcccattgtaagtcggcggccctgtggaggctttcaggacagtctgagccccaggatctccgtgcccctgattccggactctgtacagcaatacatgagttcttcctctagaaaaccaagccttctctggctgttagaaaggaggctaaagaggccgagaacccaaggtgttgtgtttgaatcccctgaggaaagtgctgatcaatctcaagctgacagagactcaaagaaggccaagaaagagaaactttctccctggcctgcggaccttgaaaagcagccttcccaccatcctttgcggatcaagaagcagttgttcccagatctctatagcaaagaatggaacaaggcagtgcctttctgtgagtctcaaaagagggtgactatgttgacggccccactgggattttcagtgcacttaaggtctacagatgaggagtttatttctcaaaaaaccagggaggaaattggtttagggtcccccttggtacccatgggagatgatgatggaggtccagaagccacagggaatcagagtgcctggatgggccatggttctcccctgtcccacagcagcaagggcacccctcttctagctactgaattcaggggtctagcactcaaatatcttctgactccagtgaactttttccaggcagggtattcttccaggagatttgaccagcaagtggaaaaataccataaaccctgctgaagacaggagagtacagaatgacaacattgagcccacactgcagttttgaagatagtaactgatggctggtgggaaagagtttgtttttggggcctacttttctatctttacaagactcttatgggcccaccgtggagcagcacttcccaaaacttgttcactggggtcctcgtgcctatggaatccttctttttataactaagtttaagaaatactttttttataaaatctttggagtatgcgtgagcaaattaaaagttctttgaagtcctacagtaacttaatctgtttaaccttgtttaacccagtatttctcaaacttttgtgaacatgcaatcatcttatgtgggtacagaaagaggtaaagagtctgaatcaaaaaggaccaggttattgctgttgctgttttgtggtgtcatgagccattctccatgtccccttctccctcttctcagatcaaaatccctagggagttctatttttaaaattatgaactatggcgctgcatgcttcaatcctgaacgtcactgacttgctgtgaccatccaaataattttcctgtctctgcctctgggagggaacaggaagcgatgaagaggtcttggaacagtagtgaaaattctacctctatgtccttcatgaggatgtgcagtatcccagtatcactgggatccatgtggaacagagccagctggggggttgggcagctctctccaaggcagtacctagagcccagctgaacaacaaggctttgggtgtgaagggactccccagcctggagaccctatttggctgaaacagttacaaaatatcaaatgtgttgtcagatattcctccaattgttcacatagctgggatatttgttgctcccctcaccccttggattatgtagggagccagtgcacacagcctgtttgttttagtatccaaggaagagaccaaggagccagctggcgggaaggggtgggggtgtgcagtctgccctgtccttctgctcataacctgacaaaatgccaaactagtaagcaggatagctgataccacggctatgagggagtaggctctgagagggcacagacttgtggagctgggcgtctggatcaaaactgctttgggatggaacctcgagccctagcagtgaagaagattccatttcttgtccaggggatttaaaagagttttctgctttgagagagaaatagagagtttagaaagcaattgctcttgggaaagctatacacagctctgttttgtcaatgacctttgttgtaagtctcccaacgtcctattaggagccacagcaggtgaggcatttggtgcagcaggaaacatggggactgcctaggctcgaatctgtggcaccctgagcaattacttaaattgtggagcctagttcctcatctgtaagatggacttgagattcctacctctcatgattactatggagattgaataattggtaaaattctcctagctcagtgactgccacaggatgggtctttcagattttggttctctttagcttctggttcttgaaagaaattaatctgtatataacataagaaactttgaaagtcaaaaaaacaaaaaattttaattcctcgtagattaattgatttgctatcttttagtttttttttctatgcatgtagatgtattaaatatgtaaatgtttttcaaagttgaggtaatattgtatagaattttatagcctacattttaatttcttgatatcttaagcatttcacttattagatattgttcaaaaatgccatttttaatatttgtataataccctatcatgtgagtataccttaactaagccattcccatattcaacattttgtgtactgtttttctaattacatatattacaatgaacaaccttatgcata

SEQ ID NO: 1399 - DNA, 2228 bp, Homo sapiens
ggcttcagctgcggttttggggtcccggactctgggatcggcggcgctatgagttctttcgaggggcagatggccgagtatccaactatctccatagaccgcttcgatagggagaacctgagggcccgcgcctacttcctgtcccactgccacaaagatcacatgaaaggattaagagcccctaccttgaaaagaaggttggagtgcagatatctattgaaatcgagactcctacccagatatctttagtggatgaagcatcaggagaggtttttatttcagggcaataatggaactgtcctgtacacaggagacttcagattggcgcaaggagaagctgctagaatggagcttctgcactccgggggcagagtcaaagacatccaaagtgtatatttggatactacgttctgtgatccaagattttaccaaattccaagtcgggaggagtgtttaagtggagtcttagagctggtccgaagctggatcactcggagcccgtaccatgttgtgtggctgaactgcaaagcggcttatggctatgaatatctgttcaccaaccttagtgaagaattaggagtccaggttcatgtgaataagctagacatgtttaggaacatgcctgagatccttcatcatctcacaacagaccgcaacactcagatccatgcatgccggcatcccaaggcagaggaatattttcagtggagcaaattaccctgtggaattacttccagaaatagaattccactccacataatcagcattaagccatccaccatgtggtttggagaaaggagcagaaaaacaaatgtaattgtgaggactggagagagttcatacagagcttgtttttcttttcactcctcctacagtgagattaaagatttcttgagctacctctgtcctgtgaacgcatatccaaatgtcattccagttggcacaactatggataaagttgtcgaaatcttaaagcctttatgccggtcttcccaaagtacggagccaaagtataaaccactgggaaaactgaagagagctagaacagttcaccgagactcagaggaggaagatgactatctctttgatgatcctctgccaatacctttaaggcacaaagttccatacccggaaacttttcaccctgaggtattttcaatgactgcagtatcagaaaagcagcctgaaaaactgagacaaaccccaggatgctgcagagcagagtgtatgcagagctctcgtttcacaaactttgtagattgtgaagaatccaacagtgaaagtgaagaagaagtaggaatcccagcttcactgcaaggagatctgggctctgtacttcacctgcaaaaggctgatggggatgtaccccagtgggaagtattctttaaaagaaatgatgaaatcacagatgagagtttggaaaacttcccttcctccacagtggcagggggatctcagtcaccaaagcttttcagtgactctgatggagaatcaactcacatctcctcccagaattcttcccagtcaacacacataacagaacaaggaagtcaaggctgggacagccaatctgatactgttttgttatcttcccaagagagaaacagtggggatattacttccttggacaaagctgactacagaccaacaatcaaagagaatattcctgcctctctcatggaacaaaatgtaatttgcccaaaggatacttactctgatttgaaaagcagagataaagatgtgacaatagttcctagtactggagaaccaactactctaagcagtgagacacatatacccgaggaaaaaagtttgctaaatcttagcacaaatgcagattcccagagctcttctgattttgaagttccctcaactccagaagctgagttacctaaacgagagcatttacaatatttatatgagaagctggcaactggtgagagtatagcagtcaaaaaaagaaaatgctcactcttagatacctaagaattcaaagcgtttcaacctagagcaaccactaaaaaacctgcacagagatgacagtcaatattacaatagagaaaatacagtacttaaaaatgttcaaataacctggttgggtgtggtggctcacacttgtaatcccagcactttgaggtgggcaatggcttgagcccaggagttcgacaccagcctggccaacacagtgaaatgtgtctctacttacaaaaaaaaaaaaaaaaaaaaaa

SEQ ID NO: 1400 - DNA, 833 bp, Homo sapiens
gcggcgctatgagttctttcgaggggcagatggccgagtatccaactatctccatagaccgcttcgatagggagaacctgagggcccgcgcctacttcctgtcccactgccacaaagatcacatgaaaggattaagagcccctaccttgaaaagaaggttggagtgcagatgaggaaactgaggaaccagagaggttaaattagttgcccagtgtcacacagccagtaagtggcaggaccaggattccagccagcttgaaggtttatctatactgttcacctgtgactaaggagttgttgttaacgagcccgaaatacagattttggaagaaacgaatttgctggtctcccgctttggctctgaagcacatgcacctgccccaggactcggaggagctgcacacgggcacccagcagaagctgatgttgctgcggccctgccccagactctgagttaagccagaagatatctattgaaatcgagactcctacccagatatctttagtggatgaagcatcaggagagaaggaagagattgttgtgactctcttaccagctggtcactgtccgggatcagttatgtttttatttcagggcaataatggaactgtcctgtacacaggagacttcagattggcgcaaggagaagctgctagaatggagcttctgcactccgggggcagagtcaaagacatccaaagtgtatatttggatactacgttctgtgatccaagattttaccaaattccaagtcgggaggagtgtttaagtggagtcttagagctggtccgaagctggatcactcggagcccgtaccatgttgtgtggctga

SEQ ID NO: 1401 - DNA, 1933 bp, Homo sapiens
aggagtaaataagtgcaattcttttgttgttcttttttggagatgaggtgtctctgtgttgcccaggctggcctcaaatccctgggcttaagcaatcctcctgcctcagccttgagtagctgggatcacagacatgtaccactgtgcccagctaagaaatgcaattctgagaccttgggtttttgtgtatattatagttaatgcccagctaaattctaacttatttgaaaagggatttgttaaacataagcaactgaccttcttggacaaggaaagcaatatattaaaaaagagaaaaaaaaaagaatctttgagtcccattggtgattctcagctcttactgtggatcagaatcacctggggaatatttaaatgtactgatttctaggcccactagtactcagtgttcaggagatctttgggagtgaggcccaggcattggatatttttttcccaagaggtccctggtgatccccacgtgcagccagcattgagaaccacagccataagagagttctgcttctctttccccagcctccctttatctcccctaacaacctgtttcatcgtagagattgttgatccatgtgattttcctttttctagattaaagatttcttgagctacctctgtcctgtgaacgcatatccaaatgtcattccagttggcacaactatggataaagttgtcgaaatcttaaagcctttatgccggtcttcccaaagtacggagccaaagtataaaccactgggaaaactgaagagagctagaacagttcaccgagactcagaggaggaagatgactatctctttgatgatcctctgccaatacctttaaggcacaaagttccatacccggaaacttttcaccctgaggtattttcaatgactgcagtatcagaaaagcagcctgaaaaactgagacaaaccccaggatgctgcagagcagagtgtatgcagagctctcgtttcacaaactttgtagattgtgaagaatccaacagtgaaagtgaagaagaagtaggaatcccagcttcactgcaaggagatctgggctctgtacttcacctgcaaaaggctgatggggatgtaccccagtgggaagtattctttaaaagaaatgatgaaatcacagatgagagtttggaaaacttcccttcctccacagtggcagggggatctcagtcaccaaagcttttcagtgactctgatggagaatcaactcacatctcctcccagaattcttcccagtcaacacacataacagaacaaggaagtcaaggctgggacagccaatctgatactgttttgttatcttcccaagagagaaacagtggggatattacttccttggacaaagctgactacagaccaacaatcaaagagaatattcctgcctctctcatggaacaaaatgtaatttgcccaaaggatacttactctgatttgaaaagcagagataaagatgtgacaatagttcctagtactggagaaccaactactctaagcagtgagacacatatacccgaggaaaaaagtttgctaaatcttagcacaaatgcagattcccagagctcttctgattttgaagttccctcaactccagaagctgagttacctaaacgagagcatttacaatatttatatgagaagctggcaactggtgagagtatagcagtcaaaaaaagaaaatgctcactcttagatacctaagaattcaaagcgtttcaacctagagcaaccactaaaaaacctgcacagagatgacagtcaatattacaatagagaaaatacagtacttaaaaatgttcaaataacctggttgggtgtggtggctcacacttgtaatcccagcactttgaggtgggcaatggcttgagcccaggagttcgacaccagcctggccaacacagtgaaatgtgtctctacttac

SEQ ID NO: 1402 - DNA, 2637 bp, Homo sapiens
gcttcccggaagtggcggcgcggtcagggctggccttggcttcagctgcggttttggggtcccggactctgggatcggcggcgctatgagttctttcgaggggcagatggccgagtatccaactatctccatagaccgcttcgatagggagaacctgagggcccgcgcctacttcctgtcccactgccacaaagatcacatgaaaggattaagagcccctaccttgaaaagaaggttggagtgcagcttgaaggtttatctatactgttcacctgtgactaaggagttgttgttaacgagcccgaaatacagattttggaagaaacgaattatatctattgaaatcgagactcctacccagatatctttagtggatgaagcatcaggagaggtttttatttcagggcaataatggaactgtcctgtacacaggagacttcagattggcgcaaggagaagctgctagaatggagcttctgcactccgggggcagagtcaaagacatccaaagtgtatatttggatactacgttctgtgatccaagattttaccaaattccaagtcgggaggagtgtttaagtggagtcttagagctggtccgaagctggatcactcggagcccgtaccatgttgtgtggctgaactgcaaagcggcttatggctatgaatatctgttcaccaaccttagtgaagaattaggagtccaggttcatgtgaataagctagacatgtttaggaacatgcctgagatccttcatcatctcacaacagaccgcaacactcagatccatgcatgccggcatcccaaggcagaggaatattttcagtggagcaaattaccctgtggaattacttccagaaatagaattccactccacataatcagcattaagccatccaccatgtggtttggagaaaggagcagaaaaacaaatgtaattgtgaggactggagagagttcatacagagcttgtttttcttttcactcctcctacagtgagattaaagatttcttgagctacctctgtcctgtgaacgcatatccaaatgtcattccagttggcacaactatggataaagttgtcgaaatcttaaagcctttatgccggtcttcccaaagtacggagccaaagtataaaccactgggaaaactgaagagagctagaacagttcaccgagactcagaggaggaagatgactatctctttgatgatcctctgccaatacctttaaggcacaaagttccatacccggaaacttttcaccctgaggtattttcaatgactgcagtatcagaaaagcagcctgaaaaactgagacaaaccccaggatgctgcagagcagagtgtatgcagagctctcgtttcacaaactttgtagattgtgaagaatccaacagtgaaagtgaagaagaagtaggaatcccagcttcactgcaaggagatctgggctctgtacttcacctgcaaaaggctgatggggatgtaccccagtgggaagtattctttaaaagaaatgatgaaatcacagatgagagtttggaaaacttcccttcctccacagtggcagggggatctcagtcaccaaagcttttcagtgactctgatggagaatcaactcacatctcctcccagaattcttcccagtcaacacacataacagaacaaggaagtcaaggctgggacagccaatctgatactgttttgttatcttcccaagagagaaacagtggggatattacttccttggacaaagctgactacagaccaacaatcaaagagaatattcctgcctctctcatggaacaaaatgtaatttgcccaaaggatacttactctgatttgaaaagcagagataaagatgtgacaatagttcctagtactggagaaccaactactctaagcagtgagacacatatacccgaggaaaaaagtttgctaaatcttagcacaaatgcagattcccagagctcttctgattttgaagttccctcaactccagaagctgagttacctaaacgagagcatttacaatatttatatgagaagctggcaactggtgagagtatagcagtcaaaaaaagaaaatgctcactcttagatacctaagaattcaaagcgtttcaacctagagcaaccactaaaaaacctgcacagagatgacagtcaatattacaatagagaaaatacagtacttaaaaatgttcaaataacctggttgggtgtggtggctcacacttgtaatcccagcactttgaggtgggcaatggcttgagcccaggagttcgacaccagcctggccaacacagtgaaatgtgtctctacttacaaaaaaaaaaaaaaaaaaaaaagccaggcatggtggtgggctactctggaggcccttgaggatcacttgagcccaggagattgaggctgcagtgagccatgactgtgccactgcacctctagtctgggtgacagagcaagaccctgtttaaaaaagaaaaaggccaggcacggtggctcatgcctgtaatcccagctacgcaggaggccaaggcaggagaatcacttgaacctgggaggtggtggttgcagtgagctgagattgtgtcattgcactccagcctgggcaacaagagcaaaactctgtctc

SEQ ID NO: 1403 - DNA, 2246 bp, Homo sapiens
gcggttttggggtcccggactctgggatcggcggcgctatgagttctttcgaggggcagatggccgagtatccaactatctccatagaccgcttcgatagggagaacctgagggcccgcgcctacttcctgtcccactgccacaaagcttgaaggtttatctatactgttcacctgtgactaaggagttgttgttaacgagcccgaaatacagattttggaagaaacgaattatatctattgaaatcgagactcctacccagatatctttagtggatgaagcatcaggagaggtttttatttcagggcaataatggaactgtcctgtacacaggagacttcagattggcgcaaggagaagctgctagaatggagcttctgcactccgggggcagagtcaaagacatccaaagtgtatatttggatactacgttctgtgatccaagattttaccaaattccaagtcgggaggagtgtttaagtggagtcttagagctggtccgaagctggatcactcggagcccgtaccatgttgtgtggctgaactgcaaagcggcttatggctatgaatatctgttcaccaaccttagtgaagaattaggagtccaggttcatgtgaataagctagacatgtttaggaacatgcctgagatccttcatcatctcacaacagaccgcaacactcagatccatgcatgccggcatcccaaggcagaggaatattttcagtggagcaaattaccctgtggaattacttccagaaatagaattccactccacataatcagcattaagccatccaccatgtggtttggagaaaggagcagaaaaacaaatgtaattgtgaggactggagagagttcatacagagcttgtttttcttttcactcctcctacagtgagattaaagatttcttgagctacctctgtcctgtgaacgcatatccaaatgtcattccagttggcacaactatggataaagttgtcgaaatcttaaagcctttatgccggtcttcccaaagtacggagccaaagtataaaccactgggaaaactgaagagagctagaacagttcaccgagactcagaggaggaagatgactatctctttgatgatcctctgccaatacctttaaggcacaaagttccatacccggaaacttttcaccctgaggtattttcaatgactgcagtatcagaaaagcagcctgaaaaactgagacaaaccccaggatgctgcagagcagagtgtatgcagagctctcgtttcacaaactttgtagattgtgaagaatccaacagtgaaagtgaagaagaagtaggaatcccagcttcactgcaaggagatctgggctctgtacttcacctgcaaaaggctgatggggatgtaccccagtgggaagtattctttaaaagaaatgatgaaatcacagatgagagtttggaaaacttcccttcctccacagtggcagggggatctcagtcaccaaagcttttcagtgactctgatggagaatcaactcacatctcctcccagaattcttcccagtcaacacacataacagaacaaggaagtcaaggctgggacagccaatctgatactgttttgttatcttcccaagagagaaacagtggggatattacttccttggacaaagctgactacagaccaacaatcaaagagaatattcctgcctctctcatggaacaaaatgtaatttgcccaaaggatacttactctgatttgaaaagcagagataaagatgtgacaatagttcctagtactggagaaccaactactctaagcagtgagacacatatacccgaggaaaaaagtttgctaaatcttagcacaaatgcagattcccagagctcttctgattttgaagttccctcaactccagaagctgagttacctaaacgagagcatttacaatatttatatgagaagctggcaactggtgagagtatagcagtcaaaaaaagaaaatgctcactcttagatacctaagaattcaaagcgtttcaacctagagcaaccactaaaaaacctgcacagagatgacagtcaatattacaatagagaaaatacagtacttaaaaatgttcaaataacctggttgggtgtggtggctcacacttgtaatcccagcactttgaggtgggcaatggcttgagcccaggagttcgacaccagcctggccaacacagtgaaatgtgtctctacttacaaaaaaaaaaaaaaaaa

SEQ ID NO: 1404 - DNA, 2485 bp, Homo sapiens
gcggttttggggtcccggactctgggatcggcggcgctatgagttctttcgaggggcagatggccgagtatccaactatctccatagaccgcttcgatagggagaacctgagggcccgcgcctacttcctgtcccactgccacaaagatcacatgaaaggattaagagcccctaccttgaaaagaaggttggagtgcagacacacctgatcacatacaagcgcgtatttccaagtaacaatggtgagggaccactgttggaggaggtccagggacaccgtgtttccacccccaccttgtgctcttggtggcactgaaatggtgtgcatagcttgaaggtttatctatactgttcacctgtgactaaggagttgttgttaacgagcccgaaatacagattttggaagaaacgaattatatctattgaaatcgagactcctacccagatatctttagtggatgaagcatcaggagagaaggaagagattgttgtgactctcttaccagctggtcactgtccgggatcagttatgtttttatttcagggcaataatggaactgtcctgtacacaggagacttcagattggcgcaaggagaagctgctagaatggagcttctgcactccgggggcagagtcaaagacatccaaagtgtatatttggatactacgttctgtgatccaagattttaccaaattccaagtcgggaggagtgtttaagtggagtcttagagctggtccgaagctggatcactcggagcccgtaccatgttgtgtggctgaactgcaaagcggcttatggctatgaatatctgttcaccaaccttagtgaagaattaggagtccaggttcatgtgaataagctagacatgtttaggaacatgcctgagatccttcatcatctcacaacagaccgcaacactcagatccatgcatgccggcatcccaaggcagaggaatattttcagtggagcaaattaccctgtggaattacttccagaaatagaattccactccacataatcagcattaagccatccaccatgtggtttggagaaaggagcagaaaaacaaatgtaattgtgaggactggagagagttcatacagagcttgtttttcttttcactcctcctacagtgagattaaagatttcttgagctacctctgtcctgtgaacgcatatccaaatgtcattccagttggcacaactatggataaagttgtcgaaatcttaaagcctttatgccggtcttcccaaagtacggagccaaagtataaaccactgggaaaactgaagagagctagaacagttcaccgagactcagaggaggaagatgactatctctttgatgatcctctgccaatacctttaaggcacaaagttccatacccggaaacttttcaccctgaggtattttcaatgactgcagtatcagaaaagcagcctgaaaaactgagacaaaccccaggatgctgcagagcagagtgtatgcagagctctcgtttcacaaactttgtagattgtgaagaatccaacagtgaaagtgaagaagaagtaggaatcccagcttcactgcaaggagatctgggctctgtacttcacctgcaaaaggctgatggggatgtaccccagtgggaagtattctttaaaagaaatgatgaaatcacagatgagagtttggaaaacttcccttcctccacagtggcagggggatctcagtcaccaaagcttttcagtgactctgatggagaatcaactcacatctcctcccagaattcttcccagtcaacacacataacagaacaaggaagtcaaggctgggacagccaatctgatactgttttgttatcttcccaagagagaaacagtggggatattacttccttggacaaagctgactacagaccaacaatcaaagagaatattcctgcctctctcatggaacaaaatgtaatttgcccaaaggatacttactctgatttgaaaagcagagataaagatgtgacaatagttcctagtactggagaaccaactactctaagcagtgagacacatatacccgaggaaaaaagtttgctaaatcttagcacaaatgcagattcccagagctcttctgattttgaagttccctcaactccagaagctgagttacctaaacgagagcatttacaatatttatatgagaagctggcaactggtgagagtatagcagtcaaaaaaagaaaatgctcactcttagatacctaagaattcaaagcgtttcaacctagagcaaccactaaaaaacctgcacagagatgacagtcaatattacaatagagaaaatacagtacttaaaaatgttcaaataacctggttgggtgtggtggctcacacttgtaatcccagcactttgaggtgggcaatggcttgagcccaggagttcgacaccagcctggccaacacagtgaaatgtgtctctacttacaaaaaaaaaaaaaaaaa

SEQ ID NO: 1405 - DNA, 2807 bp, Homo sapiens
gcggttttggggtcccggactctgggatcggcggcgctatgagttctttcgaggggcagatggccgagtatccaactatctccatagaccgcttcgatagggagaacctgagggcccgcgcctacttcctgtcccactgccacaaagatcacatgaaaggattaagagcccctaccttgaaaagaaggttggagtgcagacacacctgatcacatacaagcgcgtatttccaagtaacaatggtgagggaccactgttggaggaggtccagggacaccgtgtttccacccccaccttgtgctcttggtggcactgaaatggtgtgcatagcttgaaggtttatctatactgttcacctgtgactaaggagttgttgttaacgagcccgaaatacagattttggaagaaacgaattagcagtcacaacagcagggttgttcctgttgtctctggcattcagcttgaagttactacaggtcagcccggccagcagtcaggaaggaaagctggaagagaagtggaggggaacagagacaaactggaaggcagaatggcccactaggacagaccgaaacccacttctgtctctcacttcctctggcctcaatagtgctggtctcccgctttggctctgaagcacatgcacctgccccaggactcggaggagctgcacacgggcacccagcagaagctgatgttgctgcggccctgccccagactctgagttaagccagaagatatctattgaaatcgagactcctacccagatatctttagtggatgaagcatcaggagagaaggaagagattgttgtgactctcttaccagctggtcactgtccgggatcagttatgtttttatttcagggcaataatggaactgtcctgtacacaggagacttcagattggcgcaaggagaagctgctagaatggagcttctgcactccgggggcagagtcaaagacatccaaagtgtatatttggatactacgttctgtgatccaagattttaccaaattccaagtcgggaggagtgtttaagtggagtcttagagctggtccgaagctggatcactcggagcccgtaccatgttgtgtggctgaactgcaaagcggcttatggctatgaatatctgttcaccaaccttagtgaagaattaggagtccaggttcatgtgaataagctagacatgtttaggaacatgcctgagatccttcatcatctcacaacagaccgcaacactcagatccatgcatgccggcatcccaaggcagaggaatattttcagtggagcaaattaccctgtggaattacttccagaaatagaattccactccacataatcagcattaagccatccaccatgtggtttggagaaaggagcagaaaaacaaatgtaattgtgaggactggagagagttcatacagagcttgtttttcttttcactcctcctacagtgagattaaagatttcttgagctacctctgtcctgtgaacgcatatccaaatgtcattccagttggcacaactatggataaagttgtcgaaatcttaaagcctttatgccggtcttcccaaagtacggagccaaagtataaaccactgggaaaactgaagagagctagaacagttcaccgagactcagaggaggaagatgactatctctttgatgatcctctgccaatacctttaaggcacaaagttccatacccggaaacttttcaccctgaggtattttcaatgactgcagtatcagaaaagcagcctgaaaaactgagacaaaccccaggatgctgcagagcagagtgtatgcagagctctcgtttcacaaactttgtagattgtgaagaatccaacagtgaaagtgaagaagaagtaggaatcccagcttcactgcaaggagatctgggctctgtacttcacctgcaaaaggctgatggggatgtaccccagtgggaagtattctttaaaagaaatgatgaaatcacagatgagagtttggaaaacttcccttcctccacagtggcagggggatctcagtcaccaaagcttttcagtgactctgatggagaatcaactcacatctcctcccagaattcttcccagtcaacacacataacagaacaaggaagtcaaggctgggacagccaatctgatactgttttgttatcttcccaagagagaaacagtggggatattacttccttggacaaagctgactacagaccaacaatcaaagagaatattcctgcctctctcatggaacaaaatgtaatttgcccaaaggatacttactctgatttgaaaagcagagataaagatgtgacaatagttcctagtactggagaaccaactactctaagcagtgagacacatatacccgaggaaaaaagtttgctaaatcttagcacaaatgcagattcccagagctcttctgattttgaagttccctcaactccagaagctgagttacctaaacgagagcatttacaatatttatatgagaagctggcaactggtgagagtatagcagtcaaaaaaagaaaatgctcactcttagatacctaagaattcaaagcgtttcaacctagagcaaccactaaaaaacctgcacagagatgacagtcaatattacaatagagaaaatacagtacttaaaaatgttcaaataacctggttgggtgtggtggctcacacttgtaatcccagcactttgaggtgggcaatggcttgagcccaggagttcgacaccagcctggccaacacagtgaaatgtgtctctacttacaaaaaaaaaaaaaaaaa

SEQ ID NO: 1406 - DNA, 2463 bp, Homo sapiens
tcagggctggccttggcttcagctgcggttttggggtcccggactctgggatcggcggcgctatgagttctttcgaggggcagatggccgagtatccaactatctccatagaccgcttcgatagggagaacctgagggcccgcgcctacttcctgtcccactgccacaaagatcacatgaaaggattaagagcccctaccttgaaaagaaggttggagtgcagatgaggaaactgaggaaccagagaggttaaattagttgcccagtgtcacacagccagtaagtggcaggaccaggattccagccagcttgaaggtttatctatactgttcacctgtgactaaggagttgttgttaacgagcccgaaatacagattttggaagaaacgaattatatctattgaaatcgagactcctacccagatatctttagtggatgaagcatcaggagagaaggaagagattgttgtgactctcttaccagctggtcactgtccgggatcagttatgtttttatttcagggcaataatggaactgtcctgtacacaggagacttcagattggcgcaaggagaagctgctagaatggagcttctgcactccgggggcagagtcaaagacatccaaagtgtatatttggatactacgttctgtgatccaagattttaccaaattccaagtcgggaggagtgtttaagtggagtcttagagctggtccgaagctggatcactcggagcccgtaccatgttgtgtggctgaactgcaaagcggcttatggctatgaatatctgttcaccaaccttagtgaagaattaggagtccaggttcatgtgaataagctagacatgtttaggaacatgcctgagatccttcatcatctcacaacagaccgcaacactcagatccatgcatgccggcatcccaaggcagaggaatattttcagtggagcaaattaccctgtggaattacttccagaaatagaattccactccacataatcagcattaagccatccaccatgtggtttggagaaaggagcagaaaaacaaatgtaattgtgaggactggagagagttcatacagagcttgtttttcttttcactcctcctacagtgagattaaagatttcttgagctacctctgtcctgtgaacgcatatccaaatgtcattccagttggcacaactatggataaagttgtcgaaatcttaaagcctttatgccggtcttcccaaagtacggagccaaagtataaaccactgggaaaactgaagagagctagaacagttcaccgagactcagaggaggaagatgactatctctttgatgatcctctgccaatacctttaaggcacaaagttccatacccggaaacttttcaccctgaggtattttcaatgactgcagtatcagaaaagcagcctgaaaaactgagacaaaccccaggatgctgcagagcagagtgtatgcagagctctcgtttcacaaactttgtagattgtgaagaatccaacagtgaaagtgaagaagaagtaggaatcccagcttcactgcaaggagatctgggctctgtacttcacctgcaaaaggctgatggggatgtaccccagtgggaagtattctttaaaagaaatgatgaaatcacagatgagagtttggaaaacttcccttcctccacagtggcagggggatctcagtcaccaaagcttttcagtgactctgatggagaatcaactcacatctcctcccagaattcttcccagtcaacacacataacagaacaaggaagtcaaggctgggacagccaatctgatactgttttgttatcttcccaagagagaaacagtggggatattacttccttggacaaagctgactacagaccaacaatcaaagagaatattcctgcctctctcatggaacaaaatgtaatttgcccaaaggatacttactctgatttgaaaagcagagataaagatgtgacaatagttcctagtactggagaaccaactactctaagcagtgagacacatatacccgaggaaaaaagtttgctaaatcttagcacaaatgcagattcccagagctcttctgattttgaagttccctcaactccagaagctgagttacctaaacgagagcatttacaatatttatatgagaagctggcaactggtgagagtatagcagtcaaaaaaagaaaatgctcactcttagatacctaagaattcaaagcgtttcaacctagagcaaccactaaaaaacctgcacagagatgacagtcaatattacaatagagaaaatacagtacttaaaaatgttcaaataacctggttgggtgtggtggctcacacttgtaatcccagcactttgaggtgggcaatggcttgagcccaggagttcgacaccagcctggccaacacagtgaaatgtgtctctacttacaaaaaaaaaaaaaaaaa

SEQ ID NO: 1407 - DNA, 2354 bp, Homo sapiens
gcggttttggggtcccggactctgggatcggcggcgctatgagttctttcgaggggcagatggccgagtatccaactatctccatagaccgcttcgatagggagaacctgagggcccgcgcctacttcctgtcccactgccacaaagatcacatgaaaggattaagagcccctaccttgaaaagaaggttggagtgcagcttgaaggtttatctatactgttcacctgtgactaaggagttgttgttaacgagcccgaaatacagattttggaagaaacgaattatatctattgaaatcgagactcctacccagatatctttagtggatgaagcatcaggagagaaggaagagattgttgtgactctcttaccagctggtcactgtccgggatcagttatgtttttatttcagggcaataatggaactgtcctgtacacaggagacttcagattggcgcaaggagaagctgctagaatggagcttctgcactccgggggcagagtcaaagacatccaaagtgtatatttggatactacgttctgtgatccaagattttaccaaattccaagtcgggaggagtgtttaagtggagtcttagagctggtccgaagctggatcactcggagcccgtaccatgttgtgtggctgaactgcaaagcggcttatggctatgaatatctgttcaccaaccttagtgaagaattaggagtccaggttcatgtgaataagctagacatgtttaggaacatgcctgagatccttcatcatctcacaacagaccgcaacactcagatccatgcatgccggcatcccaaggcagaggaatattttcagtggagcaaattaccctgtggaattacttccagaaatagaattccactccacataatcagcattaagccatccaccatgtggtttggagaaaggagcagaaaaacaaatgtaattgtgaggactggagagagttcatacagagcttgtttttcttttcactcctcctacagtgagattaaagatttcttgagctacctctgtcctgtgaacgcatatccaaatgtcattccagttggcacaactatggataaagttgtcgaaatcttaaagcctttatgccggtcttcccaaagtacggagccaaagtataaaccactgggaaaactgaagagagctagaacagttcaccgagactcagaggaggaagatgactatctctttgatgatcctctgccaatacctttaaggcacaaagttccatacccggaaacttttcaccctgaggtattttcaatgactgcagtatcagaaaagcagcctgaaaaactgagacaaaccccaggatgctgcagagcagagtgtatgcagagctctcgtttcacaaactttgtagattgtgaagaatccaacagtgaaagtgaagaagaagtaggaatcccagcttcactgcaaggagatctgggctctgtacttcacctgcaaaaggctgatggggatgtaccccagtgggaagtattctttaaaagaaatgatgaaatcacagatgagagtttggaaaacttcccttcctccacagtggcagggggatctcagtcaccaaagcttttcagtgactctgatggagaatcaactcacatctcctcccagaattcttcccagtcaacacacataacagaacaaggaagtcaaggctgggacagccaatctgatactgttttgttatcttcccaagagagaaacagtggggatattacttccttggacaaagctgactacagaccaacaatcaaagagaatattcctgcctctctcatggaacaaaatgtaatttgcccaaaggatacttactctgatttgaaaagcagagataaagatgtgacaatagttcctagtactggagaaccaactactctaagcagtgagacacatatacccgaggaaaaaagtttgctaaatcttagcacaaatgcagattcccagagctcttctgattttgaagttccctcaactccagaagctgagttacctaaacgagagcatttacaatatttatatgagaagctggcaactggtgagagtatagcagtcaaaaaaagaaaatgctcactcttagatacctaagaattcaaagcgtttcaacctagagcaaccactaaaaaacctgcacagagatgacagtcaatattacaatagagaaaatacagtacttaaaaatgttcaaataacctggttgggtgtggtggctcacacttgtaatcccagcactttgaggtgggcaatggcttgagcccaggagttcgacaccagcctggccaacacagtgaaatgtgtctctacttacaaaaaaaaaaaaaaaaa

SEQ ID NO: 1408 - DNA, 3532 bp, Homo sapiens
cggaacgaagaatgatttctaagcgcagttccgcagcccactcacctcgtcggctggggccacctgctctgggagtttcgatttcccttcccgcgactgcacctccacagacatgggcaacgccttaccagagcaacacctgtgtttgttgggcgggaatgagccttgcactgggcagggctcagggcccatcgcgtgcagcgaagcgcgggtgatttaaacccaagcagcgggcgcctagaacccgaccggatgctccttgactttgcccccggtctccggactcctctgattggacgtggctgcgttcggccgcccaatggcgaggcagcgcgcggcttcccggaagtggcggcgcggtcagggctggccttggcttcagctgcggttttggggtcccggactctgggatcggcggcgctatgagttctttcgaggggcagatggccgagtatccaactatctccatagaccgcttcgatagggagaacctgagggcccgcgcctacttcctgtcccactgccacaaagatcacatgaaaggattaagagcccctaccttgaaaagaaggttggagtgcagcttgaaggtttatctatactgttcacctgtgactaaggagttgttgttaacgagcccgaaatacagattttggaagaaacgaattatatctattgaaatcgagactcctacccagatatctttagtggatgaagcatcaggagagaaggaagagattgttgtgactctcttaccagctggtcactgtccgggatcagttatgtttttatttcagggcaataatggaactgtcctgtacacaggagacttcagattggcgcaaggagaagctgctagaatggagcttctgcactccgggggcagagtcaaagacatccaaagtgtatatttggatactacgttctgtgatccaagattttaccaaattccaagtcgggaggagtgtttaagtggagtcttagagctggtccgaagctggatcactcggagcccgtaccatgttgtgtggctgaactgcaaagcggcttatggctatgaatatctgttcaccaaccttagtgaagaattaggagtccaggttcatgtgaataagctagacatgtttaggaacatgcctgagatccttcatcatctcacaacagaccgcaacactcagatccatgcatgccggcatcccaaggcagaggaatattttcagtggagcaaattaccctgtggaattacttccagaaatagaattccactccacataatcagcattaagccatccaccatgtggtttggagaaaggagcagaaaaacaaatgtaattgtgaggactggagagagttcatacagagcttgtttttcttttcactcctcctacagtgagattaaagatttcttgagctacctctgtcctgtgaacgcatatccaaatgtcattccagttggcacaactatggataaagttgtcgaaatcttaaagcctttatgccggtcttcccaaagtacggagccaaagtataaaccactgggaaaactgaagagagctagaacagttcaccgagactcagggtctcactctgtcactcaggctagaatgcggtggtgccatcatgactccctgtatcctttaactcctgggatcaagcgatcttcctgcctcagcctcctgactagctggatcacaggtgcataccgccatgcccagctaatgatttagtttttatagagatgtggggtctcactatgttgcccacactggtctggaactcctgggctcaagtgagcctccagccttgacctccccaagtgctgggattaactgtaactggttgatttatgactttttaaacaggatttgagcagtacattggaacactgcattactttcattataattaggatgttcaaaaagctatacaactatagctctctacaggacacaactgaatgttaaggactaaatctgcaagtatatgctctaaatatgatccaggcacatttttcctataacttatatatatgcagttacaaatggaaaattgttaaaaatacaggggagaagctatgttaactttggaatggaaggttttgtttttgtagaatatgttattttcatgcaattctgtaagtctaagatcgtcatctacagttctgctcttaagaacacaagttttatgacacgctcggcttaagaaaccaaaagtgtctaaagtactttatgttaccaaccaaatttggctgctgcactcattaagaatgcaacttaaaaaattttggttaacaaaaagagtaatttgattatacaagatcttgtatactgaataatttataataatctaccactgtctaaaagtgtaagaatcaaaacagccatctaatttagtttcagaattatagatgaatacagataattataggtgacccaattccaactaaaaaatccagagttgacaactccagatatgtagccatgcttgtgtctttctagtcacagctcaacctacccttcagtttgaagcagtgtggtgccatggtgaagactactgattttagagctttgaatctcggttcttattactatgtgacctgtgtgaccttgggcaaggtactcaatttctctacaataatggacataacagtactacttctcaaaaaaaaaaaaaaaaaaaaaaaaaaaagaaacagtactacctcactgagttttggagaggattagtgaattaatacatcaagtgcttagaatagtatgtgacacacggcaaatactttttacatttatatatatatatacatatatatgatttgtatacaaataaatttgctagtatttgtatggtagttttgagaatggtcttcacagttcaaaagtaagttacagattatggatgcaataaatgcttgtgtatattttacaaaactcataaatatagtatctttcatgttgatccaaaatagagttctgccaactacatttaatcatatttggtcaaatagatgaagtaaattaaaactttcaagtttcaaagcagcatgtgttacatctgagtttcttcttaggacttttgggtaaaaacagttgtcatattttaaattttacaaatcctaggtttgactagtaggaatgtgtatttgttgaaagatgactatatcaatttgttttaacgtatattttttattcatataaaagttttttatttctaaatatgccagtgaactcttctcctaaatctgaataaatttctacatatctgcaaatgaaaatatcaaaatgtaccaagtatctcttaaagagataaaaaggtaattttccaaaagtataaaccttgcatgtccatcatttactacgtggcaaatgaaacatacctctccaacatattccatgacaaaactcattcttttaatcttcacaagggtctttacaccccagccacgtccattgctagttcgaaagatgcaaagcgaatactgtgtgcctttttgtacaatcctattgggacaatcaggaccacactgacaccttga

SEQ ID NO: 1409 - DNA, 2761 bp, Homo sapiens
gcggttttggggtcccggactctgggatcggcggcgctatgagttctttcgaggggcagatggccgagtatccaactatctccatagaccgcttcgatagggagaacctgagggcccgcgcctacttcctgtcccactgccacaaagatcacatgaaaggattaagagcccctaccttgaaaagaaggttggagtgcagatgaggaaactgaggaaccagagaggttaaattagttgcccagtgtcacacagccagtaagtggcaggaccaggattccagccagcttgaaggtttatctatactgttcacctgtgactaaggagttgttgttaacgagcccgaaatacagattttggaagaaacgaattagcagtcacaacagcagggttgttcctgttgtctctggcattcagcttgaagttactacaggtcagcccggccagcagtcaggaaggaaagctggaagagaagtggaggggaacagagacaaactggaaggcagaatggcccactaggacagaccgaaacccacttctgtctctcacttcctctggcctcaatagtgctggtctcccgctttggctctgaagcacatgcacctgccccaggactcggaggagctgcacacgggcacccagcagaagctgatgttgctgcggccctgccccagactctgagttaagccagaagatatctattgaaatcgagactcctacccagatatctttagtggatgaagcatcaggagagaaggaagagattgttgtgactctcttaccagctggtcactgtccgggatcagttatgtttttatttcagggcaataatggaactgtcctgtacacaggagacttcagattggcgcaaggagaagctgctagaatggagcttctgcactccgggggcagagtcaaagacatccaaagtgtatatttggatactacgttctgtgatccaagattttaccaaattccaagtcgggaggagtgtttaagtggagtcttagagctggtccgaagctggatcactcggagcccgtaccatgttgtgtggctgaactgcaaagcggcttatggctatgaatatctgttcaccaaccttagtgaagaattaggagtccaggttcatgtgaataagctagacatgtttaggaacatgcctgagatccttcatcatctcacaacagaccgcaacactcagatccatgcatgccggcatcccaaggcagaggaatattttcagtggagcaaattaccctgtggaattacttccagaaatagaattccactccacataatcagcattaagccatccaccatgtggtttggagaaaggagcagaaaaacaaatgtaattgtgaggactggagagagttcatacagagcttgtttttcttttcactcctcctacagtgagattaaagatttcttgagctacctctgtcctgtgaacgcatatccaaatgtcattccagttggcacaactatggataaagttgtcgaaatcttaaagcctttatgccggtcttcccaaagtacggagccaaagtataaaccactgggaaaactgaagagagctagaacagttcaccgagactcagaggaggaagatgactatctctttgatgatcctctgccaatacctttaaggcacaaagttccatacccggaaacttttcaccctgaggtattttcaatgactgcagtatcagaaaagcagcctgaaaaactgagacaaaccccaggatgctgcagagcagagtgtatgcagagctctcgtttcacaaactttgtagattgtgaagaatccaacagtgaaagtgaagaagaagtaggaatcccagcttcactgcaaggagatctgggctctgtacttcacctgcaaaaggctgatggggatgtaccccagtgggaagtattctttaaaagaaatgatgaaatcacagatgagagtttggaaaacttcccttcctccacagtggcagggggatctcagtcaccaaagcttttcagtgactctgatggagaatcaactcacatctcctcccagaattcttcccagtcaacacacataacagaacaaggaagtcaaggctgggacagccaatctgatactgttttgttatcttcccaagagagaaacagtggggatattacttccttggacaaagctgactacagaccaacaatcaaagagaatattcctgcctctctcatggaacaaaatgtaatttgcccaaaggatacttactctgatttgaaaagcagagataaagatgtgacaatagttcctagtactggagaaccaactactctaagcagtgagacacatatacccgaggaaaaaagtttgctaaatcttagcacaaatgcagattcccagagctcttctgattttgaagttccctcaactccagaagctgagttacctaaacgagagcatttacaatatttatatgagaagctggcaactggtgagagtatagcagtcaaaaaaagaaaatgctcactcttagatacctaagaattcaaagcgtttcaacctagagcaaccactaaaaaacctgcacagagatgacagtcaatattacaatagagaaaatacagtacttaaaaatgttcaaataacctggttgggtgtggtggctcacacttgtaatcccagcactttgaggtgggcaatggcttgagcccaggagttcgacaccagcctggccaacacagtgaaatgtgtctctacttacaaaaaaaaaaaaaaaaa

SEQ ID NO: 1410 - DNA, 901 bp, Homo sapiens
gactctgggatcggcggcgctatgagttctttcgaggggcagatggccgagtatccaactatctccatagaccgcttcgatagggagaacctgagggcccgcgcctacttcctgtcccactgccacaaagatcacatgaaaggattaagagcccctaccttgaaaagaaggttggagtgcagacacacctgatcacatacaagcgcgtatttccaagtaacaatggtgagggaccactgttggaggaggtccagggacaccgtgtttccacccccaccttgtgctcttggtggcactgaaatggtgtgcatagcttgaaggtttatctatactgttcacctgtgactaaggagttgttgttaacgagcccgaaatacagattttggaagaaacgaattatatctattgaaatcgagactcctacccagatatctttagtggatgaagcatcaggagagaaggaagagattgttgtgactctcttaccagctggtcactgtccgggatcagttatgagacttcagattggcgcaaggagaagctgctagaatggagcttctgcactccgggggcagagtcaaagacatccaaagtgtatatttggatactacgttctgtgatccaagattttaccaaattccaagtcgggaggagtgtttaagtggagtcttagagctggtccgaagctggatcactcggagcccgtaccatgttgtgtggctgaactgcaaagcggcttatggctatgaatatctgttcaccaaccttagtgaagaattaggagtccaggttcatgtgaataagctagacatgtttaggaacatgcctgagatccttcatcatctcacaacagaccgcaacactcagatccatgcatgccggcatcccaaggcagaggaat

SEQ ID NO: 1411 - DNA, 3674 bp, Homo sapiens
gcttcccggaagtggcggcgcggtcagggctggccttggcttcagctgcggttttggggtcccggactctgggatcggcggcgctatgagttctttcgaggggcagatggccgagtatccaactatctccatagaccgcttcgatagggagaacctgagggcccgcgcctacttcctgtcccactgccacaaagatcacatgaaaggattaagagcccctaccttgaaaagaaggttggagtgcagcttgaaggtttatctatactgttcacctgtgactaaggagttgttgttaacgagcccgaaatacagattttggaagaaacgaattatatctattgaaatcgagactcctacccagatatctttagtggatgaagcatcaggagagaaggaagagattgttgtgactctcttaccagctggtcactgtccgggatcagttatgtttttatttcagggcaataatggaactgtcctgtacacaggagacttcagattggcgcaaggagaagctgctagaatggagcttctgcactccgggggcagagtcaaagacatccaaagtgtatatttggatactacgttctgtgatccaagattttaccaaattccaagtcgggaggagtgtttaagtggagtcttagagctggtccgaagctggatcactcggagcccgtaccatgttgtgtggctgaactgcaaagcggcttatggctatgaatatctgttcaccaaccttagtgaagaattaggagtccaggttcatgtgaataagctagacatgtttaggaacatgcctgagatccttcatcatctcacaacagaccgcaacactcagatccatgcatgccggcatcccaaggcagaggaatattttcagtggagcaaattaccctgtggaattacttccagaaatagaattccactccacataatcagcattaagccatccaccatgtggtttggagaaaggagcagaaaaacaaatgtaattgtgaggactggagagagttcatacagagcttgtttttcttttcactcctcctacagtgagattaaagatttcttgagctacctctgtcctgtgaacgcatatccaaatgtcattccagttggcacaactatggataaagttgtcgaaatcttaaagcctttatgccggtcttcccaaagtacggagccaaagtataaaccactgggaaaactgaagagagctagaacagttcaccgagactcagaggaggaagatgactatctctttgatgatcctctgccaatacctttaaggcacaaagttccatacccggaaacttttcaccctgaggtattttcaatgactgcagtatcagaaaagcagcctgaaaaactgagacaaaccccaggatgctgcagagcagagtgtatgcagagctctcgtttcacaaactttgtagattgtgaagaatccaacagtgaaagtgaagaagaagtaggaatcccagcttcactgcaaggagatctgggctctgtacttcacctgcaaaaggctgatggggatgtaccccagtgggaagtattctttaaaagaaatgatgaaatcacagatgagagtttggaaaacttcccttcctccacagtggcagggggatctcagtcaccaaagcttttcagtgactctgatggagaatcaactcacatctcctcccagaattcttcccagtcaacacacataacagaacaaggaagtcaaggctgggacagccaatctgatactgttttgttatcttcccaagagagaaacagtggggatattacttccttggacaaagctgactacagaccaacaatcaaagagaatattcctgcctctctcatggaacaaaatgtaatttgcccaaaggatacttactctgatttgaaaagcagagataaagatgtgacaatagttcctagtactggagaaccaactactctaagcagtgagacacatatacccgaggaaaaaagtttgctaaatcttagcacaaatgcagattcccagagctcttctgattttgaagttccctcaactccagaagctgagttacctaaacgagagcatttacaatatttatatgagaagctggcaactggtgagagtatagcagtcaaaaaaagaaaatgctcactcttagatacctaagaattcaaagcgtttcaacctagagcaaccactaaaaaacctgcacagagatgacagtcaatattacaatagagaaaatacagtacttaaaaatgttcaaataacctggttgggtgtggtggctcacacttgtaatcccagcactttgaggtgggcaatggcttgagcccaggagttcgacaccagcctggccaacacagtgaaatgtgtctctacttacaaaaaaaaaaaaaaaaaaaaaagccaggcatggtggtgggctactctggaggcccttgaggatcacttgagcccaggagattgaggctgcagtgagccatgactgtgccactgcacctctagtctgggtgacagagcaagaccctgtttaaaaaagaaaaaggccaggcacggtggctcatgcctgtaatcccagctacgcaggaggccaaggcaggagaatcacttgaacctgggaggtggtggttgcagtgagctgagattgtgtcattgcactccagcctgggcaacaagagcaaaactctgtctcaaaaaaaaaaaaaaaaaaaaagaaaaaaaaatggtagaactaaacccatacgtatcaatgattacattaaatgtaaatggtctaagtgcatcaatgacaagagacacggaaaaaaccaacataacccagtgatctgctgtctataaagaaagtcaattcaagtgattgataggttaaaaggatggaaaaaccatgtaaacaattaaaaatggagtggttatatggacagtttcctaatgataaaaggtctagttcaccaagaagacaaaataatcctaaacgtatatgcacctaacagctccaaaaatttatgaagctagaacagctgaaaagagacaaactaatgcacaattacagctagggattaatttaacatccctccttagtaacagaactagtatatacacattaatcagtaagaatatagaactgaaaatcataagccgactggattaaattgacatttatagaacacaccaccccaaactagcagaatgtatctcctgaagtacacatggaacattcagcatgatcatatctttgctcataaacacacctgatttaaattgacaaacttggatctagtatgataaactgatggctatagacaaaatcagcaccttatttatccccaaagatgttaagtcacttaaccttgatgtgaatacggtggccaaattagaagcggacaattagaatataaaagaaaatgctcaagaattaaatggtggccaggcacagtaactcctgcctgcaatcccagtactttgggaggctcgcttgagctcagggttttgagtccagcctgggcaacacacagggagaccctgtctccacaaaatgttagccagacatggtggtgtgcacctgtagtcctcgctacttggaaggcttaggtggcaggatggattgagcccaggaggttgaaactgcagtgagctgattgtgcccagcctgggcaacaaagcaagaccccatctc

SEQ ID NO: 1412 - DNA, 877 bp, Homo sapiens
ggcggcgctatgagttctttcgaggggcagatggccgagtatccaactatctccatagaccgcttcgatagggagaacctgagggcccgcgcctacttcctgtcccactgccacaaagatcacatgaaaggattaagagcccctaccttgaaaagaaggttggagtgcagatgaggaaactgaggaaccagagaggttaaattagttgcccagtgtcacacagccagtaagtggcaggaccaggattccagccagcttgaaggtttatctatactgttcacctgtgactaaggagttgttgttaacgagcccgaaatacagattttggaagaaacgaattagcagtcacaacagcagggttgttcctgttgtctctggcattcagcttgaagttactacaggtcagcccggccagcagtcaggaaggaaagctggaagagaagtggaggggaacagagacaaactggaaggcagaatggcccactaggacagaccgaaacccacttctgtctctcacttcctctggcctcaatagtgctggtctcccgctttggctctgaagcacatgcacctgccccaggactcggaggagctgcacacgggcacccagcagaagctgatgttgctgcggccctgccccagactctgagttaagccagaagatatctattgaaatcgagactcctacccagatatctttagtggatgaagcatcaggagaggtttttatttcagggcaataatggaactgtcctgtacacaggagacttcagattggcgcaaggagaagctgctagaatggagcttctgcactccgggggcagagtcaaagacatccaaagtgtatatttggatactacgttctgtgatccaagat

SEQ ID NO: 1413 - DNA, 1403 bp, Homo sapiens
cgaaggtgggcaggtcccaccttgtggaggatggaggtgaccggggacgccggggtaccagaatctggcgagatccggactctaaagccgtgtctgctgcgccgcaactacagccgcgaacagcacggcgtggccgcctcctgcctcgaagacctgaggagcaaggcctgtgacattctggccattgataagtccctgacaccagtcaccctggtcctggcagaggatggcaccatagtggatgatgacgattactttctgtgtctaccttccaatactaagtttgtggcattggctagtaatgagaaatgggcatacaacaattcagatggaggtacagcttggatttcccaagagtcctttgatgtagatgaaacagacagcggggcagggttgaagtggaagaatgtggccaggcagctgaaagaagatctgtccagcatcatcctcctatcagaggaggacctccagatgcttgttgacgctccctgctcagacctggctcaggaactacgtcagagttgtgccaccgtccagcggctgcagcacacactccaacaggtgcttgaccaaagagaggaagtgcgtcagtccaagcagctcctgcagctgtacctccaggctttggagaaagagggcagcctcttgtcaaagcaggaagagtccaaagctgcctttggtgaggaggtggatgcagtagacacgggtatcagcagagagacctcctcggacgttgcgctggcgagccacatccttactgcactgagggagaagcaggctccagagctgagcttatctagtcaggatttggaggtgggcggaaaccagggtcactgagctacagaggaggacatgccctgggatgtagtagtatcatgcagaggtgtgtgggcccttttgttcacctctgcagactgtgaatcctagctgccagtttgcctattatatgccaaggcatttgcaaaaatctcattaatctaaatcaaaatagctttaaagaaaaatgcatacacttcctcagatcatcaaacagactctggtccaaggttggtaatgaaatgactgttcctgacagggaggaatagcagggcccaatcttctgagatggcttctgggtctttccatggtcagagaagatctatagtccgtcctgaggtctgtcaatgtcacaggaaaaggcaaacttgaggggatcgtcgcctgctggctaagaccagggagctaaaaacttgaggaagggaacctgcctgggtgggtgctacttctgattcattgtccttgtccctgtcataagtacctccctattgtagatagaagggaaggaaactgttgacttgagcttggctaaatttcctgaaggtggaggaccttagagttgctccaagtaaactttccaaggactt

SEQ ID NO: 1414 - DNA, 6032 bp, Homo sapiens
gagtagaaggaccgccgctccggcctcccgcgacttctcgaaggtgggcaggtcccaccttgtggaggatggaggtgaccggggacgccggggtaccagaatctggcgagatccggactctaaagccgtgtctgctgcgccgcaactacagccgcgaacagcacggcgtggccgcctcctgcctcgaagacctgaggagcaaggcctgtgacattctggccattgataagtccctgacaccagtcaccctggtcctggcagaggatggcaccatagtggatgatgacgattactttctgtgtctaccttccaatactaagtttgtggcattggctagtaatgagaaatgggcatacaacaattcagatggaggtacagcttggatttcccaagagtcctttgatgtagatgaaacagacagcggggcagggttgaagtggaagaatgtggccaggcagctgaaagaagatctgtccagcatcatcctcctatcagaggaggacctccagatgcttgttgacgctccctgctcagacctggctcaggaactacgtcagagttgtgccaccgtccagcggctgcagcacacactccaacaggtgcttgaccaaagagaggaagtgcgtcagtccaagcagctcctgcagctgtacctccaggctttggagaaagagggcagcctcttgtcaaagcaggaagagtccaaagctgcctttggtgaggaggtggatgcagtagacacgggtatcagcagagagacctcctcggacgttgcgctggcgagccacatccttactgcactgagggagaagcaggctccagagctgagcttatctagtcaggatttggagttggttaccaaggaagaccccaaagcactggctgttgccttgaactgggacataaagaagacggagactgttcaggaggcctgtgagcgggagctcgccctgcgcctgcagcagacgcagagcttgcattctctccggagcatctcagcaagcaaggcctcaccacctggtgacctgcagaatcctaagcgagccagacaggatcccacatagcagcagcgggaagtgtgccaaggaagctctgtggcgttgtgttattggtagacaccctcagcctcatcatttgactacctatgtactactctaccccctgccttagagcaccttccagagaagctattccaggtctcaacatacgccgttccaccaattttttttttagccccaccagcttcaggacttctgccaattttgaatgatatagctgcaccaacaatatcccgcctcctctaattacatatgatgttctctgttcaaaagtaattggcagtgattggccaggcgcagtggctcacgcctgtaatcccagcactgggaggccgaggggggcggatcgtgaagtcaggagatcgagaccatcctggctaacatggtgaaaccctgtctctactaaaaatacaaaaaaaattagccagccatggtggcgggcgcctgtaatcccagctacttgggaggctgaggcaggagaatggcatgaacctgggaggcagagcttgcagtgagctgagattgcgccactgcactccagcctgggcaacagagcgagactccgtctcaaaaaaaaaaaaaaaaaaagtaattggcagtgactatgggcgcactgcctaacatttagccctgccccatatggaacatgttaaaaaaaaaaaaagccaggccgagcgtgttggctcacgcttgtaatcccagcactttgggaggccgaggcgggtggatcacgaggtcaggagatcgagaccatcctggctaacacagtgaaacgtgtttttactaaaagtacaaaaaactagctgggcgtggtggcaggagcctgtagtcccagctactcgggaggctgaggcaggagaattgcttgaaccggggaggcagaagttgcagtgagccgagattatgccactgtactccagcctgggtgacagagtgacactctgtctcaaaaaaaaaaaaaaaaaggacaggcacgacagtggctcacacctttgatcccagcactttggaggccgatgcaggcggatcacatgaggtcaggagttcaagaccaacctggccaatatggtgaaaccccgtctctactaaaaatacaaaaattagctgggcatgatggcgggtgcctgtaatcccagctactcggtaggcagaggttgcagtgagctgagagcgcaccactgcactccagcctgggtgacagagctagactccgtatctcaagaaaaaaaaaaagttttgttttgtttttttgagacagagtctcactctgtcacctagtctggagtgcagtggcacattctcggctcactgcaacccccacctcccaggttcaagcgattctcctgtttcagcctcctgagcagctgggattacaggcacgtgccaccatgcccggctaatttttgtatttttagtagagacagggttttgtcacattggccaggctggtctcaaactcctgacctcaggtgatccacccacctcagcctcccaaagtgctgggattacaggtgtgagccaccacccctggccagaaaaaaaagcttttaaataaagtaattgtcagcttaggcaacatagcaagaccctgtctctacaaaaaaaaaatttaagttagccaggcatggtggcactgacctataatcctagctactctggaggctaaggcgagagtatcacttgagcccaggagctcaaggctgatcatgccaccatactccagcctggatgatagagtaagaccctacttttttttttttttttttaaaaaggtaaccatcaagggcaatgaaaagaaatggtcgtatttccaattcattatccttattctgaagatagtacggcagaattttaagcagagatagtggtgaagatggtgacattatagagtgttgactatggccacaatcttgtttctccagttaatgaatttttttatgtgtttgtttaaagatacatattaagcttgtagaccatagggacatacggagagtccattgctaatatctcactcagtattgtgaaattctatctcaccaccgtgaaactcttcagttttctaattgctttatcagcagggggtataaaaggtcatgaaagcaatttccacatgctgtggctccaggtctctgggtgtgaagcagagcaagcctggtttgtcctcctcctgtctccacacagacggcttctgcaggtttggtaatctacagtacactccttgcagggaaaaggtgatgagtcatcatggacttatttgaccactttttatgcatgcttagaggaaaacagaatactgttaagagattcatctgctagttattaagtaaagaaatatcacaataggccgggcgcagtggctcacacctgtaatcccagcattttgggaggccaaggtgggcggatcacctgaggtcaggagttcgagaccagcctagccaacatggtgaaaccccgtctctactgaaattataaaaaattagccgggtgtagtggtacacgcctgtagtcccagttacttgggaggctgaggcatgagaattgcttgaacccaggaagtggaggtggaggtgagccgaaattgtgccactgtactccagcctgcaacagagtgagacactgtcacacaaaaaagaaagaaatatcacaatatgtcacaataggccgggcgcagtggctcacacctgcagtcccagcactttgggaggccaaggcagatggatcacctgaggtcaggagtttgagaccagcctggccaacgtgacaaaacccagtctactaaaaatacaaaaattagccaggcgtgatggtgggcacctgtaatcccagctactcaggaggctgagacatgagaatcgcttgaacccaggaggtggagattgcactgagctgagatcctgccactgggctccagcctgggtgacagaatgagactctgtctttaaaaaaaaaaaaaaaagaaaatcacaataagtcctagggtaaagatgggggtacagaaaacaattaaatagaacaaaaacaactgtttccttttcctgtgattcaagaagggcttagatcttctactcagcatccttttactaatgccctccattggctctcaccccaacatttccttttttatagcttattttgtaatgcctccttaattatcctttaatagaagccaccgctgataagctacctacactcatacagaagcattaatataatgccccagatgtactgtttcagggcaaaaaggaaaataatttccaacaaagtggtgtgtgtttcactgtcagatgcttgcacttacacacggaatcgctgtgcatccgacagaggctgattggcacatggggcacggggattgtcagctcaaacaccgtcagcagcgttgcccttggaaatgggatttcccagaacagtaaacgtgtctgtccttgatttacagagtagctacattcctaggaaatccagggtacattaaaactcaccatgttacccaggctggtctcaaactccaggcctcaagcaatcctcccacatcagcttcccagaattttgggattacaggcatgagccaccacacccagccagaatattttatttctgttagacacacagagcgttcgttgactcgtctgggcgttagtgttaatattctgtacttgaagcaagcccaccaagcggctgaactgggtggataatggaaaatgtcctgtggatttgggagtgagacaaaccggcttgagtctaacctctcagttagtctaaggctccaagcttgaaagggttaaatgaagtactatatttgttttgtttcgttttcgttttgtttgaggctttgctctgttgcccaggctggagtgtagtggcacaatctctgctcactgcaacctccatctcccaggttcaggcgattctcttgcctcagcctccagagtagctgggattacaggtgcccgccaccacacccggctaagttttttttggtatttttagtagacacagggtttcaccatgttggctagactggtctcaaactcctgacctcaagtgatccacctgccttggcctcccaaagtgctgggagtataggtggtgagccaccacgcctggcctaaatgaagtaccacatgaccgacagaccgacctggggaacatagcaagaccccatctctacaaaaatgtaaaaaataaaaattagccgggtgtagtggtacatgcctgtaatcctagatactcgggaggctaaggcagaaggatcacttgagcccaggagttcgaggctacaatgagctgtgatcgtgccactgcactccatcctgggtggcagagtgaggccctgtctcaaaataaataatccagtcccccccaagaaaggaatgaagtgctataatgagaaaaatcctagtacctaacatatagtagacagtggagagtggttctctttcgtttctcaggggcagacagatggggtgctggagtcctctatcaaagagtcagagctctatcccagatgtgtaatgaacgtggtcacagacatattgtcccattaccatttaccttccctataaccactgtgcctccagccttgtagaatagacacataggagcgcagcaatacgtctaaaaataggagtgagagagggcagggcatgcccgttcttgtggtagaagaaaagaatgtcaaagaaagcagctgggactaatgaactttacattagccatattccattatttcagcttaagtcaaatgtcggtcctcatgaggcaactggctttgacaggagctacgctaattaccacttaccaacctttaatttctgggtaaaagcaaaagagaaaaactaatggatttttcattttccagagagacaagaataaaataatagtagtctgtagaaaaaagaaaacctgcatcaattacaagaattattaatgtatctttaataaataaccacattatttagctgtttaatttcctaa

SEQ ID NO: 1415 - DNA, 906 bp, Homo sapiens
gaggtcagagacttaagtctaaggcactgagcgtatcatgttaaagatgagcgggtggcagcgacagagccaaaatcagagctggaacctgaggagagagtgttcaagaaggaagtgtatcttcatacatcaccacacctgaaagcagatgtgcttttccagactgatccaactgcagagatggcagctgagtcattgcctttctccttcgggacactgtccagctgggagctggaagcctggtatgaggacctgcaagaggtcctgtcttcagatgaaaatgggggtacctatgtttcacctcctggaaatgaagaggaagaatcaaaaatcttcaccactcttgaccctgcttctctggcttggctgactgaggaggagccagaaccagcagaggtcacaagcacctcccagagccctcactctccagattccagtcagagctccctggctcaggaggaagaggaggaagaccaagggagaaccaggaaacggaaacagagtggtcattccccagcccgggctggaaagcagcgcatgaaggagaaagaacaggagaatgaaaggaaagtggcacagctagctgaagagaatgaacggctcaagcaggaaatcgagcgcctgaccagggaagtagaggcgactcgccgagctctgattgaccgaatggtgaatctgcaccaagcatgaacaattgggagcatcagtcccccacttgggccacactacccacctttcccagaagtggctactgactaccctctcactagtgccaatgatgtgaccctcaatcccacatacgcagggggaaggcttggagtagacaaaaggaaaggtctcagcttgtatatagagattgtacatttatttattactgtccctatctattaaagtgactttctatga

SEQ ID NO: 1416 - DNA, 872 bp, Homo sapiens
actgagcgtatcatgttaaagatgagcgggtggcagcgacagagccaaaatcagagctggaacctgaggagagagtgttcaagaaggaagtgtatcttcatacatcaccacacctgaaagcagactgatccaactgcagagatggcagctgagtcattgcctttctccttcgggacactgtccagctgggagctggaagcctggtatgaggacctgcaagaggtcctgtcttcagatgaaaatgggggtacctatgtttcacctcctggaaatgaagaggaagaatcaaaaatcttcaccactcttgaccctgcttctctggcttggctgactgaggaggagccagaaccagcagaggtcacaagcacctcccagagccctcactctccagattccagtcagagctccctggctcaggaggaagaggaggaagaccaagggagaaccaggaaacggaaacagagtggtcattccccagcccgggctggaaagcagcgcatgaaggagaaagaacaggagaatgaaaggaaagtggcacagctagctgaagagaatgaacggctcaagcaggaaatcgagcgcctgaccagggaagtagaggcgactcgccgagctctgattgaccgaatggtgaatctgcaccaagcatgaacaattgggagcatcagtcccccacttgggccacactacccacctttcccagaagtggctactgactaccctctcactagtgccaatgatgtgaccctcaatcccacatacgcagggggaaggcttggagtagacaaaaggaaaggtctcagcttgtatatagagattgtacatttatttattactgtccctatctattaaagtgactttctatgagccaa

SEQ ID NO: 1417 - DNA, 644 bp, Homo sapiens
agagacttaagtctaaggcactgagcgtatcatgttaaagatgagcgggtggcagcgacagagccaaaatcagagctggaacctgaggagagagtgttcaagaaggaagtgtatcttcatacatcaccacacctgaaagcagtacaactttacctacaaaaacaggcatcagaccagcttgccaacttgtggcatagactgtttgctacatggagcttgttccagccactccccattatcctgcagatgtgcttttccagactgatccaactgcagagatggcagctgagtcattgcctttctccttcgggacactgtccagctgggagctggaagcctggtatgaggacctgcaagaggtcctgtcttcagatgaaaatgggggtacctatgtttcacctcctggaaatgaagaggaagaatcaaaaatcttcaccactcttgaccctgcttctctggcttggctgactgaggaggagccagaaccagcagaggtcacaagcacctcccagagccctcactctccagattccagtcagagctccctggctcaggaggaagaggaggaagaccaagggagaaccaggaaacggaaacagagtggtcattccccagcccgggctggaaagcagcgcatgaaggag

SEQ ID NO: 1418 - DNA, 1067 bp, Homo sapiens
gaggtcagagacttaagtctaaggcactgagcgtatcatgttaaagatgagcgggtggcagcgacagagccaaaatcagagctggaacctgaggagagagtgttcaagaaggaagtgtatcttcatacatcaccacacctgaaagcagcaccaaagcagccataaacaatatgtaaataaacagatgtggctgtattccagtacaactttacctacaaaaacaggcatcagaccagcttgccaacttgtggcatagactgtttgctacatggagcttgttccagccactccccattatcctgcagatgtgcttttccagactgatccaactgcagagatggcagctgagtcattgcctttctccttcgggacactgtccagctgggagctggaagcctggtatgaggacctgcaagaggtcctgtcttcagatgaaaatgggggtacctatgtttcacctcctggaaatgaagaggaagaatcaaaaatcttcaccactcttgaccctgcttctctggcttggctgactgaggaggagccagaaccagcagaggtcacaagcacctcccagagccctcactctccagattccagtcagagctccctggctcaggaggaagaggaggaagaccaagggagaaccaggaaacggaaacagagtggtcattccccagcccgggctggaaagcagcgcatgaaggagaaagaacaggagaatgaaaggaaagtggcacagctagctgaagagaatgaacggctcaagcaggaaatcgagcgcctgaccagggaagtagaggcgactcgccgagctctgattgaccgaatggtgaatctgcaccaagcatgaacaattgggagcatcagtcccccacttgggccacactacccacctttcccagaagtggctactgactaccctctcactagtgccaatgatgtgaccctcaatcccacatacgcagggggaaggcttggagtagacaaaaggaaaggtctcagcttgtatatagagattgtacatttatttattactgtccctatctattaaagtgactttctatgagcca

SEQ ID NO: 1419 - DNA, 951 bp, Homo sapiens
agagacttaagtctaaggcactgagcgtatcatgttaaagatgagcgggtggcagcgacagagccaaaatcagagctggaacctgaggagagagtgttcaagaaggaagtgtatcttcatacatcaccacacctgaaagcaggtaaacttaacctacccttttccaaaaattttaaacggcaggacagtaaatattttagatgttaaaagtcctatagtctctagcgtgactcttcatctctgccactgtagcaccaaagcagccataaacaatatgtaaataaacagatgtggctgtattccagtacaactttacctacaaaaacaggcatcagaccagcttgccaacttgtggcatagactgtttgctacatggagcttgttccagccactccccattatcctgcagatgtgcttttccagactgatccaactgcagagatggcagctgagtcattgcctttctccttcgggacactgtccagctgggagctggaagcctggtatgaggacctgcaagaggtcctgtcttcagatgaaaatgggggtacctatgtttcacctcctggaaatgaagaggaagaatcaaaaatcttcaccactcttgaccctgcttctctggcttggctgactgaggaggagccagaaccagcagaggtcacaagcacctcccagagccctcactctccagattccagtcagagctccctggctcaggaggaagaggaggaagaccaagggagaaccaggaaacggaaacagagtggtcattccccagcccgggctggaaagcagcgcatgaaggagaaagaacaggagaatgaaaggaaagtggcacagctagctgaagagaatgaacggctcaagcaggaaatcgagcgcctgaccagggaagtagaggcgactcgccgagctctgattgaccgaatggtgaatctgcaccaagcatga

SEQ ID NO: 1420 - DNA, 1161 bp, Homo sapiens
attccgcttccggcatctggctcagttccgccatggcctccttggaagtcagtcgtagtcctcgcaggtctcggcgggagctggaagtgcgcagtccacgacagaacaaatattcggtgcttttacctacctacaacgagcgcgagaacctgccgctcatcgtgtggctgctggtgaaaagcttctccgagagtggaatcaactatgaaattataatcatagatgatggaagcccagatggaacaagggatgttgctgaacagttggagaagatctatgggtcagacagaattcttctaagaccacgagagaaaaagttgggactaggaactgcatatattcatggaatgaaacatgccacaggaaactacatcattattatggatgctgatctctcacaccatccaaaatttattcctgaatttattaggaagcaaaaggagggtaattttgatattgtctctggaactcgctacaaaggaaatggaggtgtatatggctgggatttgaaaagaaaaataatcagtgatggagttttgccatgttgcccaggctggtcactcctgggctcaagtgatccagccatcttggcctcctgggattacagccgtggggccaattttttaactcagatcttgctgagaccaggagcatctgatttaacaggaagtttcagattataccgaaaagaagttctagagaaattaatagaaaaatgtgtttctaaaggctacgtcttccagatggagatgattgttcgggcaagacagttgaattatactattggcgaggttccaatatcatttgtggatcgtgtttatggtgaatccaagttgggaggaaatgaaatagtatctttcttgaaaggattattgactctttttgctactacataaaagaaagatactcatttatagttacgttcatttcaggttaaacatgaaagaagcctggttactgatttgtataaaatgtactcttaaagtataaaatataaggtaaggtaaatttcatgcatctttttatgaagaccacctattttatatttcaaattaaataattttaaagttgctggcctaatgagcaatgttctcaattttcgttttcattttgctgtattgagacctataaataaatgtatatttttttttgcataaagta

SEQ ID NO: 1421 - DNA, 956 bp, Homo sapiens
agttccgccatggcctccttggaagtcagtcgtagtcctcgcaggtctcggcgggagctggaagtgcgcagtccacgacagaacaaatattcggtgcttttacctacctacaacgagcgcgagaacctgccgctcatcgtgtggctgctggtgaaaagcttctccgagagtggaatcaactatgaaattataatcatagatgatggaagcccagatggaacaagggatgttgctgaacagttggagaagatctatgggtcagacagaattcttctaagaccacgagagaaaaagttgggactaggaactgcatatattcatggaatgaaacatgccacaggaaactacatcattattatggatgctgatctctcacaccatccaaaatttattcctgaatttattagtgatggagttttgccatgttgcccaggctggtcactcctgggctcaagtgatccagccatcttggcctcctgggattacagccgtggggccaattttttaactcagatcttgctgagaccaggagcatctgatttaacaggaagtttcagattataccgaaaagaagttctagagaaattaatagaaaaatgtgtttctaaaggctacgtcttccagatggagatgattgttcgggcaagacagttgaattatactattggcgaggttccaatatcatttgtggatcgtgtttatggtgaatccaagttgggaggaaatgaaatagtatctttcttgaaaggattattgactctttttgctactacataaaagaaagatactcatttatagttacgttcatttcaggttaaacatgaaagaagcctggttactgatttgtataaaatgtactcttaaagtataaaatataaggtaaggtaaatttcatgcatctttttatgaagaccacctattttatatttcaaattaaataattttaaagttgctgg

SEQ ID NO: 1422 - DNA, 1073 bp, Homo sapiens
ggcctccttggaagtcagtcgtagtcctcgcaggtctcggcgggagctggaagtgcgcagtccacgacagaacaaatattcggtgcttttacctacctacaacgagcgcgagaacctgccgctcatcgtgtggctgctggtgaaaagcttctccgagagtggaatcaactatgaaattataatcatagatgatggaagcccagatggaacaagggatgttgctgaacagttggagaagatctatgggtcagacagaattcttctaagaccacgagagaaaaagttgggactaggaactgcatatattcatggaatgaaacatgccacaggaaactacatcattattatggatgctgatctctcacaccatccaaaatttattcctgaatttattaggaagcaaaaggagggtaattttgatattgtctctggaactcgctacaaaggaaatggaggtgtatatggctgggatttgaaaagaaaaataatcagtgatggagttttgccatgttgcccaggctggtcactcctgggctcaagtgatccagccatcttggcctcctgggattacaggtgtgagccaccgcgcctagccagccgtggggccaattttttaactcagatcttgctgagaccaggagcatctgatttaacaggaagtttcagattataccgaaaagaagttctagagaaattaatagaaaaatgtgtttctaaaggctacgtcttccagatggagatgattgttcgggcaagacagttgaattatactattggcgaggttccaatatcatttgtggatcgtgtttatggtgaatccaagttgggaggaaatgaaatagtatctttcttgaaaggattattgactctttttgctactacataaaagaaagatactcatttatagttacgttcatttcaggttaaacatgaaagaagcctggttactgatttgtataaaatgtactcttaaagtataaaatataaggtaaggtaaatttcatgcatctttttatgaagaccacctattttatatttcaaattaaataattttaaagttgctggcctaatga

SEQ ID NO: 1423 - DNA, 1075 bp, Homo sapiens
gcttccggcatctggctcagttccgccatggcctccttggaagtcagtcgtagtcctcgcaggtctcggcgggagctggaagtgcgcagtccacgacagaacaaatattcggtgcttttacctacctacaacgagcgcgagaacctgccgctcatcgtgtggctgctggtgaaaagcttctccgagagtggaatcaactatgaaattataatcatagatgatggaagcccagatggaacaagggatgttgctgaacagttggagaagatctatgggtcagacagaattcttctaagaccacgagagaaaaagttgggactaggaactgcatatattcatggaatgaaacatgccacaggaaactacatcattattatggatgctgatctctcacaccatccaaaatttattcctgaatttattaggaagcaaaaggagggtaattttgatattgtctctggaactcgctacaaaggaaatggaggtgtatatggctgggatttgaaaagaaaaataatcagccgtggggccaattttttaactcagatcttgctgagaccaggagcatctgatttaacaggaagtttcagattataccgaaaagaagttctagagaaattaatagaaaaatgtgtttctaaaggctacgtcttccagatggagatgattgttcgggcaagacagttgaattatactattggcgaggttccaatatcatttgtggatcgtgtttatggtgaatccaagttgggaggaaatgaaatagtatctttcttgaaaggattattgactctttttgctactacataaaagaaagatactcatttatagttacgttcatttcaggttaaacatgaaagaagcctggttactgatttgtataaaatgtactcttaaagtataaaatataaggtaaggtaaatttcatgcatctttttatgaagaccacctattttatatttcaaattaaataattttaaagttgctggcctaatgagcaatgttctcaattttcgttttcattttgctgtattgagacctataaataaatgtatatttttttttgcataaagta

SEQ ID NO: 1424 - DNA, 672 bp, Homo sapiens
agttccgccatggcctccttggaagtcagtcgtagtcctcgcaggtctcggcgggagctggaagtgcgcagtccacgacagaacaaatattcggtgcttttacctacctacaacgagcgcgagaacctgccgctcatcgtgtggctgctggtgaaaagcttctccgagagtggaatcaactatgaaattataatcatagatgatggaagcccagatggaacaagggatgttgctgaacagttggagaagatctatgggtcagacagaattcttctaagaccacgagagaaaaagttgggactaggaactgcatatattcatggaatgaaacatgccacaggaaactacatcattattatggatgctgatctctcacaccatccaaaatttattcctgaatttattagtgatggagttttgccatgttgcccaggctggtcactcctgggctcaagtgatccagccatcttggcctcctgggattacagccgtggggccaattttttaactcagatcttgctgagaccaggagcatctgatttaacaggaagtttcagattataccgaaaagaagttctagagaaattaatagaaaaatgtgtttctaaaggctacgtcttccagatggagatgattgttcgggcaagacagttgaattatactattggcgag

SEQ ID NO: 1425 - DNA, 1076 bp, Homo sapiens
agttccgccatggcctccttggaagtcagtcgtagtcctcgcaggtctcggcgggagctggaagtgcgcagtccacgacagaacaaatattcggtgcttttacctacctacaacgagcgcgagaacctgccgctcatcgtgtggctgctggtgaaaagcttctccgagagtggaatcaactatgaaattataatcatagatgatggaagcccagatggaacaagggatgttgctgaacagttggagaagatctatgggtcagacagaattcttctaagaccacgagagaaaaagttgggactaggaactgcatatattcatggaatgaaacatgccacaggaaactacatcattattatggatgctgatctctcacaccatccaaaatttattcctgaatttattaggaagcaaaaggagggtaattttgatattgtctctggaactcgctacaaaggaaatggaggtgtatatggctgggatttgaaaagaaaaataatcagtgatggagttttgccatgttgcccaggctggtcactcctgggctcaagtgatccagccatcttggcctcctgggattacaggtgtgagccaccgcgcctagccagccgtggggccaattttttaactcagatcttgctgagaccaggagcatctgatttaacaggaagtttcagattataccgaaaagaagttctagagaaattaatagaaaaatgtgtttctaaaggctacgtcttccagatggagatgattgttcgggcaagacagttgaattatactattggcgaggttccaatatcatttgtggatcgtgtttatggtgaatccaagttgggaggaaatgaaatagtatctttcttgaaaggattattgactctttttgctactacataaaagaaagatactcatttatagttacgttcatttcaggttaaacatgaaagaagcctggttactgatttgtataaaatgtactcttaaagtataaaatataaggtaaggtaaatttcatgcatctttttatgaagaccacctattttatatttcaaattaaataattttaaagttgctgg

SEQ ID NO: 1426 - DNA, 2194 bp, Homo sapiens
ctgtctttttagtaccacatgcgcaggcaggtgatggcggcgctggtcgtatccggggcagcggagcagggcggccgagacggccctggcagaggtcgggcccctcggggccgcgtggccaatcagatcccccctgagatcctgaagaaccctcagctgcaggcagcaatccgggtcctgccttccaactacaactttgagatccccaagaccatctggaggatccaacaagcccaggccaagaaggtggccttgcaaatgccggaaggcctcctcctctttgcctgtaccattgtggatatcttggaaaggttcacggaggccgaagtgatggtgatgggtgacgtgacctacggggcttgctgtgtggatgacttcacagcgagggccctgggagctgacttcttggtgcactacggccacagttgcctgattcccatggacacctcggcccaagacttccgggtgctgtacgtctttgtggacatccggatagacactacacacctcctggactctctccgcctcacctttcccccagccactgcccttgccctggtcagcaccattcagtttgtgtcgaccttgcaggcagccgcccaggagctgaaagccgagtatcgtgtgagtgtcccacagtgcaagcccctgtcccctggagagatcctgggctgcacatccccccgactgtccaaagaggtggaggccgttgtgtatcttggagatggccgcttccatctggagtctgtcatgattgccaaccccaatgtccccgcttaccggtatgacccatatagcaaagtcctatccagagaacactatgaccaccagcgcatgcaggctgctcgccaagaagccatagccactgcccgctcagctaagtcctggggccttattctgggcactttgggccgccagggcagtcctaagatcctggagcacctggaatctcgactccgagccttgggcctttcctttgtgaggctgctgctctctgagatcttccccagcaagcttagcctacttcctgaggtggatgtgtgggtgcaggtggcatgtccacgtctctccattgactggggcacagccttccccaagccgctgctgacaccctatgaggcggccgtggctctgagggacatttcctggcagcagccctacccgatggacttctacgctggcagctccttggggccctggacggtgaaccacggccaggaccgccgtccccacgccccgggccggcccgcgcgggggaaggtgcaggaggggtccgcgcgtcccccttcggccgtggcttgcgaggactgcagctgcagggacgagaaggtggcgccgctggctccttgacgcgctcccgggcctcagggtcctgccctccggaggagcagcctcgaggctggtggttttcagagcaggaggccgacgttttctccgcattggaagagcccgccgtctgcaggggcctggaggaatcactggggatggtggcacaggcactgaacaggctggggccttttgacggccttcttggtttcagccaaggggctgcgctagcagcccttgtgtgtgccctgggccaggcaggcgatccccgcttccccttgccacggtttatcctcttggtgtctggtttctgtccccggggcattgggttcaaggaatccatcctgcaaaggcccttgtcattgccttcgctccatgtttttggggacactgacaaagtcatcccctctcaggagagtgtgcaactggccagccaatttcccggagccatcaccctcacccactctggtggccacttcattccagcagctgcaccccagcgtcaggcctacctcaagttcttggaccagtttgcagagtgaaagatcaagaaatgtctctgctcctacatccagctcctctaggggcagcctccgtcatccatgccctcccaggaccctccactcactgctgtgagtgcgcctcaccagaaccagttaagagacaactatcaattcttgagacccaaattataagggccctgccctgtactgaagaaaaggggagcacaaggccttaatggacattgacttgtgaaaacgcaaacatgaatatggttggagagccctggattaggagggtgacatggggaaggcagaggctggcaccatggtgactgccacataataaagtggtgatttggattttg

SEQ ID NO: 1427 - DNA, 4359 bp, Homo sapiens
tttgtttctgcactctacattgttttaatgaaaataaaatgttattttaagaaaaaaggttttcttctgattttctgcacaaccagacgtttgtttgtttgctttaaaatgtttcaacaaaatcctggtttgtttcgaaatatgttggattagcatttaacacctcatcggtcactaaagcccagtcagttcaccagccccaacacagcctcggctaaaagaacatcagagcaaacagagctgggcctttaaaagtggcaaacaaatgccacacaccgcctaaagaaggggggttgggggaggggagggttaaggcgaacttgggtccaaatgagtttgaagggaatacaaagaacgaaaagtcagcacaagttttcctaaagctagctcgcgaacgcaagcgtcgcgaacaagggcttttgtgcatgctaattgcgccattggtgcgcaaaagttccgacgcgaagtgtgaactctcaacagaaggaaacatgagacaactgaagtgccctggtttatgtgccctgctcctcctccgctgccgcctccccttctttctccttcctcccgccgagcccgctgttgcagcttgtttgcactggggcttatccggagcggaaattcctttccgtttttgtgaatgacaaactcattaacaattcatcaacacaacctgttccagccggcccgtccccacggcaacagccccttccgcagcacgctcattggctggcccggagaatgtatccattgagacgctcgctgtttgtatccattgaggagctgcctcgcgcagggggtgtgcgaggctgagtccaagagatagcaaatcgagtcttaaataatccggggagaaagacgcccgggtagatttgaggtgcagccttggagggagggattagaagccgctagactttttttcctcccctctcagtagcacggagtccgaattaattggatttcattcactggggaggaacaaaaactatctgggcagcttcattgagagagattcattgacactaagagccagcggctgcagctgggtgcagagagaacctccggctttacttctgtctcgtctgccccaaccgctagcctcggcttgggtaaggcgaggcggaattaaaccccgctccgagagcggcagcttcgcgcgcggtgcgctcggcctatgcctgccccgaggggcgtctggtaggcaccccgccctctcccgcagctcgacccccatgatagatacgctcagacccgtgcccttcgcgtcggaaatggcgatcagcaagacggtggcgtggctcaacgagcagctggagctgggcaacgagcggctgctgctgatggactgccggccgcaggagctatacgagtcgtcgcacatcgagtcggccatcaacgtggccatcccgggcatcatgctgcggcgcctgcagaagggtaacctgccggtgcgcgcgctcttcacgcgcggcgaggaccgggaccgcttcacccggcgctgtggcaccgacacagtggtgctctacgacgagagcagcagcgactggaacgagaatacgggcggcgagtcggtgctcgggctgctgctcaagaagctcaaggacgagggctgccgggcgttctacctggaaggtggcttcagtaagttccaagccgagttctccctgcattgcgagaccaatctagacggctcgtgtagcagcagctcgccgccgttgccagtgctggggctcgggggcctgcggatcagctctgactcttcctcggacatcgagtctgaccttgaccgagaccccaatagtgcaacagactcggatggtagtccgctgtccaacagccagccttccttcccagtggagatcttgcccttcctctacttgggctgtgccaaagactccaccaacttggacgtgttggaggaattcggcatcaagtacatcttgaacgtcacccccaatttgccgaatctctttgagaacgcaggagagtttaaatacaagcaaatccccatctcggatcactggagccaaaacctgtcccagtttttccctgaggccatttctttcatagatgaagcccggggcaagaactgtggtgtcttggtacattgcttggctggcattagccgctcagtcactgtgactgtggcttaccttatgcagaagctcaatctgtcgatgaacgacgcctatgacattgtcaaaatgaaaaaatccaacatatcccctaacttcaacttcatgggtcagctgctggacttcgagaggacgctgggactcagcagcccatgtgacaacagggttccagcacagcagctgtattttaccaccccttccaaccagaatgtataccaggtggactctctgcaatctacgtgaaagaccccacacccctccttgctggaatgtgtctggcccttcagcagtttctcttggcagcatcagctgggctgctttctttgtgtgtggccccaggtgtcaaaatgacaccagctgtctgtactagacaaggttaccaagtgcggaattggttaatactaacagagagatttgctccattctctttggaataacaggacatgctgtatagatacaggcagtaggtttgctctgtacccatgtgtacagcctacccatgcagggactgggattcgaggacttccaggcgcatagggtagaaccaaatgatagggtaggagcatgtgttctttagggccttgtaaggctgtttccttttgcatctggaactgactatataattgtcttcaatgaagactaattcaattttgcatatagaggagccaaagagagatttcagctctgtatttgtggtatcagtttggaaaaaaaaatctgatactccatttgattattgtaaatatttgatcttgaatcacttgacagtgtttgtttgaattgtgtttgttttttcctttgatgggcttaaaagaaattatccaaagggagaaagagcagtatgccacttcttaaaacagaacaaaacaaaaaaagaaaattgtgctcttttctaatccaaagggtatatttgcagcatgcttgactttaccaattctgatgacatctttacggacactattatcactaagaccttgttatggcgaagtctttagtctttttcatgtattttcctcatgattttttctctttatgtagtttgactatgccttacctttgtaaatatttttgcttgtgttgtcgcaaaggggataatctgggaaagacaccaaatcatgggctcactttaaaaaaagaaagaataaaaaaaccttcagctgtgctaaacagtatattacctctgtataaaattcttcagggagtgtcacctcaaatgcaatactttgggttggtttctttcctttaaaaaaatttgtataaaactggaagtgtgtgtgtgtgagcatgggtacccatttgataagagaaatgcatttgattgtgaagaagggagagttaaattctccattatgttcgtggtgtaaagtttagagctggaatttattataagaatgtaaaaccttaaattattaataaataactattttggctattgaatgtgtgtttttaaaaactcagttatacctatgtgtgaagtgacacattttagaactttttcattcagggattgattttgacttgtaggcatagtagggcaaggttcttttaagcttttcctagaacgtttttcagcagcagtttatgaaattcatcgtttgccacgaataaagatgacatcctagaatggaccgactgtaccgtgtatatgaacaatacctcttatgagtatagttccggcttaagattttaaagcccctgaagaaaaatgaacctatagagcatagcttgctgaggaatacaatttggatattaaccacagagaggtgtagcagaataccaagatgacagccacatgttaacctcctccctatccttcactgtcaggatcttctgctttataatgctgagataatgccaaagaggaagtagggataattctttttccagtctgttgtcatgggcaattctacctgcagatatcctagtgtgagaatgctgaatccagaatgatgtctccactttttcccctagcatgcgcatggcaaggcatatctaagcttcctcaccgtgtcaggatatggctttagaattttacattggcacttaggaggcaactttgtcatccctgttgtaatgtgcttttttgtttaactggcttgggatgtgggtcagaaacccttattgaaacttgtggggattattttagtttcttttcaagctaaagactttatatcttgccatttttcttgggacctaccctctccttacctcaaatgtaaaaata

SEQ ID NO: 1428 - DNA, 1959 bp, Homo sapiens
gtagatttgaggtgcagccttggagggagggattagaagccgctagactttttttcctcccctctcagtagcacggagtccgaattaattggatttcattcactggggaggaacaaaaactatctgggcagcttcattgagagagattcattgacactaagagccagcggctgcagctgggtgcagagagaacctccggctttacttctgtctcgtctgccccaaccgctagcctcggcttgggtaaggcgaggcggaattaaaccccgctccgagagcggcagcttcgcgcgcggtgcgctcggcctatgcctgccccgaggggcgtctggtaggcaccccgccctctcccgcagctcgacccccatgatagatacgctcagacccgtgcccttcgcgtcggaaatggcgatcagcaagacggtggcgtggctcaacgagcagctggagctgggcaacgagcggctgctgctgatggactgccggccgcaggagctatacgagtcgtcgcacatcgagtcggccatcaacgtggccatcccgggcatcatgctgcggcgcctgcagaagggtaacctgccggtgcgcgcgctcttcacgcgcggcgaggaccgggaccgcttcacccggcgctgtggcaccgacacagtggtgctctacgacgagagcagcagcgactggaacgagaatacgggcggcgagtcggtgctcgggctgctgctcaagaagctcaaggacgagggctgccgggcgttctacctggaagatgaagcccggggcaagaactgtggtgtcttggtacattgcttggctggcattagccgctcagtcactgtgactgtggcttaccttatgcagaagctcaatctgtcgatgaacgacgcctatgacattgtcaaaatgaaaaaatccaacatatcccctaacttcaacttcatgggtcagctgctggacttcgagaggacgctgggactcagcagcccatgtgacaacagggttccagcacagcagctgtattttaccaccccttccaaccagaatgtataccaggtggactctctgcaatctacgtgaaagaccccacacccctccttgctggaatgtgtctggcccttcagcagtttctcttggcagcatcagctgggctgctttctttgtgtgtggccccaggtgtcaaaatgacaccagctgtctgtactagacaaggttaccaagtgcggaattggttaatactaacagagagatttgctccattctctttggaataacaggacatgctgtatagatacaggcagtaggtttgctctgtacccatgtgtacagcctacccatgcagggactgggattcgaggacttccaggcgcatagggtagaaccaaatgatagggtaggagcatgtgttctttagggccttgtaaggctgtttccttttgcatctggaactgactatataattgtcttcaatgaagactaattcaattttgcatatagaggagccaaagagagatttcagctctgtatttgtggtatcagtttggaaaaaaaaatctgatactccatttgattattgtaaatatttgatcttgaatcacttgacagtgtttgtttgaattgtgtttgttttttcctttgatgggcttaaaagaaattatccaaagggagaaagagcagtatgccacttcttaaaacagaacaaaacaaaaaaagaaaattgtgctcttttctaatccaaagggtatatttgcagcatgcttgactttaccaattctgatgacatctttacggacactattatcactaagaccttgttatggcgaagtctttagtctttttcatgtattttcctcatgattttttctctttatgtagtttgactatgccttacctttgtaaatatttttgcttgtgttgtcgcaaaggggataatctgggaaagacaccaaatcatgggctcacttt

SEQ ID NO: 1429 - DNA, 567 bp, Homo sapiens
attgaggagctgcctcgcgcagggggtgtgcgaggctgagtccaagagatagcaaatcgagtcttaaataatccggggagaaagacgcccgggtagatttgaggcggaattaaaccccgctccgagagcggcagcttcgcgcgcggtgcgctcggcctatgcctgccccgaggggcgtctggtaggcaccccgccctctcccgcagctcgacccccatgatagatacgctcagacccgtgcccttcgcgtcggaaatggcgatcagcaagacggtggcgtggctcaacgagcagctggagctgggcaacgagcggctgctgctgatggactgccggccgcaggagctatacgagtcgtcgcacatcgagtcggccatcaacgtggccatcccgggcatcatgctgcggcgcctgcagaagggtaacctgccggtgcgcgcgctcttcacgcgcggcgaggaccgggaccgcttcacccggcgctgtggcaccgacacagtggtgctctacgacgagagcagcagcgactggaacgagaatacgggcggcgagtcggtgctcgggctg

SEQ ID NO: 1430 - DNA, 2577 bp, Homo sapiens
agcaaatcgcattgcgcagacgaccagcgggcgcctcggattccgcccccgggatggccccgcctcctcccgccccgcggcaaggcacgcacagggcagtgcgcgggtgggtgggtcctagcagcgcggcctgacgggaccaaggcggcgggagtctgcggtcgttccctcggctgtggaccgggcggcacgcacgcggtgcagggtaacatggcggatgcggaagtaattattttgccaaagaaacataagaagaaaaaggagcggaagtcattgccagaagaagatgtagccgaaatacaacacgctgaagaatttcttatcaaacctgaatccaaagttgctaagttggacacgtctcagtggccccttttgctaaagaattttgataagctgaatgtaaggacaacacactatacacctcttgcatgtggttcaaatcctctgaagagagagattggggactatatcaggacaggtttcattaatcttgacaagccctctaacccctcttcccatgaggtggtagcctggattcgacggatacttcgggtggagaagacagggcacagtggtacgctggatcccaaggtgactggttgtttaatcgtgtgcatagaacgagccactcgcttggtgaagtcacaacagagtgcaggcaaagagtatgtggggattgtccggctgcacaatgctattgaaggggggacccagctttctagggccctagaaactctgacaggtgccttattccagcgacccccacttattgctgcagtaaagaggcagctccgagtgaggaccatctacgagagcaaaatgattgaatacgatcctgaaagaagattaggaatcttttgggtgagttgtgaggctggcacctacattcggacattatgtgtgcaccttggtttgttattgggagttggtggtcagatgcaggagcttcggagggttcgttctggagtcatgagtgaaaaggaccacatggtgacaatgcatgatgtgcttgatgctcagtggctgtatgataaccacaaggatgagagttacctgcggcgagttgtttaccctttggaaaagctgttgacatctcataaacggctggttatgaaagacagtgcagtaaatgccatctgctatggggccaagattatgcttccaggtgttcttcgatatgaggacggcattgaggtcaatcaggagattgtggttatcaccaccaaaggagaagcaatctgcatggctattgcattaatgaccacagcggtcatctctacctgcgaccatggtatagtagccaagatcaagagagtgatcatggagagagacacttaccctcggaagtggggtttaggtccaaaggcaagtcagaagaagctgatgatcaagcagggccttctggacaagcatgggaagcccacagacagcacacctgccacctggaagcaggagtatgttgactacagtgagtctgccaaaaaagaggtggttgctgaagtggtaaaagccccgcaggtagttgccgaagcagcaaaaactgcgaagcggaagcgagagagtgagagtgaaagtgacgagactcctccagcagctcctcagttgatcaagaaggaaaagaagaagagtaagaaggacaagaaggccaaagctggtctggagagcggggccgagcctggagatggggacagtgataccaccaagaagaagaagaagaagaagaaagcaaaagaggtagaattggtttctgagtagtgaaggccacttgaagctggaggagaaactaaagccttattgagaaaacatgttatagatccttttgttgctgagagagtggaacataggtcctagacagggtgaagagttctggcacattttagctgctactttgagacctcggtgatgttacctggtgtggtcatcccatcttgtcctgttttaaggatatgggtggtgaaagatgaaagaggcagagtttatcccaatgacttctctgtttgagttgggaagcctcaccttcagacccagtaactgtccgcagctgtctgctagtggttgtcttaacatcgtagtcctagtttgcattttttaaatcccctctgtttaaaaggtttgtaaaacaaaaacaaaaaactaagtctgctcagtgaaatgctgtagaaccctaaataagtggtagaagagtgtcactgaattttgtctctgaattcagtataactgagttttgtccatgctggtgtctgggttataggcctgatgggcctggtagttttccatcttgttctggcctagaggtcagtcctttgcacttcctcaaagcttgtgtacagtgctcacctaaatccatctgactacttgttcctgtgccctcttgttttaggcctcgtttacttttaaaaaatgaaattgttcattgctgggagaagaatgttgtaatttttacttattaaagtcaacttgttaagttttttatgtattcctgttgggttttcttgttgatctcatgctagcagagcaaaaattgtaaaatattttgattaaaaatctagggacctttatgtcctatttgaaatgtga

SEQ ID NO: 1431 - DNA, 9585 bp, Homo sapiens
cttgtttgtgtgctaggctgggggggagagagggcgagagagagcgggcgagagtgggcaagcaggacgccgggctgagtgctaactgcgggagccagagagtgcggaggggagtcgggtcggagagaggcggcaggggccgagacagtggcagggggcccggggcgcacgggctgaggcgacccccagccccctcccgtccgcacacacccccaccgcggtccagcagccgggccggcgtcgacgcctaggggggaccattacataaccccgcgccccgcggcgtcttctcccgccgccgcgggcggccccgaacggagccccggggggcgggcgctcccagcacctggccgccggcggtgggggccgtagcagcggccgtatttatttattttccgcgggaaaggaaggcgaaggaggggagcgcggcgcgaggaggggccgcctgcgccgccgccggagcggggcctcctcggtgggctccgcgtcggcgcgggcgtgcgggcggcgctgctcggcccggccccctcggccctctggtccggccagctccgctcccggcgtccttgccgcgcctccgccggccgccgcgcgatgtgaggcggcggcgccagcctggctctcggctcgggcgagttctctgcggccattaggggccggtgcggcggcggcggcgcggagcgcggcggcaggaggagggttcggagggtgggggcgcaggcccgggagggggcaccgggaggaggtgagtgtctcttgtcgcctcctcctctccccccttttcgcccccgcctccttgtggcgatgagaaggaggaggacagcgccgaggaggaagaggttgatggcggcggcggagctccgagagacctcggctgggcaggggccggccgtggcgggccggggactgcgcctctagagccgcgagttctcgggaattcgccgcagcggacgcgctcggcgaatttgtgctcttgtgccctcctccgggcttgggcccaggcccggcccctcgcacttgcccttaccttttctatcgagtccgcatccctctccagccactgcgacccggcgaagagaaaaaggaacttcccccaccccctcgggtgccgtcggagccccccagcccacccctgggtgcggcgcggggaccccgggccgaagaagagatttcctgaggattctggttttcctcgcttgtatctccgaaagaattaaaaatggccgagaatgtggtggaaccggggccgccttcagccaagcggcctaaactctcatctccggccctctcggcgtccgccagcgatggcacagattttggctctctatttgacttggagcacgacttaccagatgaattaatcaactctacagaattgggactaaccaatggtggtgatattaatcagcttcagacaagtcttggcatggtacaagatgcagcttctaaacataaacagctgtcagaattgctgcgatctggtagttcccctaacctcaatatgggagttggtggcccaggtcaagtcatggccagccaggcccaacagagcagtcctggattaggtttgataaatagcatggtcaaaagcccaatgacacaggcaggcttgacttctcccaacatggggatgggcactagtggaccaaatcagggtcctacgcagtcaacaggtatgatgaacagtccagtaaatcagcctgccatgggaatgaacacagggatgaatgcgggcatgaatcctggaatgttggctgcaggcaatggacaagggataatgcctaatcaagtcatgaacggttcaattggagcaggccgagggcgacagaatatgcagtacccaaacccaggcatgggaagtgctggcaacttactgactgagcctcttcagcagggctctccccagatgggaggacaaacaggattgagaggcccccagcctcttaagatgggaatgatgaacaaccccaatccttatggttcaccatatactcagaatcctggacagcagattggagccagtggccttggtctccagattcagacaaaaactgtactatcaaataacttatctccatttgctatggacaaaaaggcagttcctggtggaggaatgcccaacatgggtcaacagccagccccgcaggtccagcagccaggcctggtgactccagttgcccaagggatgggttctggagcacatacagctgatccagagaagcgcaagctcatccagcagcagcttgttctccttttgcatgctcacaagtgccagcgccgggaacaggccaatggggaagtgaggcagtgcaaccttccccactgtcgcacaatgaagaatgtcctaaaccacatgacacactgccagtcaggcaagtcttgccaagtggcacactgtgcatcttctcgacaaatcatttcacactggaagaattgtacaagacatgattgtcctgtgtgtctccccctcaaaaatgctggtgataagagaaatcaacagccaattttgactggagcacccgttggacttggaaatcctagctctctaggggtgggtcaacagtctgcccccaacctaagcactgttagtcagattgatcccagctccatagaaagagcctatgcagctcttggactaccctatcaagtaaatcagatgccgacacaaccccaggtgcaagcaaagaaccagcagaatcagcagcctgggcagtctccccaaggcatgcggcccatgagcaacatgagtgctagtcctatgggagtaaatggaggtgtaggagttcaaacgccgagtcttctttctgactcaatgttgcattcagccataaattctcaaaacccaatgatgagtgaaaatgccagtgtgccctccctgggtcctatgccaacagcagctcaaccatccactactggaattcggaaacagtggcacgaagatattactcaggatcttcgaaatcatcttgttcacaaactcgtccaagccatatttcctacgccggatcctgctgctttaaaagacagacggatggaaaacctagttgcatatgctcggaaagttgaaggggacatgtatgaatctgcaaacaatcgagcggaatactaccaccttctagctgagaaaatctataagatccagaaagaactagaagaaaaacgaaggaccagactacagaagcagaacatgctaccaaatgctgcaggcatggttccagtttccatgaatccagggcctaacatgggacagccgcaaccaggaatgacttctaatggccctctacctgacccaagtatgatccgtggcagtgtgccaaaccagatgatgcctcgaataactccacaatctggtttgaatcaatttggccagatgagcatggcccagccccctattgtaccccggcaaacccctcctcttcagcaccatggacagttggctcaacctggagctctcaacccgcctatgggctatgggcctcgtatgcaacagccttccaaccagggccagttccttcctcagactcagttcccatcacagggaatgaatgtaacaaatatccctttggctccgtccagcggtcaagctccagtgtctcaagcacaaatgtctagttcttcctgcccggtgaactctcctataatgcctccagggtctcaggggagccacattcactgtccccagcttcctcaaccagctcttcatcagaattcaccctcgcctgtacctagtcgtacccccacccctcaccatactcccccaagcataggggctcagcagccaccagcaacaacaattccagcccctgttcctacacctcctgccatgccacctgggccacagtcccaggctctacatccccctccaaggcagacacctacaccaccaacaacacaacttccccaacaagtgcagccttcacttcctgctgcaccttctgctgaccagccccagcagcagcctcgctcacagcagagcacagcagcgtctgttcctaccccaacagcaccgctgcttcctccgcagcctgcaactccactttcccagccagctgtaagcattgaaggacaggtatcaaatcctccatctactagtagcacagaagtgaattctcaggccattgctgagaagcagccttcccaggaagtgaagatggaggccaaaatggaagtggatcaaccagaaccagcagatactcagccggaggatatttcagagtctaaagtggaagactgtaaaatggaatctaccgaaacagaagagagaagcactgagttaaaaactgaaataaaagaggaggaagaccagccaagtacttcagctacccagtcatctccggctccaggacagtcaaagaaaaagattttcaaaccagaagaactacgacaggcactgatgccaactttggaggcactttaccgtcaggatccagaatcccttccctttcgtcaacctgtggaccctcagcttttaggaatccctgattactttgatattgtgaagagccccatggatctttctaccattaagaggaagttagacactggacagtatcaggagccctggcagtatgtcgatgatatttggcttatgttcaataatgcctggttatataaccggaaaacatcacgggtatacaaatactgctccaagctctctgaggtctttgaacaagaaattgacccagtgatgcaaagccttggatactgttgtggcagaaagttggagttctctccacagacactgtgttgctacggcaaacagttgtgcacaatacctcgtgatgccacttattacagttaccagaacaggtatcatttctgtgagaagtgtttcaatgagatccaaggggagagcgtttctttgggggatgacccttcccagcctcaaactacaataaataaagaacaattttccaagagaaaaaatgacacactggatcctgaactgtttgttgaatgtacagagtgcggaagaaagatgcatcagatctgtgtccttcaccatgagatcatctggcctgctggattcgtctgtgatggctgtttaaagaaaagtgcacgaactaggaaagaaaataagttttctgctaaaaggttgccatctaccagacttggcacctttctagagaatcgtgtgaatgactttctgaggcgacagaatcaccctgagtcaggagaggtcactgttagagtagttcatgcttctgacaaaaccgtggaagtaaaaccaggcatgaaagcaaggtttgtggacagtggagagatggcagaatcctttccataccgaaccaaagccctctttgcctttgaagaaattgatggtgttgacctgtgcttctttggcatgcatgttcaagagtatggctctgactgccctccacccaaccagaggagagtatacatatcttacctcgatagtgttcatttcttccgtcctaaatgcttgaggactgcagtctatcatgaaatcctaattggatatttagaatatgtcaagaaattaggttacacaacagggcatatttgggcatgtccaccaagtgagggagatgattatatcttccattgccatcctcctgaccagaagatacccaagcccaagcgactgcaggaatggtacaaaaaaatgcttgacaaggctgtatcagagcgtattgtccatgactacaaggatatttttaaacaagctactgaagatagattaacaagtgcaaaggaattgccttatttcgagggtgatttctggcccaatgttctggaagaaagcattaaggaactggaacaggaggaagaagagagaaaacgagaggaaaacaccagcaatgaaagcacagatgtgaccaagggagacagcaaaaatgctaaaaagaagaataataagaaaaccagcaaaaataagagcagcctgagtaggggcaacaagaagaaacccgggatgcccaatgtatctaacgacctctcacagaaactatatgccaccatggagaagcataaagaggtcttctttgtgatccgcctcattgctggccctgctgccaactccctgcctcccattgttgatcctgatcctctcatcccctgcgatctgatggatggtcgggatgcgtttctcacgctggcaagggacaagcacctggagttctcttcactccgaagagcccagtggtccaccatgtgcatgctggtggagctgcacacgcagagccaggaccgctttgtctacacctgcaatgaatgcaagcaccatgtggagacacgctggcactgtactgtctgtgaggattatgacttgtgtatcacctgctataacactaaaaaccatgaccacaaaatggagaaactaggccttggcttagatgatgagagcaacaaccagcaggctgcagccacccagagcccaggcgattctcgccgcctgagtatccagcgctgcatccagtctctggtccatgcttgccagtgtcggaatgccaattgctcactgccatcctgccagaagatgaagcgggttgtgcagcataccaagggttgcaaacggaaaaccaatggcgggtgccccatctgcaagcagctcattgccctctgctgctaccatgccaagcactgccaggagaacaaatgcccggtgccgttctgcctaaacatcaagcagaagctccggcagcaacagctgcagcaccgactacagcaggcccaaatgcttcgcaggaggatggccagcatgcagcggactggtgtggttgggcagcaacagggcctcccttcccccactcctgccactccaacgacaccaactggccaacagccaaccaccccgcagacgccccagcccacttctcagcctcagcctacccctcccaatagcatgccaccctacttgcccaggactcaagctgctggccctgtgtcccagggtaaggcagcaggccaggtgacccctccaacccctcctcagactgctcagccaccccttccagggcccccacctgcagcagtggaaatggcaatgcagattcagagagcagcggagacgcagcgccagatggcccacgtgcaaatttttcaaaggccaatccaacaccagatgcccccgatgactcccatggcccccatgggtatgaacccacctcccatgaccagaggtcccagtgggcatttggagccagggatgggaccgacagggatgcagcaacagccaccctggagccaaggaggattgcctcagccccagcaactacagtctgggatgccaaggccagccatgatgtcagtggcccagcatggtcaacctttgaacatggctccacaaccaggattgggccaggtaggtatcagcccactcaaaccaggcactgtgtctcaacaagccttacaaaaccttttgcggactctcaggtctcccagctctcccctgcagcagcaacaggtgcttagtatccttcacgccaacccccagctgttggctgcattcatcaagcagcgggctgccaagtatgccaactctaatccacaacccatccctgggcagcctggcatgccccaggggcagccagggctacagccacctaccatgccaggtcagcagggggtccactccaatccagccatgcagaacatgaatccaatgcaggcgggcgttcagagggctggcctgccccagcagcaaccacagcagcaactccagccacccatgggagggatgagcccccaggctcagcagatgaacatgaaccacaacaccatgccttcacaattccgagacatcttgagacgacagcaaatgatgcaacagcagcagcaacagggagcagggccaggaataggccctggaatggccaaccataaccagttccagcaaccccaaggagttggctacccaccacagcagcagcagcggatgcagcatcacatgcaacagatgcaacaaggaaatatgggacagataggccagcttccccaggccttgggagcagaggcaggtgccagtctacaggcctatcagcagcgactccttcagcaacagatggggtcccctgttcagcccaaccccatgagcccccagcagcatatgctcccaaatcaggcccagtccccacacctacaaggccagcagatccctaattctctctccaatcaagtgcgctctccccagcctgtcccttctccacggccacagtcccagcccccccactccagtccttccccaaggatgcagcctcagccttctccacaccacgtttccccacagacaagttccccacatcctggactggtagctgcccaggccaaccccatggaacaagggcattttgccagcccggaccagaattcaatgctttctcagcttgctagcaatccaggcatggcaaacctccatggtgcaagcgccacggacctgggactcagcaccgataactcagacttgaattcaaacctctcacagagtacactagacatacactagagacaccttgtagtattttgggagcaaaaaaattattttctcttaacaagactttttgtactgaaaacaatttttttgaatctttcgtagcctaaaagacaattttccttggaacacataagaactgtgcagtagccgtttgtggtttaaagcaaacatgcaagatgaacctgagggatgatagaatacaaagaatatatttttgttatggctggttaccaccagcctttcttcccctttgtgtgtgtggttcaagtgtgcactgggaggaggctgaggcctgtgaagccaaacaatatgctcctgccttgcacctccaataggttttattattttttttaaattaatgaacatatgtaatattaatagttattatttactggtgcagatggttgacatttttccctattttcctcactttatggaagagttaaaacatttctaaaccagaggacaaaaggggttaatgttactttaaaattacattctatatatatataaatatatataaatatatattaaaataccagttttttttctctgggtgcaaagatgttcattcttttaaaaaatgtttaaaaaaaaaaaaaaactgcctttcttcccctcaagtcaacttttgtgctccagaaaattttctattctgtaagtctgagcgtaaaacttcaagtattaaaataatttgtacatgtagagagaaaaatgactttttcaaaaatatacaggggcagctgccaaattgatgtattatatattgtggtttctgtttcttgaaagaatttttttcgttatttttacatctaacaaagtaaaaaaattaaaaagagggtaagaaacgattccggtgggatgattttaacatgcaaaatgtccctgggggtttcttctttgcttgctttcttcctccttaccctaccccccactcacacacacacacacacacacacacacacacacacacacacactttctataaaacttgaaaatagcaaaaaccctcaactgttgtaaatcatgcaattaaagttgattacttataaatatgaactttggatcactgtatagactgttaaatttgatttcttattacctattgttaaataaactgtgtgagacagaca

SEQ ID NO: 1432 - DNA, 2503 bp, Homo sapiens
ttggcgcgtaaaagtggccgggactttgcaggcagcggcggccgggggcggagcgggatcgagccctcgccgaggcctgccgccatgggcccgcgccgccgccgccgcctgtcacccgggccgcgcgggccgtgagcgtcatggccttggccggggcccctgcgggcggcccatgcgcgccggcgctggaggccctgctcggggccggcgcgctgcggctgctcgactcctcgcagatcgtcatcatctccgccgcgcaggacgccagcgccccgccggctcccaccggccccgcggcgcccgccgccggcccctgcgaccctgacctgctgctcttcgccacaccgcaggcgccccggcccacacccagtgcgccgcggcccgcgctcggccgcccgccggtgaagcggaggctggacctggaaactgaccatcagtacctggccgagagcagtgggccagctcggggcagaggccgccatccaggaaaaggtgtgaaatccccgggggagaagtcacgctatgagacctcactgaatctgaccaccaagcgcttcctggagctgctgagccactcggctgacggtgtcgtcgacctgaactgggctgccgaggtgctgaaggtgcagaagcggcgcatctatgacatcaccaacgtccttgagggcatccagctcattgccaagaagtccaagaaccacatccagtggctgggcagccacaccacagtgggcgtcggcggacggcttgaggggttgacccaggacctccgacagctgcaggagagcgagcagcagctggaccacctgatgaatatctgtactacgcagctgcgcctgctctccgaggacactgacagccagcgcctggcctacgtgacgtgtcaggaccttcgtagcattgcagaccctgcagagcagatggttatggtgatcaaagcccctcctgagacccagctccaagccgtggactcttcggagaactttcagatctcccttaagagcaaacaaggcccgatcgatgttttcctgtgccctgaggagaccgtaggtgggatcagccctgggaagaccccatcccaggaggtcacttctgaggaggagaacagggccactgactctgccaccatagtgtcaccaccaccatcatctcccccctcatccctcaccacagatcccagccagtctctactcagcctggagcaagaaccgctgttgtcccggatgggcagcctgcgggctcccgtggacgaggaccgcctgtccccgctggtggcggccgactcgctcctggagcatgtgcgggaggacttctccggcctcctccctgaggagttcatcagcctttccccaccccacgaggccctcgactaccacttcggcctcgaggagggcgagggcatcagagacctcttcgactgtgactttggggacctcacccccctggatttctgacagggcttggagggaccagggtttccagagatgctcaccttgtctctgcagccctggagccccctgtccctggccgtcctcccagcctgtttggaaacatttaatttatacccctctcctctgtctccagaagcttctagctctggggtctggctaccgctaggaggctgagcaagccaggaagggaaggagtctgtgtggtgtgtatgtgcatgcagcctacacccacacgtgtgtaccgggggtgaatgtgtgtgagcatgtgtgtgtgcatgtaccggggaatgaaggtgaacatacacctctgtgtgtgcactgcagacacgccccagtgtgtccacatgtgtgtgcatgagtccatgtgtgcgcgtgggggggctctaactgcactttcggcccttttgctctgggggtcccacaaggcccagggcagtgcctgctcccagaatctggtgctctgaccaggccaggtggggaggctttggctggctgggcgtgtaggacggtgagagcacttctgtcttaaaggttttttctgattgaagctttaatggagcgttatttatttatcgaggcctctttggtgagcctggggaatcagcaaaggggaggaggggtgtggggttgataccccaactccctctacccttgagcaagggcaggggtccctgagctgttcttctgccccatactgaaggaactgaggcctgggtgatttatttattgggaaagtgagggagggagacagactgactgacagccatgggtggtcagatggtggggtgggccctctccagggggccagttcagggccccagctgccccccaggatggatatgagatgggagaggtgagtgggggaccttcactgatgtgggcaggaggggtggtgaaggcctcccccagcccagaccctgtggtccctcctgcagtgtctgaagcgcctgcctccccactgctctgccccaccctccaatctgcactttgatttgcttcctaacagctctgttccctcctgctttggttttaataaatattttgatgacgtt

SEQ ID NO: 1433 - DNA, 2100 bp, Homo sapiens
gcggaagtggcggcggcgccggcctggcctggcctggctgaggggaggcggcgggcgggcgcgatggcggaggccgggccacaggcgccgccgcccccgggcactccaagccggcacgaaaagagcctgggactgctcaccaccaagttcgtgtcccttctgcaggaggccaaggacggcgtgcttgacctcaagctggcagctgacaccctagctgtacgccagaagcggcggatttacgacattaccaatgttttggaaggtatcgggctaatcgagaaaaagtccaagaacagcatccagtggaagggtgtggggcctggctgcaatacccgggagattgctgacaaactgattgagctcaaggcagagatcgaggagctgcagcagcgggagcaagaactagaccagcacaaggtgtgggtgcagcagagcatccggaacgtcacagaggacgtgcagaacagctgtttggcctacgtcactcatgaggacatctgcagatgctttgctggagataccctcttggccatccgggccccatcaggcaccagcctggaggtgcccatcccagagggtctcaatgggcagaagaagtaccagattcacctgaagagtgtgagtggtcccattgaggttctgctggtgaacaaggaggcatggagctcaccccctgtggctgtgcctgtgccaccacctgaagatttgctccagagcccatctgctgtttctacacctccacctctgcccaagcctgccctagcccagtcccaggaagcctcacgtccaaatagtcctcagctcactcccactgctgtccctggcagtgcagaagtccagggaatggctggcccagcagctgagatcacagtgagtggcggccctgggactgatagcaaggacagtggtgagctcagttcactcccactgggcccaacaacactggacacccggccactgcagtcttctgccctgctggacagcagcagcagcagcagcagcagcagcagcagcagcagcaacagtaacagcagcagttcgtccggacccaacccttctacctcctttgagcccatcaaggcagaccccacaggtgttttggaactccccaaagagctgtcagaaatctttgatcccacacgagagtgcatgagctcggagctgctggaggagttgatgtcctcagaagtgtttgcccctctgcttcgtctttctccacccccgggagaccacgattatatctacaacctggacgagagtgaaggtgtctgtgacctctttgatgtgcctgttctcaacctctgactgacagggacatgccctgtgtggctgggacccagactgtctgacctgggggttgcctggggacctctcccacccgacccctacagagcttgagagccacagacgcctggcttctccggcctcccctcaccgcacagttctggccacagctcccgctcctgtgctggcacttctgtgctcgcagagcaggggaacaggactcagcccccatcaccgtggagccaaagtgtttgcttctccctttctgcggccttcgccagcccaggctcggctgccacccagtggcacagaaccgaggagctgccattaccccccatagggggcagtgtcttgttcctgccagcctcagtgtcttgcttctgccagctccttcccctaggagggaagggtggggtggaactgggcacatgccagcaccacttctagcttccttcgctatcccccaccccctgaccctccagctcctcctggccctctcacgtgcccacttctgctgggcctttagccctagaacctgcaggtggtgggggcggctaccaagaaggaacagaggtctctggggaggagtctgggtggtccagccctgatgattggccccacctcctgctgccccataaccctctcttcatttcggctttttcatttaccctcatttagagccatttgcagagatttagaaagatttacagtaacgaatggattcctatataaagattatttttatactttttgcagcaaaaggaaattgtaatatttgtacagtgttcaagtgaataaaaaccatgcctaaggcta

SEQ ID NO: 1434 - DNA, 4336 bp, Homo sapiens
gatcaatactgaggccgcgtccgacccccttgagccgagatccccccccagcccagcccccaccccaccccccgcacacgccccaccccccccacgacccagcctcataccgcaccagctgaggcacccaagaggattaccccctggggccctctcccgccccccaaaaaagagaagatcccctctcctggcccatcccttcccttcttccctcccccctccccccgaactttccctctcgcatgcttttcccctgcaccacggatcgcctctcggatgccgcttgcctggaagctgcgttaggagcgagcggcggcggtggcggcggtggcggcggcggcggcagctcgggagtgctatgaccggcaaactcgccgagaagctgccggtgaccatgagcagtttgctaaaccaactgcctgacaatctgtaccccgaggagatccccagcgcgctcaacctcttctccggcagcagcgactcggtagtccattacaatcagatggctacagagaatgtaatggacatcggtctgaccaacgagaagcccaacccggaactctcttactccggctccttccagccagcccccggcaacaagaccgtgacctacttgggaaagttcgccttcgactccccttccaactggtgccaggacaacatcattagcctcatgagcgccggcatcttgggggtgcccccggcttcaggggcgctcagcacgcagacgtccacggccagcatggtgcagccaccgcagggtgacgtggaggccatgtatcccgcgctacccccctactccaactgcggcgacctctactcagagcccgtgtctttccacgacccccagggcaatcccgggctcgcctattccccccaggattaccaatcggccaagccggcgttggacagcaatctcttccccatgattcctgactacaacctctaccaccaccccaacgacatgggctccattccggagcacaagcccttccagggcatggaccccatccgggtcaacccgccccctattacccctctggagaccatcaaggcattcaaagacaagcagatccacccgggctttggcagcctgccccagccgccgctcaccctcaagcccatccggccccgcaagtaccccaaccggcctagcaagacaccgctccacgaacggccccacgcgtgcccggccgagggctgcgaccgccgtttcagccgttcggacgagctgacccggcacctgcgcatccacacgggccacaagcccttccagtgccggatctgcatgcggagcttcagccgcagcgaccacctcaccactcacatccgcactcatacgggcgagaagccctttgcctgcgagttctgcgggcgcaagtttgcgcgcagcgacgagcgcaagcgccacgccaagatccacctcaagcaaaaggagaagaaggcggagaagggcggtgcaccctctgcatcctcggcgccccccgtgtcgctggcccccgtggtcaccacctgcgcctgaggatcgggcccccagatccccacttttcccctccagtgcctcccggctgctagcctgaaagcagcgggaaagccagccacggaggcgtaggggccgcgccctggcctctccatggacgtgcggccccttgcttccccttcgatgcccccggttcccaacctttcacgccggccagcggtcaggggccagggctggaggcgccttcccctcgcggtcccccacttagccaaggcgtgggggcggaaaggtggcgtctagcccgctttgttcagttcggatcgccttgatccaggggccgccgggccgcgccaaggacctgcaagggactgaaggcggagcccatccaaccctcgcccgacccaaacacctcattgtttcccccacgtctccctctataccccctcgaagactcgagagggggagggggtaaggagcgcaccaaagcgcagagcttgctgcccgccgcacgcacgcgcgcctgcgtgcggggatgcgcgcgagtgtgtgcgtgctcgcgtgtgtgtgtatgtgtgtgtgtgagtgtgtgtgtgtgcgcgcgcgcaagcgtgtgtgtttaagactcttgagctgaactgggctgtgtttaccccaaactcttccccacctcgggtccccaagccgctgggagatgtcccatgctgggggtccgcacgtggctggaggaggtggtcttccatccgctctgaaatcatgtttcttagagaaatgcctcggatgccgccgacgcggtgctgctgccgccgcttcgggtttggcccctcagaacccctccttttctgagcgcttccctcttaggcctcagggcagtttgatctgtggggagaaagagcagccatcgctgagcctgccttttaaaatatatgtgtatttccttagccccactctaagaaatctatgttcctgagtttgccccctgccctcccactccttccccttctcccctctaaaccttctcccatctctttcaaaatcttttcccagaaaggcaggcttcaaccagccactccagctttgtgtcttctctcaattacatagcaatttctccttcccaccatcatggggaagctggctctgcttttgccctttgtcatcaccaacacaacagatagaatttaaatataagtatatggtgtgcgtgtgtatgtatgtgtatgtatatgcatgcatgtgtataaagatgcacatgcgtacatatacataacatacacacaatatgtattcctagcaaaataaaatctctaaggtacttggttatccagtgcagtgcaccggaataaagagaatttgtaggcgtatacagctttaaatgatttattttttatgaaaatgttaactgatgagattatatctacatacgtgtgttatgtgtgtggatatagatgcacacatatctgtacatatacatgtgagtgtacatatatacacatatacacatctatgtatggatatgtgtgtatacacatatacacatctctgtccaaaatttcctcaaagatatggggattttttcatgaatccatgtggatgaatgaggtgtctcctttccatacccagtctcaccttctccccaccctacctcacctcttctcaggcacccctcttccccagctgtcctgccagcccttctcgtacagggtggctcctttgaagtggagtaatagggaaggttgctctctgccacagcttgcagcatggtcttgactgaatgtactgttcctgttagcgttacttctcctgtggtcagtaagttgcccagagagaaggaacaaaggtctggagtttacagaatgtctgtttttaaagtcactttatgcgttttccacttttttcttttttaagaaaaagaagtaccatttttgttttgttttgttttgatttttggtggtggataaataatactaaaaggactctagtggaaaggggggatatcgaagagcagggggttgtgaatttccaggtacttggactttttgtagaaggagagagaagaagatgaagtttgccaggagggcccatattttttcagctgaagggtaaaatctttctttgcagagacagtattttgctgaatactttttataatgtgatgattattaaaaaagcaaaaattttggtcacttccaagctagaaggaggaatcagataccctttaatattttttcctcgctccttctggtatatgcatgtcactgcatgataattgagttttcctttgttttaataaaactgttctcagacattaagctaaactaagagaaaaataactttgttgccaaaaggttgtgctatccagattttttatatgtctgcatgtttaaaaaaaaaaagcaacaaaagaaaatgcactctaacttatgtgaactgagagaaaaaaatcaggttttaaacaggaaaacctatggggaatgatattttttgaaagacttttgtataaagttgagtacttagaaaaaagacaaaccagatgtaatatattttgtggatgtttttatttcttggatttatagtaccttatactaaggttaaaaaaatatgcttgatattgtgaaaaggtgaaattcttcaccaacatttcatttgctcctttgtcatattgtaatgccaatataatatagttaatgaaaacagcatttttaaaaaccgaaatattgaaatggtgtaatgttgtaccatttgcactgtgagcaaatgctaatacagtaaatatattgtgtttgctgacaatcagccggcctataaatctccttattttatttcttgtttttatagcataaagctttagtttggcctgtt

SEQ ID NO: 1435 - DNA, 1095 bp, Homo sapiens
gatcgagaaggctaggttggcgacgccacggtagaggcttcggttctcccgggtgggggcagccgccgaccggagggagagaatgtaatggacatcggtctgaccaacgagaagcccaacccggaactctcttactccggctccttccagccagcccccggcaacaagaccgtgaccatgattcctgactacaacctctaccaccaccccaacgacatgggctccattccggagcacaagcccttccagggcatggaccccatccgggtcaacccgccccctattacccctctggagaccatcaaggcattcaaagacaagcagatccacccgggctttggcagcctgccccagccgccgctcaccctcaagcccatccggccccgcaagtaccccaaccggcctagcaagacaccgctccacgaacggccccacgcgtgcccggccgagggctgcgaccgccgtttcagccgttcggacgagctgacccggcacctgcgcatccacacgggccacaagcccttccagtgccggatctgcatgcggagcttcagccgcagcgaccacctcaccactcacatccgcactcatacgggcgagaagccctttgcctgcgagttctgcgggcgcaagtttgcgcgcagcgacgagcgcaagcgccacgccaagatccacctcaagcaaaaggagaagaaggcggagaagggcggtgcaccctctgcatcctcggcgccccccgtgtcgctggcccccgtggtcaccacctgcgcctgaggatcgggcccccagatccccacttttcccctccagtgcctcccggctgctagcctgaaagcagcgggaaagccagccacggaggcgtaggggccgcgccctggcctctccatggacgtgcggccccttgcttccccttcgatgcccccggttcccaacctttcacgccggccagcggtcaggggccagggctggaggcgccttcccctcgcggtcccccacttagccaaggcgtgggggcggaaaggtggcgtctagcccgctttgttcagttcggatcgccttgatccaggggccgccgggccgcgccaaggacctgca

SEQ ID NO: 1436 - DNA, 1553 bp, Homo sapiens
ctcttcccgggaggagcccggcgtctttttcacccgcgctctccccccttactccctcagcctcccacccgggatggagccatgtgcggcgtggagtccccgcggtgggagagagaatgtaatggacatcggtctgaccaacgagaagcccaacccggaactctcttactccggctccttccagccagcccccggcaacaagaccgtgacctacttgggaaagttcgccttcgactccccttccaactggtgccaggacaacatcattagcctcatgagcgccggcatcttgggggtgcccccggcttcaggggcgctcagcacgcagacgtccacggccagcatggtgcagccaccgcagggtgacgtggaggccatgtatcccgcgctacccccctactccaactgcggcgacctctactcagagcccgtgtctttccacgacccccagggcaatcccgggctcgcctattccccccaggattaccaatcggccaagccggcgttggacagcaatctcttccccatgattcctgactacaacctctaccaccaccccaacgacatgggctccattccggagcacaagcccttccagggcatggaccccatccgggtcaacccgccccctattacccctctggagaccatcaaggcattcaaagacaagcagatccacccgggctttggcagcctgccccagccgccgctcaccctcaagcccatccggccccgcaagtaccccaaccggcctagcaagacaccgctccacgaacggccccacgcgtgcccggccgagggctgcgaccgccgtttcagccgttcggacgagctgacccggcacctgcgcatccacacgggccacaagcccttccagtgccggatctgcatgcggagcttcagccgcagcgaccacctcaccactcacatccgcactcatacgggcgagaagccctttgcctgcgagttctgcgggcgcaagtttgcgcgcagcgacgagcgcaagcgccacgccaagatccacctcaagcaaaaggagaagaaggcggagaagggcggtgcaccctctgcatcctcggcgccccccgtgtcgctggcccccgtggtcaccacctgcgcctgaggatcgggcccccagatccccacttttcccctccagtgcctcccggctgctagcctgaaagcagcgggaaagccagccacggaggcgtaggggccgcgccctggcctctccatggacgtgcggccccttgcttccccttcgatgcccccggttcccaacctttcacgccggccagcggtcaggggccagggctggaggcgccttcccctcgcggtcccccacttagccaaggcgtgggggcggaaaggtggcgtctagcccgctttgttcagttcggatcgccttgatccaggggccgccgggccgcgccaaggacctgcaagggactgaaggcggagcccatccaaccctcgcccgacccaaacacctcattgtttcccccacgtctccctctataccccctcgaagactcgagagggggagggggtaa

SEQ ID NO: 1437 - DNA, 5165 bp, Homo sapiens
gggcgccgtccgcctgaggggctgcagatcccggctaccgcgagcgccgtggctggcttggctgttccatgtggctccggcggggatggaggactcggtggcggcggcggctgctgctgcggcggcgacggaggagcggctatgagaagggaacggggccagactcagcccgacagcgggattagagccctccagaatacccatcatatagcccctgaggtggcatggtgatgtctccatgagggaaccccttcccactcatcctgtcacgtatatcatagtgttcttgactgggccattcatctaagatgggatttaccctgtgaaacagggagaagacttatggaccccaagcatcatttcgagttgtagttgagtttttaaaagacatacatgcaaagttcctttgctttggaccctctgcattattaaagctgctgtattgctaacccagaactgctccagtgtcttgactgatcatcatggcttcagtttggaagagactgcagcgtgtgggaaaacatgcatccaagttccagtttgtggcctcctaccaggagctcatggttgagtgtacgaagaaatggcaaccagataaactggtggtagtttggaccagaagaagccgaaggaagtcttctaaggcacatagctggcaacctggaataaaaaatccctatcgtggtgttgttgtgtggcctgttcctgaaaacattgaaatcactgtaacactttttaaggatcctcatgcggaagaatttgaagacaaagagtggacatttgtcatagaaaatgaatccccttctggtcgaaggaaagctcttgctactagcagcatcaatatgaaacagtatgcaagccctatgccaactcagactgatgtcaagttaaaattcaagccattatctaaaaaagttgtatctgccgctcttcagttttcattatcttgcatttttctgagggaaggaaaagccacagatgaagacatgcaaagtttggctagtttgatgagtatgaagcaggctgacattggcaatttagatgacttcgaagaagataatgaagatgatgatgagaacagagtgaaccaagaagaaaaggcagctaaaattacagaaattgtaaaccagttgaatgctctgagcagcttagatgaagatcaagatgactgcataaagcaagcaaatatgcgttcagctaaatcagccagttcctctgaagagcttatcaacaaacttaactttttggatgaagcagaaaaggacttggccaccgtgaattcaaatccatttgatgatcctgatgctgcagaattaaatccatttggagatcctgactcagaagaacctatcactgaaacagcttcacctagaaaaacagaagactctttttataataacagctataatccctttaaagaggtgcagactccacagtatttgaacccattcgatgagccagaagcatttgtgaccataaaggattctcctccccagtctacaaaaagaaaaaatataagacctgtggatatgagcaagtacctctatgctgatagttctaaaactgaagaagaagaattggatgaatcaaatcctttttatgaacctaaatcaactcctcctccaaataatttggtaaatcctgttcaagaactagaaactgaaaggcgagtgaaaagaaaggccccggctccaccagtcctctcaccaaaaacaggagtattaaatgaaaacacagtttctgcaggaaaagatctctctacttctcctaagccaagccctataccaagtcctgttttggggcgaaagccaaatgctagtcagtctttgcttgtatggtgtaaagaagttacaaagaactaccgaggagtaaaaatcaccaattttactacatcgtggagaaatggtttatctttttgtgcaatattacaccactttagaccagatttaattgactacaagtctctgaatcctcaagatattaaagagaacaacaaaaaggcatacgatggatttgccagcataggaatttcccgattattggaaccttctgatatggtattattagcaattcctgataaactgactgttatgacttatctctatcaaataagggcacatttcagtggccaagaactaaatgtcgttcagatagaggaaaacagcagtaaaagcacatataaagttggaaactatgaaacagatacaaacagttctgttgatcaagaaaaattctatgcagagcttagtgatctgaagcgggagcctgaactacaacagcctatcagcggagcagtagacttcttatcacaggatgactctgtatttgtaaatgatagcggggttggagagtcagaaagtgagcatcaaactcctgatgatcaccttagtccaagcacagcctccccttactgtcgcaggactaaaagtgacacagaaccccagaagtctcagcagagctctggaaggacttcaggatctgatgaccctggaatatgttccaatacagattcaacccaagcacaggttttgttaggcaaaaagagactattgaaagctgagactttagaattgagtgacttatatgttagtgataagaagaaggatatgtctccaccctttatttgtgaggagacagatgaacaaaagcttcaaactctagacatcggtagtaacttggagaaagaaaaattagagaattccagatccttagaatgcagatcagatccagaatctcctatcaaaaaaacaagtttatctcctacttctaaacttggatactcatatagtagagatctagaccttgctaagaaaaaacatgcttccctgaggcagacggagtctgatccagatgctgatagaaccactttaaatcatgcagatcattcatcaaaaatagtccagcatcgattgttatctagacaagaagaacttaaggaaagagcaagagttctgcttgagcaagcaagaagagatgcagccttaaaggcggggaataagcacaataccaacacagccaccccattctgcaacaggcagctaagtgatcagcaagatgaagagcgacgtcggcagctgagagagagagctcgtcagctaatagcagaagctcgatctggagtgaagatgtcagaacttcccagctatggtgaaatggctgcagaaaagttgaaagaaaggtcaaaggcatctggagatgaaaatgataatattgagatagatactaacgaggagatccctgaaggctttgttgtaggaggtggagatgaacttactaacttagaaaatgaccttgatactcccgaacaaaacagtaagttggtggacttgaagctgaagaagctcctagaagttcagccacaggtggcaaattcaccctccagtgctgcccagaaagctgtaactgagagctcagagcaggacatgaaaagtggcacagaagatctccggactgaacgattacaaaaaacaacagaacgttttagaaatcctgttgtgttcagcaaagattctacagtcagaaaaactcaacttcagtctttcagccaatatattgagaatagaccagagatgaaaaggcagagatcaatacaggaagatacaaagaaaggaaatgaggagaaggcagcgataactgaaactcagaggaagccatcagaagatgaagtgcttaataaagggttcaaagacaccagtcagtatgtagtaggagaattggcagcactagagaatgagcaaaagcaaattgacacccgtgccgcgctggtggagaagcgccttcgctatctcatggacacaggaaggaacacagaagaagaagaagctatgatgcaggaatggtttatgttagttaataagaaaaatgccttaataaggagaatgaatcagctctctcttctggaaaaagaacatgatttagaacgacggtatgagctgctgaaccgggaattgagggcaatgctagccattgaagactggcagaagaccgaggcccagaagcgacgcgaacagcttctgctagatgagctggtggccctggtgaacaagcgcgatgcgctcgtcagggacctggacgcgcaggagaagcaggccgaagaagaagatgagcatttggagcgaactctggagcaaaacaaaggcaagatggccaagaaagaggagaaatgtgttcttcagtagccatcagatcagaaagaatctctcccaacattttagagtcttgcttcccaaaccagaaaaagtcagactcattgttgatttaaaacttttaacattttgtttggctggattgtactactttacctctactttaccaccaccacccttttcctccctcctttccaaataatatacagaactccaaaatagcttcatttaaggatttttttgtgagttaacaatttccttgaaatcctgtgaaatagatttgcacagacaccttgtgagtgattggtattggaggtgttcaagaaactgttcgaaaaagaacaaaaacacttccctcgttattttctctcattttttgatgagaggaaaatttgaaacattattcttgttgttgttggtaatagcataatgacagtgggaggggtacaaggggataagaaaaatgtcatgatttttttccggtcctgccacatgtaacacttactctgttacctaaattttatagttagatcatatccaatctacttattaaactgtgttctatttaccagtggagtttttctgcagtggttgcgtttcactgtaaggataatggagttcctctcctctgctttcctcagaggatggtcctttaacatagccagaaacaagccctgtggtttgaaggtgagctgtgaggatgggactaattgatatgcaccagtttacaaagacagtcttatcatccgagaatacaccatctttttctctggataattatttcttacatcatgcttgattcctacattttgttgggtctcaacattggctcacgaatgctgttaatatttattctgtattgataaaaagtctgtcttgccactacaagtaaatcccccatttaatattttcttctttagcatagcactgtcattttttgtgaaaatggttatgtttatttattacaatactgagtcatatataaattttcaataaaagcagaaactttcttaccttaaa

SEQ ID NO: 1438 - DNA, 5057 bp, Homo sapiens
gggcgccgtccgcctgaggggctgcagatcccggctaccgcgagcgccgtggctggcttggctgttccatgtggctccggcggggatggaggactcggtggcggcggcggctgctgctgcggcggcgacggaggagcggctatgagaagggaacggggccagactcagcccgacagcgggattagagccctccagaatacccatcatatagcccctgaggtggcatggtgatgtctccatgagggaaccccttcccactcatcctgtcacgtatatcatagtgttcttgactgggccattcatctaagatgggatttaccctgtgaaacagggagaagacttatggaccccaagcatcatttcgagttgtagttgagtttttaaaagacatacatgcaaagttcctttgctttggaccctctgcattattaaagctgctgtattgctaacccagaactgctccagtgtcttgactgatcatcatggcttcagtttggaagagactgcagcgtgtgggaaaacatgcatccaagttccagtttgtggcctcctaccaggagctcatggttgagtgtacgaagaaatggcaaccagataaactggtggtagtttggaccagaagaagccgaaggaagtcttctaaggcacatagctggcaacctggaataaaaaatccctatcgtggtgttgttgtgtggcctgttcctgaaaacattgaaatcactgtaacactttttaaggatcctcatgcggaagaatttgaagacaaagagtggacatttgtcatagaaaatgaatccccttctggtcgaaggaaagctcttgctactagcagcatcaatatgaaacagtatgcaagccctatgccaactcagactgatgtcaagttaaaattcaagccattatctaaaaaagttgtatctgccgctcttcagttttcattatcttgcatttttctgagggaaggaaaagccacagatgaagacatgcaaagtttggctagtttgatgagtatgaagcaggctgacattggcaatttagatgacttcgaagaagataatgaagatgatgatgagaacagagtgaaccaagaagaaaaggcagctaaaattacagagcttatcaacaaacttaactttttggatgaagcagaaaaggacttggccaccgtgaattcaaatccatttgatgatcctgatgctgcagaattaaatccatttggagatcctgactcagaagaacctatcactgaaacagcttcacctagaaaaacagaagactctttttataataacagctataatccctttaaagaggtgcagactccacagtatttgaacccattcgatgagccagaagcatttgtgaccataaaggattctcctccccagtctacaaaaagaaaaaatataagacctgtggatatgagcaagtacctctatgctgatagttctaaaactgaagaagaagaattggatgaatcaaatcctttttatgaacctaaatcaactcctcctccaaataatttggtaaatcctgttcaagaactagaaactgaaaggcgagtgaaaagaaaggccccggctccaccagtcctctcaccaaaaacaggagtattaaatgaaaacacagtttctgcaggaaaagatctctctacttctcctaagccaagccctataccaagtcctgttttggggcgaaagccaaatgctagtcagtctttgcttgtatggtgtaaagaagttacaaagaactaccgaggagtaaaaatcaccaattttactacatcgtggagaaatggtttatctttttgtgcaatattacaccactttagaccagatttaattgactacaagtctctgaatcctcaagatattaaagagaacaacaaaaaggcatacgatggatttgccagcataggaatttcccgattattggaaccttctgatatggtattattagcaattcctgataaactgactgttatgacttatctctatcaaataagggcacatttcagtggccaagaactaaatgtcgttcagatagaggaaaacagcagtaaaagcacatataaagttggaaactatgaaacagatacaaacagttctgttgatcaagaaaaattctatgcagagcttagtgatctgaagcgggagcctgaactacaacagcctatcagcggagcagtagacttcttatcacaggatgactctgtatttgtaaatgatagcggggttggagagtcagaaagtgagcatcaaactcctgatgatcaccttagtccaagcacagcctccccttactgtcgcaggactaaaagtgacacagaaccccagaagtctcagcagagctctggaaggacttcaggatctgatgaccctggaatatgttccaatacagattcaacccaagcacaggttttgttaggcaaaaagagactattgaaagctgagactttagaattgagtgacttatatgttagtgataagaagaaggatatgtctccaccctttatttgtgaggagacagatgaacaaaagcttcaaactctagacatcggtagtaacttggagaaagaaaaattagagaattccagatccttagaatgcagatcagatccagaatctcctatcaaaaaaacaagtttatctcctacttctaaacttggatactcatatagtagagatctagaccttgctaagaaaaaacatgcttccctgaggcagacggagtctgatccagatgctgatagaaccactttaaatcatgcagatcattcatcaaaaatagtccagcatcgattgttatctagacaagaagaacttaaggaaagagcaagagttctgcttgagcaagcaagaagagatgcagccttaaaggcggggaataagcacaataccaacacagccaccccattctgcaacaggcagctaagtgatcagcaagatgaagagcgacgtcggcagctgagagagagagctcgtcagctaatagcagaagctcgatctggagtgaagatgtcagaacttcccagctatggtgaaatggctgcagaaaagttgaaagaaaggtcaaaggcatctggagatgaaaatgataatattgagatagatactaacgaggagatccctgaaggctttgttgtaggaggtggagatgaacttactaacttagaaaatgaccttgatactcccgaacaaaacagtaagttggtggacttgaagctgaagaagctcctagaagttcagccacaggtggcaaattcaccctccagtgctgcccagaaagctgtaactgagagctcagagcaggacatgaaaagtggcacagaagatctccggactgaacgattacaaaaaacaacagaacgttttagaaatcctgttgtgttcagcaaagattctacagtcagaaaaactcaacttcagtctttcagccaatatattgagaatagaccagagatgaaaaggcagagatcaatacaggaagatacaaagaaaggaaatgaggagaaggcagcgataactgaaactcagaggaagccatcagaagatgaagtgcttaataaagggttcaaagacaccagtcagtatgtagtaggagaattggcagcactagagaatgagcaaaagcaaattgacacccgtgccgcgctggtggagaagcgccttcgctatctcatggacacaggaaggaacacagaagaagaagaagctatgatgcaggaatggtttatgttagttaataagaaaaatgccttaataaggagaatgaatcagctctctcttctggaaaaagaacatgatttagaacgacggtatgagctgctgaaccgggaattgagggcaatgctagccattgaagactggcagaagaccgaggcccagaagcgacgcgaacagcttctgctagatgagctggtggccctggtgaacaagcgcgatgcgctcgtcagggacctggacgcgcaggagaagcaggccgaagaagaagatgagcatttggagcgaactctggagcaaaacaaaggcaagatggccaagaaagaggagaaatgtgttcttcagtagccatcagatcagaaagaatctctcccaacattttagagtcttgcttcccaaaccagaaaaagtcagactcattgttgatttaaaacttttaacattttgtttggctggattgtactactttacctctactttaccaccaccacccttttcctccctcctttccaaataatatacagaactccaaaatagcttcatttaaggatttttttgtgagttaacaatttccttgaaatcctgtgaaatagatttgcacagacaccttgtgagtgattggtattggaggtgttcaagaaactgttcgaaaaagaacaaaaacacttccctcgttattttctctcattttttgatgagaggaaaatttgaaacattattcttgttgttgttggtaatagcataatgacagtgggaggggtacaaggggataagaaaaatgtcatgatttttttccggtcctgccacatgtaacacttactctgttacctaaattttatagttagatcatatccaatctacttattaaactgtgttctatttaccagtggagtttttctgcagtggttgcgtttcactgtaaggataatggagttcctctcctctgctttcctcagaggatggtcctttaacatagccagaaacaagccctgtggtttgaaggtgagctgtgaggatgggactaattgatatgcaccagtttacaaagacagtcttatcatccgagaatacaccatctttttctctggataattatttcttacatcatgcttgattcctacattttgttgggtctcaacattggctcacgaatgctgttaatatttattctgtattgataaaaagtctgtcttgccactacaagtaaatcccccatttaatattttcttctttagcatagcactgtcattttttgtgaaaatggttatgtttatttattacaatactgagtcatatataaattttcaataaaagcagaaactttcttacctt

SEQ ID NO: 1439 - DNA, 4108 bp, Homo sapiens
aactgggaggctccccagtttgtgggtaacatctgactctccctccccaaagagagactccagcgagagactggggatttggaggtccaagtcatggcagaactgggttgcttgctaggacacaaggttagcatgcccctgtagcagcaatgtgagaatcagaaaaggtgactgtgcatctcaagaagccgaatcaaaaagccaagccaaccacctaaccagtgattttcaagccctccagaatacccatcatatagcccctgaggtggcatggtgatgtctccatgagggaaccccttcccactcatcctgtcacgtatatcatagtgttcttgactgggccattcatctaagatgggatttaccctgtgaaacagggagaagacttatggaccccaagcatcatttcgagttgtagttgagtttttaaaagacatacatgcaaagttcctttgctttggaccctctgcattattaaagctgctgtattgctaacccagaactgctccagtgtcttgactgatcatcatggcttcagtttggaagagactgcagcgtgtgggaaaacatgcatccaagttccagtttgtggcctcctaccaggagctcatggttgagtgtacgaagaaatggcaaccagataaactggtggtagtttggaccagaagaagccgaaggaagtcttctaaggcacatagctggcaacctggaataaaaaatccctatcgtggtgttgttgtgtggcctgttcctgaaaacattgaaatcactgtaacactttttaaggatcctcatgcggaagaatttgaagacaaagagtggacatttgtcatagaaaatgaatccccttctggtcgaaggaaagctcttgctactagcagcatcaatatgaaacagtatgcaagccctatgccaactcagactgatgtcaagttaaaattcaagccattatctaaaaaagttgtatctgccgctcttcagttttcattatcttgcatttttctgagggaaggaaaagccacagatgaagacatgcaaagtttggctagtttgatgagtatgaagcaggctgacattggcaatttagatgacttcgaagaagataatgaagatgatgatgagaacagagtgaaccaagaagaaaaggcagctaaaattacagagcttatcaacaaacttaactttttggatgaagcagaaaaggacttggccaccgtgaattcaaatccatttgatgatcctgatgctgcagaattaaatccatttggagatcctgactcagaagaacctatcactgaaacagcttcacctagaaaaacagaagactctttttataataacagctataatccctttaaagaggtgcagactccacagtatttgaacccattcgatgagccagaagcatttgtgaccataaaggattctcctccccagtctacaaaaagaaaaaatataagacctgtggatatgagcaagtacctctatgctgatagttctaaaactgaagaagaagaattggatgaatcaaatcctttttatgaacctaaatcaactcctcctccaaataatttggtaaatcctgttcaagaactagaaactgaaaggcgagtgaaaagaaaggccccggctccaccagtcctctcaccaaaaacaggagtattaaatgaaaacacagtttctgcaggaaaagatctctctacttctcctaagccaagccctataccaagtcctgttttggggcgaaagccaaatgctagtcagtctttgcttgtatggtgtaaagaagttacaaagaactaccgaggagtaaaaatcaccaattttactacatcgtggagaaatggtttatctttttgtgcaatattacaccactttagaccagatttaattgactacaagtctctgaatcctcaagatattaaagagaacaacaaaaaggcatacgatggatttgccagcataggaatttcccgattattggaaccttctgatatggtattattagcaattcctgataaactgactgttatgacttatctctatcaaataagggcacatttcagtggccaagaactaaatgtcgttcagatagaggaaaacagcagtaaaagcacatataaagttggaaactatgaaacagatacaaacagttctgttgatcaagaaaaattctatgcagagcttagtgatctgaagcgggagcctgaactacaacagcctatcagcggagcagtagacttcttatcacaggatgactctgtatttgtaaatgatagcggggttggagagtcagaaagtgagcatcaaactcctgatgatcaccttagtccaagcacagcctccccttactgtcgcaggactaaaagtgacacagaaccccagaagtctcagcagagctctggaaggacttcaggatctgatgaccctggaatatgttccaatacagattcaacccaagcacaggttttgttaggcaaaaagagactattgaaagctgagactttagaattgagtgacttatatgttagtgataagaagaaggatatgtctccaccctttatttgtgaggagacagatgaacaaaagcttcaaactctagacatcggtagtaacttggagaaagaaaaattagagaattccagatccttagaatgcagatcagatccagaatctcctatcaaaaaaacaagtttatctcctacttctaaacttggatactcatatagtagagatctagaccttgctaagaaaaaacatgcttccctgaggcagacggagtctgatccagatgctgatagaaccactttaaatcatgcagatcattcatcaaaaatagtccagcatcgattgttatctagacaagaagaacttaaggaaagagcaagagttctgcttgagcaagcaagaagagatgcagccttaaaggcggggaataagcacaataccaacacagccaccccattctgcaacaggcagctaagtgatcagcaagatgaagagcgacgtcggcagctgagagagagagctcgtcagctaatagcagaagctcgatctggagtgaagatgtcagaacttcccagctatggtgaaatggctgcagaaaagttgaaagaaaggtcaaaggcatctggagaacaaaacagtaagttggtggacttgaagctgaagaagctcctagaagttcagccacaggtggcaaattcaccctccagtgctgcccagaaagctgtaactgagagctcagagcaggacatgaaaagtggcacagaagatctccggactgaacgattacaaaaaacaacagaacgttttagaaatcctgttgtgttcagcaaagattctacagtcagaaaaactcaacttcagtctttcagccaatatattgagaatagaccagagatgaaaaggcagagatcaatacaggaagatacaaagaaaggaaatgaggagaaggcagcgataactgaaactcagaggaagccatcagaagatgaagtgcttaataaagggttcaaagacaccagtcagtatgtagtaggagaattggcagcactagagaatgagcaaaagcaaattgacacccgtgccgcgctggtggagaagcgccttcgctatctcatggacacaggaaggaacacagaagaagaagaagctatgatgcaggaatggtttatgttagttaataagaaaaatgccttaataaggagaatgaatcagctctctcttctggaaaaagaacatgatttagaacgacggtatgagctgctgaaccgggaattgagggcaatgctagccattgaagactggcagaagaccgaggcccagaagcgacgcgaacagcttctgctagatgagctggtggccctggtgaacaagcgcgatgcgctcgtcagggacctggacgcgcaggagaagcaggccgaagaagaagatgagcatttggagcgaactctggagcaaaacaaaggcaagatggccaagaaagaggagaaatgtgttcttcagtagccatcagatcagaaagaatctctcccaacattttagagtcttgcttcccaaaccagaaaaagtcagactcattgttgatttaaaacttttaacattt

SEQ ID NO: 1440 - DNA, 3591 bp, Homo sapiens
atggcttcagtttggaagagactgcagcgtgtgggaaaacatgcatccaagttccagtttgtggcctcctaccaggagctcatggttgagtgtacgaagaaatggcaaccagataaactggtggtagtttggaccagaagaagccgaaggaagtcttctaaggcacatagctggcaacctggaataaaaaatccctatcgtggtgttgttgtgtggcctgttcctgaaaacattgaaatcactgtaacactttttaaggatcctcatgcggaagaatttgaagacaaagagtggacatttgtcatagaaaatgaatccccttctggtcgaaggaaagctcttgctactagcagcatcaatatgaaacagtatgcaagccctatgccaactcagactgatgtcaagttaaaattcaagccattatctaaaaaagttgtatctgccgctcttcagttttcattatcttgcatttttctgagggaaggaaaagccacagatgaagacatgcaaagtttggctagtttgatgagtatgaagcaggctgacattggcaatttagatgacttcgaagaagataatgaagatgatgatgagaacagagtgaaccaagaagaaaaggcagctaaaattacagagcttatcaacaaacttaactttttggatgaagcagaaaaggacttggccaccgtgaattcaaatccatttgatgatcctgatgctgcagaattaaatccatttggagatcctgactcagaagaacctatcactgaaacagcttcacctagaaaaacagaagactctttttataataacagctataatccctttaaagaggtgcagactccacagtatttgaacccattcgatgagccagaagcatttgtgaccataaaggattctcctccccagtctacaaaaagaaaaaatataagacctgtggatatgagcaagtacctctatgctgatagttctaaaactgaagaagaagaattggatgaatcaaatcctttttatgaacctaaatcaactcctcctccaaataatttggtaaatcctgttcaagaactagaaactgaaaggcgagtgaaaagaaaggccccggctccaccagtcctctcaccaaaaacaggagtattaaatgaaaacacagtttctgcaggaaaagatctctctacttctcctaagccaagccctataccaagtcctgttttggggcgaaagccaaatgctagtcagtctttgcttgtatggtgtaaagaagttacaaagaactaccgaggagtaaaaatcaccaattttactacatcgtggagaaatggtttatctttttgtgcaatattacaccactttagaccagatttaattgactacaagtctctgaatcctcaagatattaaagagaacaacaaaaaggcatacgatggatttgccagcataggaatttcccgattattggaaccttctgatatggtattattagcaattcctgataaactgactgttatgacttatctctatcaaataagggcacatttcagtggccaagaactaaatgtcgttcagatagaggaaaacagcagtaaaagcacatataaagttggaaactatgaaacagatacaaacagttctgttgatcaagaaaaattctatgcagagcttagtgatctgaagcgggagcctgaactacaacagcctatcagcggagcagtagacttcttatcacaggatgactctgtatttgtaaatgatagcggggttggagagtcagaaagtgagcatcaaactcctgatgatcaccttagtccaagcacagcctccccttactgtcgcaggactaaaagtgacacagaaccccagaagtctcagcagagctctggaaggacttcaggatctgatgaccctggaatatgttccaatacagattcaacccaagcacaggttttgttaggcaaaaagagactattgaaagctgagactttagaattgagtgacttatatgttagtgataagaagaaggatatgtctccaccctttatttgtgaggagacagatgaacaaaagcttcaaactctagacatcggtagtaacttggagaaagaaaaattagagaattccagatccttagaatgcagatcagatccagaatctcctatcaaaaaaacaagtttatctcctacttctaaacttggatactcatatagtagagatctagaccttgctaagaaaaaacatgcttccctgaggcagacggagtctgatccagatgctgatagaaccactttaaatcatgcagatcattcatcaaaaatagtccagcatcgattgttatctagacaagaagaacttaaggaaagagcaagagttctgcttgagcaagcaagaagagatgcagccttaaaggcggggaataagcacaataccaacacagccaccccattctgcaacaggcagctaagtgatcagcaagatgaagagcgacgtcggcagctgagagagagagctcgtcagctaatagcagaagctcgatctggagtgaagatgtcagaacttcccagctatggtgaaatggctgcagaaaagttgaaagaaaggtcaaaggcatctggagatgaaaatgataatattgagatagatactaacgaggagatccctgaaggctttgttgtaggaggtggagatgaacttactaacttagaaaatgaccttgatactcccgaacaaaacagtaagttggtggacttgaagctgaagaagctcctagaagttcagccacaggtggcaaattcaccctccagtgctgcccagaaagctgtaactgagagctcagagcaggacatgaaaagtggcacagaagatctccggactgaacgattacaaaaaacaacagaacgttttagaaatcctgttgtgttcagcaaagattctacagtcagaaaaactcaacttcagtctttcagccaatatattgagaatagaccagagatgaaaaggcagagatcaatacaggaagatacaaagaaaggaaatgaggagaaggcagcgataactgaaactcagaggaagccatcagaagatgaagtgcttaataaagggttcaaagacaccagtcagtatgtagtaggagaattggcagcactagagaatgagcaaaagcaaattgacacccgtgccgcgctggtggagaagcgccttcgctatctcatggacacaggaaggaacacagaagaagaagaagctatgatgcaggaatggtttatgttagttaataagaaaaatgccttaataaggagaatgaatcagctctctcttctggaaaaagaacatgatttagaacgacggtatgagctgctgaaccgggaattgagggcaatgctagccattgaagactggcagaagaccgaggcccagaagcgacgcgaacagcttctgctagatgagctggtggccctggtgaacaagcgcgatgcgctcgtcagggacctggacgcgcaggagaagcaggccgaagaagaagatgagcatttggagcgaactctggagcaaaacaaaggcaagatggccaagaaagaggagaaatgtgttcttcagtag

SEQ ID NO: 1441 - DNA, 1311 bp, Homo sapiens
acgcgcggggcctggccaatggcggcggggcggtggaggttgagctgccgtgggtagggttagtgtgagaggtgcggcgggggagccctccagaatacccatcatatagcccctgaggtggcatggtgatgtctccatgagggaaccccttcccactcatcctgtcacgtatatcatagtgttcttgactgggccattcatctaagatgggatttaccctgtgaaacagggagaagacttatggaccccaagcatcatttcgagttgtagttgagtttttaaaagacatacatgcaaagttcctttgctttggaccctctgcattattaaagctgctgtattgctaacccagaactgctccagtgtcttgactgatcatcatggcttcagtttggaagagactgcagcgtgtgggaaaacatgcatccaagttccagtttgtggcctcctaccaggagctcatggttgagtgtacgaagaaatggcaaccagataaactggtggtagtttggaccagaagaagccgaaggaagtcttctaaggcacatagctggcaacctggaataaaaaatccctatcgtggtgttgttgtgtggcctgttcctgaaaacattgaaatcactgtaacactttttaaggatcctcatgcggaagaatttgaagacaaagagtggacatttgtcatagaaaatgaatccccttctggtcgaaggaaagctcttgctactagcagcatcaatatgaaacagtatgcaagccctatgccaactcagactgatgtcaagttaaaattcaagccattatctaaaaaagttgtatctgccgctcttcagttttcattatcttgcatttttctgagggaaggaaaagccacagatgaagacatgcaaagtttggctagtttgatgagtatgaagcaggctgacattggcaatttagatgacttcgaagaagataatgaagatgatgatgagaacagagtgaaccaagaagaaaaggcagctaaaattacagagcttatcaacaaacttaactttttggatgaagcagaaaaggacttggccaccgtgaattcaaatccatttgatgatcctgatgctgcagaattaaatccatttggagatcctgactcagaagaacctatcactgaaacagcttcacctagaaaaacagaagactctttttataataacagctataatccctttaaagaggtgcagactccacagtatttgaacccattcgatgagccagaagcatttgtgaccataaaggattctcctccccagtctacaaaaagaaaaaatataa

SEQ ID NO: 1442 - DNA, 581 bp, Homo sapiens
acgcgcggggcctggccaatggcggcggggcggtggaggttgagctgccgtggccctccagaatacccatcatatagcccctgaggtggcatggtgatgtctccatgagggaaccccttcccactcatcctgtcacgtatatcatagtgttcttgactgggccattcatctaagatgggatttaccctgtgaaacagggagaagacttatggaccccaagcatcatttcgagttgtagttgagtttttaaaagacatacatgcaaagttcctttgctttggaccctctgcattattaaagctgctgtattgctaacccagaactgctccagtgtcttgactgatcatcatggcttcagtttggaagagactgcagcgtgtgggaaaacatgcatccaagttccagtttgtggcctcctaccaggagctcatggttgagtgtacgaagaaatggcaaccagataaactggtggtagtttggaccagaagaagccgaaggaagtcttctaaggcacatagctggcaacctggaataaaaaatccctatcgtggtgttgttgtgtggcctgttcctgaaaacat

SEQ ID NO: 1443 - DNA, 5076 bp, Homo sapiens
gatgatggtggcggaggagaaaggcgggggagggggtgctgggcgctgagcggtggctctggcagggcttggtagggtgggggacggtcgcggggcgatctgtcagggagggggtgggcgtgaggggcgccgtccgcctgaggggctgcagatcccggctaccgcgagcgccgtggctggcttggctgttccatgtggctccggcggggatggaggactcggtggcggcggcggctgctgctgcggcggcgacggaggagcggctatgagaagggaacggggccagactcagcccgacagcgggattagagccctccagaatacccatcatatagcccctgaggtggcatggtgatgtctccatgagggaaccccttcccactcatcctgtcacgtatatcatagtgttcttgactgggccattcatctaagatgggatttaccctgtgaaacagggagaagacttatggaccccaagcatcatttcgagttgtagttgagtttttaaaagacatacatgcaaagttcctttgctttggaccctctgcattattaaagctgctgtattgctaacccagaactgctccagtgtcttgactgatcatcatggcttcagtttggaagagactgcagcgtgtgggaaaacatgcatccaagttccagtttgtggcctcctaccaggagctcatggttgagtgtacgaagaaatggcaaccagataaactggtggtagtttggaccagaagaagccgaaggaagtcttctaaggcacatagctggcaacctggaataaaaaatccctatcgtggtgttgttgtgtggcctgttcctgaaaacattgaaatcactgtaacactttttaaggatcctcatgcggaagaatttgaagacaaagagtggacatttgtcatagaaaatgaatccccttctggtcgaaggaaagctcttgctactagcagcatcaatatgaaacagtatgcaagccctatgccaactcagactgatgtcaagttaaaattcaagccattatctaaaaaagttgtatctgccgctcttcagttttcattatcttgcatttttctgagggaaggaaaagccacagatgaagacatgcaaagtttggctagtttgatgagtatgaagcaggctgacattggcaatttagatgacttcgaagaagataatgaagatgatgatgagaacagagtgaaccaagaagaaaaggcagctaaaattacagagcttatcaacaaacttaactttttggatgaagcagaaaaggacttggccaccgtgaattcaaatccatttgatgatcctgatgctgcagaattaaatccatttggagatcctgactcagaagaacctatcactgaaacagcttcacctagaaaaacagaagactctttttataataacagctataatccctttaaagaggtgcagactccacagtatttgaacccattcgatgagccagaagcatttgtgaccataaaggattctcctccccagtctacaaaaagaaaaaatataagacctgtggatatgagcaagtacctctatgctgatagttctaaaactgaagaagaagaattggatgaatcaaatcctttttatgaacctaaatcaactcctcctccaaataatttggtaaatcctgttcaagaactagaaactgaaaggcgagtgaaaagaaaggccccggctccaccagtcctctcaccaaaaacaggagtattaaatgaaaacacagtttctgcaggaaaagatctctctacttctcctaagccaagccctataccaagtcctgttttggggcgaaagccaaatgctagtcagtctttgcttgtatggtgtaaagaagttacaaagaactaccgaggagtaaaaatcaccaattttactacatcgtggagaaatggtttatctttttgtgcaatattacaccactttagaccagatttaattgactacaagtctctgaatcctcaagatattaaagagaacaacaaaaaggcatacgatggatttgccagcataggaatttcccgattattggaaccttctgatatggtattattagcaattcctgataaactgactgttatgacttatctctatcaaataagggcacatttcagtggccaagaactaaatgtcgttcagatagaggaaaacagcagtaaaagcacatataaagttggaaactatgaaacagatacaaacagttctgttgatcaagaaaaattctatgcagagcttagtgatctgaagcgggagcctgaactacaacagcctatcagcggagcagtagacttcttatcacaggatgactctgtatttgtaaatgatagcggggttggagagtcagaaagtgagcatcaaactcctgatgatcaccttagtccaagcacagcctccccttactgtcgcaggactaaaagtgacacagaaccccagaagtctcagcagagctctggaaggacttcaggatctgatgaccctggaatatgttccaatacagattcaacccaagcacaggttttgttaggcaaaaagagactattgaaagctgagactttagaattgagtgacttatatgttagtgataagaagaaggatatgtctccaccctttatttgtgaggagacagatgaacaaaagcttcaaactctagacatcggtagtaacttggagaaagaaaaattagagaattccagatccttagaatgcagatcagatccagaatctcctatcaaaaaaacaagtttatctcctacttctaaacttggatactcatatagtagagatctagaccttgctaagaaaaaacatgcttccctgaggcagacggagtctgatccagatgctgatagaaccactttaaatcatgcagatcattcatcaaaaatagtccagcatcgattgttatctagacaagaagaacttaaggaaagagcaagagttctgcttgagcaagcaagaagagatgcagccttaaaggcggggaataagcacaataccaacacagccaccccattctgcaacaggcagctaagtgatcagcaagatgaagagcgacgtcggcagctgagagagagagctcgtcagctaatagcagaagctcgatctggagtgaagatgtcagaacttcccagctatggtgaaatggctgcagaaaagttgaaagaaaggtcaaaggcatctggagaacaaaacagtaagttggtggacttgaagctgaagaagctcctagaagttcagccacaggtggcaaattcaccctccagtgctgcccagaaagctgtaactgagagctcagagcaggacatgaaaagtggcacagaagatctccggactgaacgattacaaaaaacaacagaacgttttagaaatcctgttgtgttcagcaaagattctacagtcagaaaaactcaacttcagtctttcagccaatatattgagaatagaccagagatgaaaaggcagagatcaatacaggaagatacaaagaaaggaaatgaggagaaggcagcgataactgaaactcagaggaagccatcagaagatgaagtgcttaataaagggttcaaagacaccagtcagtatgtagtaggagaattggcagcactagagaatgagcaaaagcaaattgacacccgtgccgcgctggtggagaagcgccttcgctatctcatggacacaggaaggaacacagaagaagaagaagctatgatgcaggaatggtttatgttagttaataagaaaaatgccttaataaggagaatgaatcagctctctcttctggaaaaagaacatgatttagaacgacggtatgagctgctgaaccgggaattgagggcaatgctagccattgaagactggcagaagaccgaggcccagaagcgacgcgaacagcttctgctagatgagctggtggccctggtgaacaagcgcgatgcgctcgtcagggacctggacgcgcaggagaagcaggccgaagaagaagatgagcatttggagcgaactctggagcaaaacaaaggcaagatggccaagaaagaggagaaatgtgttcttcagtagccatcagatcagaaagaatctctcccaacattttagagtcttgcttcccaaaccagaaaaagtcagactcattgttgatttaaaacttttaacattttgtttggctggattgtactactttacctctactttaccaccaccacccttttcctccctcctttccaaataatatacagaactccaaaatagcttcatttaaggatttttttgtgagttaacaatttccttgaaatcctgtgaaatagatttgcacagacaccttgtgagtgattggtattggaggtgttcaagaaactgttcgaaaaagaacaaaaacacttccctcgttattttctctcattttttgatgagaggaaaatttgaaacattattcttgttgttgttggtaatagcataatgacagtgggaggggtacaaggggataagaaaaatgtcatgatttttttccggtcctgccacatgtaacacttactctgttacctaaattttatagttagatcatatccaatctacttattaaactgtgttctatttaccagtggagtttttctgcagtggttgcgtttcactgtaaggataatggagttcctctcctctgctttcctcagaggatggtcctttaacatagccagaaacaagccctgtggtttgaaggtgagctgtgaggatgggactaattgatatgcaccagtttacaaagacagtcttatcatccgagaatacaccatctttttctctggataattatttcttacatcatgcttgattcctacattttgttgggtctcaacattggctcacgaatgctgttaatatttattctgtattgataaaaagtctgtcttgccactacaagtaaatcccccatttaatattttcttctttagcatagcactgtcattttttgtgaaaatggttatgtttatttattacaatactgagtcatatataaattttcaataaaagcagaaactttcttaccttaaa

SEQ ID NO: 1444 - DNA, 1999 bp, Homo sapiens
gatactcatatagtagagatctagaccttgctaagaaaaaacatgcttccctgaggcagacggagtctgatccagatgctgatagaaccactttaaatcatgcagatcattcatcaaaaatagtccagcatcgattgttatctagacaagaagaacttaaggaaagagcaagagttctgcttgagcaagcaagaagagatgcagccttaaaggcggggaataagcacaataccaacacagccaccccattctgcaacaggcagctaagtgatcagaagatctccggactgaacgattacaaaaaacaacagaacgttttagaaatcctgttgtgttcagcaaagattctacagtcagaaaaactcaacttcagtctttcagccaatatattgagaatagaccagagatgaaaaggcagagatcaatacaggaagatacaaagaaaggaaatgaggagaaggcagcgataactgaaactcagaggaagccatcagaagatgaagtgcttaataaagggttcaaagacaccagtcagtatgtagtaggagaattggcagcactagagaatgagcaaaagcaaattgacacccgtgccgcgctggtggagaagcgccttcgctatctcatggacacaggaaggaacacagaagaagaagaagctatgatgcaggaatggtttatgttagttaataagaaaaatgccttaataaggagaatgaatcagctctctcttctggaaaaagaacatgatttagaacgacggtatgagctgctgaaccgggaattgagggcaatgctagccattgaagactggcagaagaccgaggcccagaagcgacgcgaacagcttctgctagatgagctggtggccctggtgaacaagcgcgatgcgctcgtcagggacctggacgcgcaggagaagcaggccgaagaagaagatgagcatttggagcgaactctggagcaaaacaaaggcaagatggccaagaaagaggagaaatgtgttcttcagtagccatcagatcagaaagaatctctcccaacattttagagtcttgcttcccaaaccagaaaaagtcagactcattgttgatttaaaacttttaacattttgtttggctggattgtactactttacctctactttaccaccaccacccttttcctccctcctttccaaataatatacagaactccaaaatagcttcatttaaggatttttttgtgagttaacaatttccttgaaatcctgtgaaatagatttgcacagacaccttgtgagtgattggtattggaggtgttcaagaaactgttcgaaaaagaacaaaaacacttccctcgttattttctctcattttttgatgagaggaaaatttgaaacattattcttgttgttgttggtaatagcataatgacagtgggaggggtacaaggggataagaaaaatgtcatgatttttttccggtcctgccacatgtaacacttactctgttacctaaattttatagttagatcatatccaatctacttattaaactgtgttctatttaccagtggagtttttctgcagtggttgcgtttcactgtaaggataatggagttcctctcctctgctttcctcagaggatggtcctttaacatagccagaaacaagccctgtggtttgaaggtgagctgtgaggatgggactaattgatatgcaccagtttacaaagacagtcttatcatccgagaatacaccatctttttctctggataattatttcttacatcatgcttgattcctacattttgttgggtctcaacattggctcacgaatgctgttaatatttattctgtattgataaaaagtctgtcttgccactacaagtaaatcccccatttaatattttcttctttagcatagcactgtcattttttgtgaaaatggttatgtttatttattacaatactgagtcatatataaattttcaataaaagcagaaactttcttacctt

SEQ ID NO: 1445 - DNA, 2695 bp, Homo sapiens
cgcgtatggagcccccgccccccggagctgccaacattgccaacgccaccgccacgctacacacaggtacccctgggatggcgtgagcactcccccagcgatggacccatctgtgacgctgtggcagtttctgctgcagctgctgagagagcaaggcaatggccacatcatctcctggacttcacgggatggtggtgaattcaagctggtggatgcagaggaggtggcccggctgtgggggctacgcaagaacaagaccaacatgaattacgacaagctcagccgggccttgcggtactactatgacaagaacatcatccgcaaggtgagcggccagaagttcgtctacaagtttgtgtcctaccctgaggtcgcagggtgctccactgaggactgcccgccccagccagaggtgtctgttacctccaccatgccaaatgtggcccctgctgctatacatgccgccccaggggacactgtctctggaaagccaggcacacccaagggtgcaggaatggcaggcccaggcggtttggcacgcagcagccggaacgagtacatgcgctcgggcctctattccaccttcaccatccagtctctgcagccgcagccaccccctcatcctcggcctgctgtggtgctccccagtgcagctcctgcaggggcagcagcgcccccctcggggagcaggagcaccagtccaagccccttggaggcctgtctggaggctgaagaggccggcttgcctctgcaggtcatcctgaccccgcccgaggccccaaacctgaaatcggaagagcttaatgtggagccgggtttgggccgggctttgcccccagaagtgaaagtagaagggcccaaggaagagttggaagttgcgggggagagagggtttgtgccagaaaccaccaaggccgagccagaagtccctccacaggagggcgtgccagcccggctgcccgcggttgttatggacaccgcagggcaggcgggcggccatgcggcttccagccctgagatctcccagccgcagaagggccggaagccccgggacctagagcttccactcagcccgagcctgctaggtgggccgggacccgaacggaccccaggatcgggaagtggctccggcctccaggctccggggccggcgctgaccccatccctgcttcctacgcatacattgaccccggtgctgctgacacccagctcgctgcctcctagcattcacttctggagcaccctgagtcccattgcgccccgtagcccggccaagctctccttccagtttccatccagtggcagcgcccaggtgcacatcccttctatcagcgtggatggcctctcgacccccgtggtgctctccccagggccccagaagccatgactactaccaccaccaccaccaccccttctggggtcactccatccatgctctctccagccagccatctcaaggagaaacatagttcaactgaaagactcatgctctgattgtggtggggtggggatccttgggaagaattactcccaagagtaactctcattatctcctccacagaaaacacacagcttccacaacttctctgttttctgtcagtcccccagtggccgcccttacacgtctcctacttcaatggtaggggcggtttatttatttattttttgaaggccactgggaggagcctgacctaaccttttagggtggttaggacatctcccccacctccccacttttttccccaagacaagacaatcgaggtctggcttgagaacgacctttctttctttatttctcagcctgcccttggggagatgagggagccctgtctgcgtttttggatgtgagtagaagagttagtttgttttgttttattattcctggccatactcaggggtccaggaagaatttgtaccatttaatgggttgggagtcttggccaaggaagaatcacacccttggaatagaaatttccacctccccaacctttctctcagacagcttatccttttcaaccaactttttggccagggaggaatgtcccttttgttcttccccctgagaagccattcctttgtctgccaacctccctggggtcctgcctgtttcctcccaatggagggtttttttggggggtggtccccgtctggggggcccctccagccagtactccaggtctccctgtctctcccccgctgccattttgatagtataatctatttttaaatggggcttttcaataggggagagggagtcatctcttcctatatttggtggggtgggtgggaaggaagggatttgggggggaatcttcctgccgcctcccccactccaagtgtttatttttgataccaaacatgaattttcagttccctccctcccagccccccaatttcctgcgggcgggtacaaaggaccctttcaatgtccctggagttgggagggaggaatgggggacataaagcctgtcctgtctctattctaggcaagagagagtgggttcaaaagactcctgggctcacctgttagcgctggcccagcccaggccttgggacctgggggttggtgatttgggggacagtgctacactcgtctccactgtttgttttacttccccaaaatggaccttttttttttctaaagagtcccagagaatggggaattgttcctgtaaatatatatttttcaaagtga

SEQ ID NO: 1446 - DNA, 504 bp, Homo sapiens
ctcgggcccacgtgagctgtagggaaacgcaggggcggcttctaggtgctgccgccgccaccgccaccaccacctccaccgccgcctcggaacccaggcctggggggcggtggggccgcgtatggagcccccgccccccggagctgccaacattgccaacgccaccgccacgctacacacaggtacccctgggatggcgtgagcactcccccagcgatggacccatctgtgacgctgtggcagtttctgctgcagctgctgagagagcaaggcaatggccacatcatctcctggacttcacgggatggtggtgaattcaagctggtggatgcagaggaggtggcccggctgtgggggctacgcaagaacaagaccaacatgaattacgacaagctcagccgggccttgcggtactactatgacaagaacatcatccgcaaggtgagcggccagaagttcgtctacaagtttgtgtcctaccctgagtcccattgcgccccgtag

SEQ ID NO: 1447 - DNA, 2258 bp, Homo sapiens
gagctgtagggaaacgcaggggcggcttctaggtgctgccgccgccaccgccaccaccacctccaccgccgcctcggaacccaggcctggggggcggtggggccgcgtatggagcccccgccccccggagctgccaacattgccaacgccaccgccacgctacacacagcctcaactttcaggagacccgtccgtggccttatttattccacccttcctgtacatcgtagcgaatcaatccgtggcgccgcactcctccgcatccctctttaacagtacccctgggatggcgtgagcactcccccagcgatggacccatctgtgacgctgtggcagtttctgctgcagctgctgagagagcaaggcaatggccacatcatctcctggacttcacgggatggtggtgaattcaagctggtggatgcagaggaggtggcccggctgtgggggctacgcaagaacaagaccaacatgaattacgacaagctcagccgggccttgcggtactactatgacaagaacatcatccgcaaggtgagcggccagaagttcgtctacaagtttgtgtcctaccctgaggtcgcagggtgctccactgaggactgcccgccccagccagaggtgtctgttacctccaccatgccaaatgtggcccctgctgctatacatgccgccccaggggacactgtctctggaaagccaggcacacccaagggtgcaggaatggcaggcccaggcggtttggcacgcagcagccggaacgagtacatgcgctcgggcctctattccaccttcaccatccagtctctgcagccgcagccaccccctcatcctcggcctgctgtggtgctccccagtgcagctcctgcaggggcagcagcgcccccctcggggagcaggagcaccagtccaagccccttggaggcctgtctggaggctgaagaggccggcttgcctctgcaggtcatcctgaccccgcccgaggccccaaacctgaaatcggaagagcttaatgtggagccgggtttgggccgggctttgcccccagaagtgaaagtagaagggcccaaggaagagttggaagttgcgggggagagagggtttgtgccagaaaccaccaaggccgagccagaagtccctccacaggagggcgtgccagcccggctgcccgcggttgttatggacaccgcagggcaggcgggcggccatgcggcttccagccctgagatctcccagccgcagaagggccggaagccccgggacctagagcttccactcagcccgagcctgctaggtgggccgggacccgaacggaccccaggatcgggaagtggctccggcctccaggctccggggccggcgctgaccccatccctgcttcctacgcatacattgaccccggtgctgctgacacccagctcgctgcctcctagcattcacttctggagcaccctgagtcccattgcgccccgtagcccggccaagctctccttccagtttccatccagtggcagcgcccaggtgcacatcccttctatcagcgtggatggcctctcgacccccgtggtgctctccccagggccccagaagccatgactactaccaccaccaccaccaccccttctggggtcactccatccatgctctctccagccagccatctcaaggagaaacatagttcaactgaaagactcatgctctgattgtggtggggtggggatccttgggaagaattactcccaagagtaactctcattatctcctccacagaaaacacacagcttccacaacttctctgttttctgtcagtcccccagtggccgcccttacacgtctcctacttcaatggtaggggcggtttatttatttattttttgaaggccactgggaggagcctgacctaaccttttagggtggttaggacatctcccccacctccccacttttttccccaagacaagacaatcgaggtctggcttgagaacgacctttctttctttatttctcagcctgcccttggggagatgagggagccctgtctgcgtttttggatgtgagtagaagagttagtttgttttgttttattattcctggccatactcaggggtccaggaagaatttgtaccatttaatgggttgggagtcttggccaaggaagaatcacacccttggaatagaaatttccacctccccaacctttctctcagacagcttatccttttcaaccaactttttggccagggaggaatgtccctttt

SEQ ID NO: 1448 - DNA, 1859 bp, Homo sapiens
ctgaaatcggaagagcttaatgtggagccgggtttgggccgggctttgcccccagaagtgaaagtagaagggcccaaggaagagttggaagttgcgggggagagagggtttgtgccagaaaccaccaaggccgagccagaagtccctccacaggagggcgtgccagcccggctgcccgcggttgttatggacaccgcagggcaggcgggcggccatgcggcttccagccctgagatctcccagccgcagaagggccggaagccccgggacctagagcttccactcagcccgagcctgctaggtgggccgggacccgaacggaccccagccctgcttcctacgcatacattgaccccggtgctgctgacacccagctcgctgcctcctagcattcacttctggagcaccctgagtcccattgcgccccgtagcccggccaagctctccttccagtttccatccagtggcagcgcccaggtgcacatcccttctatcagcgtggatggcctctcgacccccgtggtgctctccccagggccccagaagccatgactactaccaccaccaccaccaccccttctggggtcactccatccatgctctctccagccagccatctcaaggagaaacatagttcaactgaaagactcatgctctgattgtggtggggtggggatccttgggaagaattactcccaagagtaactctcattatctcctccacagaaaacacacagcttccacaacttctctgttttctgtcagtcccccagtggccgcccttacacgtctcctacttcaatggtaggggcggtttatttatttattttttgaaggccactgggaggagcctgacctaaccttttagggtggttaggacatctcccccacctccccacttttttccccaagacaagacaatcgaggtctggcttgagaacgacctttctttctttatttctcagcctgcccttggggagatgagggagccctgtctgcgtttttggatgtgagtagaagagttagtttgttttgttttattattcctggccatactcaggggtccaggaagaatttgtaccatttaatgggttgggagtcttggccaaggaagaatcacacccttggaatagaaatttccacctccccaacctttctctcagacagcttatccttttcaaccaactttttggccagggaggaatgtcccttttgttcttccccctgagaagccattcctttgtctgccaacctccctggggtcctgcctgtttcctcccaatggagggtttttttggggggtggtccccgtctggggggcccctccagccagtactccaggtctccctgtctctcccccgctgccattttgatagtataatctatttttaaatggggcttttcaataggggagagggagtcatctcttcctatatttggtggggtgggtgggaaggaagggatttgggggggaatcttcctgccgcctcccccactccaagtgtttatttttgataccaaacatgaattttcagttccctccctcccagccccccaatttcctgcgggcgggtacaaaggaccctttcaatgtccctggagttgggagggaggaatgggggacataaagcctgtcctgtctctattctaggcaagagagagtgggttcaaaagactcctgggctcacctgttagcgctggcccagcccaggccttgggacctgggggttggtgatttgggggacagtgctacactcgtctccactgtttgttttacttccccaaaatggaccttttttttttctaaagagtcccagagaatggggaattgttcctgtaaatatatatttttcaaagtg

SEQ ID NO: 1449 - DNA, 2758 bp, Homo sapiens
cggcggccgggcgcgcggccccggcgggcacccctcagagggcggccgaggaagctccgggaggaggagcaggaccacgaggaggtgggaggcggcggccgcctggggaccagctccgcgcctcggcctctccgccccctccccagcctttctctcgccctcttctcccacactcccggccggcgcctcggctttgtgcgaggagatggtgtagccccctggccgccgaaggaggagccggacacttgtctcccgtctccgagctgctccccacccctggaggagagacccccccctcggctcggcgccttctgcgtctcccggctggtggggaagcctctgcgccgccggcaccatgagtgaacagagtatctgtcaggcaagagctgctgtgatggtttatgatgatgccaataagaagtgggtgccagctggtggctcaactggattcagcagagttcatatctatcaccatacaggcaacaacacattcagagtggtgggcaggaagattcaggaccatcaggtcgtgataaactgtgccattcctaaagggttgaagtacaatcaagctacacagaccttccaccagtggcgagatgctagacaggtgtatggtctcaactttggcagcaaagaggatgccaatgtcttcgcaagtgccatgatgcatgccttagaagtgttaaattcacaggaaacagggccaacattgcctagacaaaactcacaactacctgctcaagttcaaaatggcccatcccaagaagaattggaaattcaaagaagacaactacaagaacagcaacggcaaaaggagctggagcgggaaaggctggagcgagaaagaatggaaagagaaaggttggagagagagaggttagaaagggaaaggctggagagggagcgactggaacaagaacagctggagagagagagacaagaacgggaacggcaggaacgcctggagcggcaggaacgcctggagcggcaggaacgcctggagcggcaggaacgcctggatcgggagaggcaagaaagacaagaacgagagaggctggagagactggaacgggagaggcaagaaagggagcgacaagagcagttagaaagggaacagctggaatgggagagagagcgcagaatatcaagtgctgctgcccctgcctctgttgagactcctctaaactctgtgctgggagactcttctgcttctgagccaggcttgcaggcagcctctcagccggccgagactccatcccaacagggcattgtcttgggaccacttgcacctccacctcctccaccactcccaccagggcctgcacaggcttcagtagccctccctcctcccccagggccccctccacctcctccactcccatccaccgggcctccaccgccccctcctccccctcctctccctaatcaagtaccccctcctcctccaccacctcctgccccacccctccctgcatctggattctttttggcatccatgtcagaagacaatcgccctttaactggacttgcagctgcaattgccggagcaaaacttaggaaagtgtcacggatggaggatacctctttcccaagtggagggaatgctattggtgtgaactccgcctcatctaaaacagatacaggccgtggaaatggaccccttcctttagggggtagtggtttaatggaagaaatgagtgccctgctggccaggaggagaagaattgctgaaaagggatcaacaatagaaacagaacaaaaagaggacaaaggtgaagattcagagcctgtaacttctaaggcctcttcaacaagtacacctgaaccaacaagaaaaccttgggaaagaacaaatacaatgaatggcagcaagtcacctgttatctccagaccaaaatccacacccttatcacagcccagtgccaatggagtccagacggaaggacttgactatgacaggctgaagcaggacattttagatgaaatgagaaaagaattaacaaagctaaaagaagagctcattgatgcaatcaggcaggaactgagcaagtcaaatactgcatagaggaacagactaaggagagataggactttaatctggaggaaaaatatcctacaaacaacaactgttcacaacagcaaacccctacatttatgagctgtaagaagaaaatggagacaaacagaaggagggaaaaaccaacctactctgaaagccttcagacattatgactctggtgataagctctttccctctccgtttgctgcttttttctggcctttacaacagaatggaagagaatcatttaagagttcctgtaacagttatgcagaaaatactaaaacccatcaggcaagatcaccacgcattgaaatattttcatatcaagataaagtcgcacattttccacaatacattgctaaaataaagaggagaaaggcttaggaagtttttttgcagagagtgctggtaaagaattgagcaagtttgctattgtattgtaatgtttctctcaggtttgttcttcctatcatgtttgatattccatgaataattgagatcagccctatgtaagttaagatcataatatgtggaacaaatggaattgtaagtgctttcaaagggtaatatttataagaaagtgtccgaaaaatgtttcttcagcttgagaaattttagaatgataggaagtttctcgagttagccttcatgcaattttgtagattaaaacataaaatttgtccagaacttaaa

SEQ ID NO: 1450 - DNA, 7167 bp, Homo sapiens
ggttcctcgcggcgatcccgactctcctcccgcggctgcagcagctgccggttgcacacggcctcggcggcggcgcggcgagcgcgggcctgtggagcggcggccgggcgcgcggccccggcgggcacccctcagagggcggccgaggaagctccgggaggaggagcaggaccacgaggaggtgggaggcggcggccgcctggggaccagctccgcgcctcggcctctccgccccctccccagcctttctctcgccctcttctcccacactcccggccggcgcctcggctttgtgcgaggagatggtgtagccccctggccgccgaaggaggagccggacacttgtctcccgtctccgagctgctccccacccctggaggagagacccccccctcggctcggcgccttctgcgtctcccggctggtggggaagcctctgcgccgccggcaccatgagtgaacagagtatctgtcaggcaagagctgctgtgatggtttatgatgatgccaataagaagtgggtgccagctggtggctcaactggattcagcagagttcatatctatcaccatacaggcaacaacacattcagagtggtgggcaggaagattcaggaccatcaggtcgtgataaactgtgccattcctaaagggttgaagtacaatcaagctacacagaccttccaccagtggcgagatgctagacaggtgtatggtctcaactttggcagcaaagaggatgccaatgtcttcgcaagtgccatgatgcatgccttagaagtgttaaattcacaggaaacagggccaacattgcctagacaaaactcacaactacctgctcaagttcaaaatggcccatcccaagaagaattggaaattcaaagaagacaactacaagaacagcaacggcaaaaggagctggagcgggaaaggctggagcgagaaagaatggaaagagaaaggttggagagagagaggttagaaagggaaaggctggagagggagcgactggaacaagaacagctggagagagagagacaagaacgggaacggcaggaacgcctggagcggcaggaacgcctggagcggcaggaacgcctggagcggcaggaacgcctggatcgggagaggcaagaaagacaagaacgagagaggctggagagactggaacgggagaggcaagaaagggagcgacaagagcagttagaaagggaacagctggaatgggagagagagcgcagaatatcaagtgctgctgcccctgcctctgttgagactcctctaaactctgtgctgggagactcttctgcttctgagccaggcttgcaggcagcctctcagccggccgagactccatcccaacagggcattgtcttgggaccacttgcacctccacctcctccaccactcccaccagggcctgcacaggcttcagtagccctccctcctcccccagggccccctccacctcctccactcccatccaccgggcctccaccgccccctcctccccctcctctccctaatcaagtaccccctcctcctccaccacctcctgccccacccctccctgcatctggattctttttggcatccatgtcagaagacaatcgccctttaactggacttgcagctgcaattgccggagcaaaacttaggaaagtgtcacggatggaggatacctctttcccaagtggagggaatgctattggtgtgaactccgcctcatctaaaacagatacaggccgtggaaatggaccccttcctttagggggtagtggtttaatggaagaaatgagtgccctgctggccaggaggagaagaattgctgaaaagggatcaacaatagaaacagaacaaaaagaggacaaaggtgaagattcagagcctgtaacttctaaggcctcttcaacaagtacacctgaaccaacaagaaaaccttgggaaagaacaaatacaatgaatggcagcaagtcacctgttatctccagacgggattctccaaggaaaaatcagattgtttttgacaacaggtcctatgattcattacacagaccaaaatccacacccttatcacagcccagtgccaatggagtccagacggaaggacttgactatgacaggctgaagcaggacattttagatgaaatgagaaaagaattaacaaagctaaaagaagagctcattgatgcaatcaggcaggaactgagcaagtcaaatactgcatagaggaacagactaaggagagataggactttaatctggaggaaaaatatcctacaaacaacaactgttcacaacagcaaacccctacatttatgagctgtaagaagaaaatggagacaaacagaaggagggaaaaaccaacctactctgaaagccttcagacattatgactctggtgataagctctttccctctccgtttgctgcttttttctggcctttacaacagaatggaagagaatcatttaagagttcctgtaacagttatgcagaaaatactaaaacccatcaggcaagatcaccacgcattgaaatattttcatatcaagataaagtcgcacattttccacaatacattgctaaaataaagaggagaaaggcttaggaagtttttttgcagagagtgctggtaaagaattgagcaagtttgctattgtattgtaatgtttctctcaggtttgttcttcctatcatgtttgatattccatgaataattgagatcagccctatgtaagttaagatcataatatgtggaacaaatggaattgtaagtgctttcaaagggtaatatttataagaaagtgtccgaaaaatgtttcttcagcttgagaaattttagaatgataggaagtttctcgagttagccttcatgcaattttgtagattaaaacataaaatttgtccagaacttaaagatttagatgccttcctaaattgttacaatgctttaccaaatctatgacttctacataacacaaaccagtggtcaaatgtaaacactatattgtagatttactgtaggttttcaaccttttttagatttatgcatgtggacatttttataatgtaattacaatcaccacaaggttagcttttttaattgcagacagtaatgcatgtcacactaatatgtagtggccttttcaaggcctagtcccagggaaaacattttgtagagtataggggagtgggaggaaggggaggaataattttttatttaaagttgatttctgcactatctttttctcagttacctgcatgaataaataatgagaaatattttgtgactttaattggtaaatatgttacaaaaccaagtacttaatcttttacatcatgtcttcagctatttgtattttaaccagtaatttcaatggtctgaaacatgattctgagcttcacataatatcttaactgtggaactcaaaagtttgatcactgaatttggcagttattattacctaggtacccccgctgttacacaggtgtttagatacgtgttcctgaatgaagctgcttttgaattttgttatgttgaaatgcaagaaataacaatgatggcagcaattaaggtcacagaaatcattaggtaaaggaaaaccaatgaggagttctgcagttttcttttaataagtaaagtgagacttgggtggtgggaagaaggaaggtgggaagaaggaattagacactctgcctgccactctgcgtgtgtgtgctctcgcgcacgtgctgtctatatggaagccactcccttttctttcctttgaaactggtaaggttaaaataggggagaaatcctacatgttggaatgatagctttttggaaaatttaagaaactctccaggctctccatcttgatttatgcttgagttgttatgtgccatatttgctttgaactctgattatcagaagttttactaaaactttgaaataattcactttcatctgctttctagattttgtacatctcagtccataaagcaaagcttgttgatagtgtagttttctaaacgctgcaaatttgcagcctttaccactacaaagaagtttggatgagggattttttttttctttgtcaaaatagttcctgtttctgtagaaatttcatttttagattaaactgtgatggatgagctatcataattcaagtatacatttcttttttctatcagatattcattgtcatgcagtagtagtaaaaacatcaaagatgcagcaagcttattaagtattattttctaaaagaaataggaggcattttcatctttattattgtacttttggttatgcaaacactttgataatataaacagttatgtcccctataaatctggtcagcaacctcttttgattttgttgggtaagttaaatagtctgtagtaggtagagtactgggtacaagtggtccaaactaagataagagactaaaataaaatgctaaatcttaaaagaaactgggtttatgcactaaacgttttgtgccttggtctaatattaacatgatgtatgtgtaaactgacaaaaaaaaaaaaaaaaaaaaaccagtgttgaatcatgctatatttcccatcatcccagattgctaaatgttctttccaagaagtctgaatgaattattatatacatttgctatcatacatgacagttgtgtcattattagagatttcagtaattaaaatgggaaacagaagcctaagttatttaccttatcaaaaccacgttccttggaaccacattattatgatggtttttgtgctcttgtacgttggatgtcttaagctgagtacagtttaggggatcctttctaatgacaggaaggcactgctttcctcaacactgtgatctgacctgtgacaagtctgtactatccactatgtaaatggctcacaagtcaattgcaaacaaactgaatgtacaaatcttagtgctggtgctgaaatctcttcagaatagtcatcatgatttaaaagtttgtttaaaaatttgcaagcatcaagtgtcaatcaaaactgaagatgaaacactaatgaatgttgaattctcatgcttttaggtgtacttcctttttagaattttcagttttctgctatttttaccgtaactatttcgtttaaatttgtttcatttaagtttcctacacgctaacttcgtttgtgcgattgaaataaaattgcagtatatatatgttgcttgtttgtgacacttagataatcttctgaaataatttgttttaaagtaagttatattggatgtgaaaaacaccttttaaagtccaagactttactacttaaaagtttacatgtcacgtcactattctttacagatttcatagaagtcgtgaatactaagtaatgtatacaaaagaaatatgtgatgatgtgtctactttttgtttgaaataactgttgggtgttccctcttcttattttctctctgcccaccttgacacagtaacttcctcttatagtcaagatgatgattaagtgtttaatttttattccattttgttctgcaacacgttcaggtacttaaaactcattcatgcagttagaattatcctttatgtagtttgcatggtaaaggacattgtgtggtaaagggcattattgagtaatgaattttaagtatagcaaaatatgtatagtgtttatacatgatgctgatttcttaaaacctacatataagcagtagtactttttctctattataaagtattaattttgagttccattttataattctgatgtcttcattagaaatacaaaaatacaatccttgtattttttctttgaccagacccaaattttccccttcccccctccattctcctctccacttctcgtggaccgcgtgttcccaatattcattaacatttgcagccattacagagttacagttgtaaaattttcagctgtttttttttttttttttttgctctagcctgtctcatgttcttgcttctcttcatatgtaagtcagtatttttgtctacaaattaaaagtcacttgtcattcaaaaatgagttaagtaacatgataatcttttaaatttacctagctacaacttttatgtctcttgtaaatttatatatactttcagtgccattgtgaagaattggccttttaattctaagtagtattaccctatgaagcacagtgtgcaaaggtatgctacaaggtctctttaattcctgtgtggccattataattttataacaccattaccctttaaattctaccgattataagcagcgtaaaagtaactatataaagcaaacatcgcaaaggaactctgcaggagctcttaattcctttatgtagctatcataaaattcactttcctgaagacatttactctcattcacttccaaactccaaacctttttctggtagcaccacttttgtttttaatagaaagatgagttcatatctgtacatctctccaaagctctaaggaatgagaaaaggatcctagtatattgaaattactgatgtttaatacctctgccttttcactaaaagccatttaatatttttaaagtcaaaacttgacatacaggtatttataaggaatctccatgactctgaaggaatgaaattgatgtaggtagctttggctatgtaaagacatagtagaggacaattacttaaagaagagttttcttttgaggatttgtagatttgactaagcagctgaagtcagtaacccctcaagaaagtccgtttatagaagccaagaactgttggaggtctgtgatgcaggtttttctgttcccaacatcaaaagctgtggattatttggtgtgttcccctttatgttatctctcgataatttttgagacatcaagattttttaaaatatcaatactggaaagatgaaaccttcaaattaaaacctaaaattgattagaaagaaaagtaaaatattaatgcagtaaatttaggatggttacagatactcaccatcaacataaataaatggagttctaggataaattatttgtggaatactaatggtcaagtcacataagagtaaaatcttttggtgaggagacacatttgacaactgctaaagaattaactaaatttgtctttctaaatagttttctttataaagtaacagaaacattgtaaaaggataaatgactgtcataatgactta

SEQ ID NO: 1451 - DNA, 1609 bp, Homo sapiens
agtgaacagagtatctgtcaggcaagagctgctgtgatggtttatgatgatgccaataagaagtgggtgccagctggtggctcaactggattcagcagagttcatatctatcaccatacaggcaacaacacattcagagtggtgggcaggaagattcaggaccatcaggtcgtgataaactgtgccattcctaaagggttgaagtacaatcaagctacacagaccttccaccagtggcgagatgctagacaggtgtatggtctcaactttggcagcaaagaggatgccaatgtcttcgcaagtgccatgatgcatgccttagaagtgttaaattcacaggaaacagggccaacattgcctagacaaaactcacaactacctgctcaagttcaaaatggcccatcccaagaagaattggaaattcaaagaagacaactacaagaacagcaacggcaaaaggagctggagcgggaaaggctggagcgagaaagaatggaaagagaaaggttggagagagagaggttagaaagggaaaggctggagagggagcgactggaacaagaacagctggagagagagagacaagaacgggaacggcaggaacgcctggagcggcaggaacgcctggagcggcaggaacgcctggagcggcaggaacgcctggatcgggagaggcaagaaagacaagaacgagagaggctggagagactggaacgggagaggcaagaaagggagcgacaagagcagttagaaagggaacagctggaatgggagagagagcgcagaatatcaagtgctggcattgtcttgggaccacttgcacctccacctcctccaccactcccaccagggcctgcacaggcttcagtagccctccctcctcccccagggccccctccacctcctccactcccatccaccgggcctccaccgccccctcctccccctcctctccctaatcaagtaccccctcctcctccaccacctcctgccccacccctccctgcatctggattctttttggcatccatgtcagaagacaatcgccctttaactggacttgcagctgcaattgccggagcaaaacttaggaaagtgtcacggatggaggatacctctttcccaagtggagggaatgctattggtgtgaactccgcctcatctaaaacagatacaggccgtggaaatggaccccttcctttagggggtagtggtttaatggaagaaatgagtgccctgctggccaggaggagaagaattgctgaaaagggatcaacaatagaaacagaacaaaaagaggacaaaggtgaagattcagagcctgtaacttctaaggcctcttcaacaagtacacctgaaccaacaagaaaaccttgggaaagaacaaatacaatgaatggcagcaagtcacctgttatctccagaccaaaatccacacccttatcacagcccagtgccaatggagtccagacggaaggacttgactatgacaggctgaagcaggacattttagatgaaatgagaaaagaattaacaaagctaaaagaagagctcattgatgcaatcaggcaggaactgagcaagtcaaatactgcatagaggaacagac

SEQ ID NO: 1452 - DNA, 3059 bp, Homo sapiens
cctggggccaggactgctgctgtcactgccatccattggagcccagcaccccctccccgcccatccttcggacagcaactccagcccagccccgcgtccctgtgtccacttctcctgacccctcggccgccaccccagaaggctggagcagggacgccgtcgctccggccgcctgctcccctcgggtccccgtgcgagcccacgccggccccggtgcccgcccgcagccctgccactggacacaggataaggcccagcgcacaggcccccacgtggacagcatggaccgcggcacgctccctctggctgttgccctgctgctggccagctgcagcctcagccccacaagtcttgcagaaacagtccattgtgaccttcagcctgtgggccccgagaggggcgaggtgacatataccactagccaggtctcgaagggctgcgtggctcaggcccccaatgccatccttgaagtccatgtcctcttcctggagttcccaacgggcccgtcacagctggagctgactctccaggcatccaagcaaaatggcacctggccccgagaggtgcttctggtcctcagtgtaaacagcagtgtcttcctgcatctccaggccctgggaatcccactgcacttggcctacaattccagcctggtcaccttccaagagcccccgggggtcaacaccacagagctgccatccttccccaagacccagatccttgagtgggcagctgagaggggccccatcacctctgctgctgagctgaatgacccccagagcatcctcctccgactgggccaagcccaggggtcactgtccttctgcatgctggaagccagccaggacatgggccgcacgctcgagtggcggccgcgtactccagccttggtccggggctgccacttggaaggcgtggccggccacaaggaggcgcacatcctgagggtcctgccgggccactcggccgggccccggacggtgacggtgaaggtggaactgagctgcgcacccggggatctcgatgccgtcctcatcctgcagggtcccccctacgtgtcctggctcatcgacgccaaccacaacatgcagatctggaccactggagaatactccttcaagatctttccagagaaaaacattcgtggcttcaagctcccagacacacctcaaggcctcctgggggaggcccggatgctcaatgccagcattgtggcatccttcgtggagctaccgctggccagcattgtctcacttcatgcctccagctgcggtggtaggctgcagacctcacccgcaccgatccagaccactcctcccaaggacacttgtagcccggagctgctcatgtccttgatccagacaaagtgtgccgacgacgccatgaccctggtactaaagaaagagcttgttgcgcatttgaagtgcaccatcacgggcctgaccttctgggaccccagctgtgaggcagaggacaggggtgacaagtttgtcttgcgcagtgcttactccagctgtggcatgcaggtgtcagcaagtatgatcagcaatgaggcggtggtcaatatcctgtcgagctcatcaccacagcggaaaaaggtgcactgcctcaacatggacagcctctctttccagctgggcctctacctcagcccacacttcctccaggcctccaacaccatcgagccggggcagcagagctttgtgcaggtcagagtgtccccatccgtctccgagttcctgctccagttagacagctgccacctggacttggggcctgagggaggcaccgtggaactcatccagggccgggcggccaagggcaactgtgtgagcctgctgtccccaagccccgagggtgacccgcgcttcagcttcctcctccacttctacacagtacccatacccaaaaccggcaccctcagctgcacggtagccctgcgtcccaagaccgggtctcaagaccaggaagtccataggactgtcttcatgcgcttgaacatcatcagccctgacctgtctggttgcacaagcaaaggcctcgtcctgcccgccgtgctgggcatcacctttggtgccttcctcatcggggccctgctcactgctgcactctggtacatctactcgcacacgcgtgagtaccccaggcccccacagtgagcatgccgggcccctccatccacccgggggagcccagtgaagcctctgagggattgaggggccctggccaggaccctgacctccgcccctgcccccgctcccgctcccaggttcccccagcaagcgggagcccgtggtggcggtggctgccccggcctcctcggagagcagcagcaccaaccacagcatcgggagcacccagagcaccccctgctccaccagcagcatggcatagccccggccccccgcgctcgcccagcaggagagactgagcagccgccagctgggagcactggtgtgaactcaccctgggagccagtcctccactcgacccagaatggagcctgctctccgcgcctacccttcccgcctccctctcagaggcctgctgccagtgcagccactggcttggaacaccttggggtccctccaccccacagaaccttcaacccagtgggtctgggatatggctgcccaggagacagaccacttgccacgctgttgtaaaaacccaagtccctgtcatttgaacctggatccagcactggtgaactgagctgggcaggaagggagaacttgaaacagattcaggccagcccagccaggccaacagcacctccccgctgggaagagaagagggcccagcccagagccacctggatctatccctgcggcctccacacctgaacttgcctaactaactggcaggggagacaggagcctagcggagcccagcctgggagcccagagggtggcaagaacagtgggcgttgggagcctagctcctgccacatggagccccctctgccggtcgggcagccagcagagggggagtagccaagctgcttgtcctgggcctgcccctgtgtattcaccaccaataaatcagaccatgaaacc

SEQ ID NO: 1453 - DNA, 3048 bp, Homo sapiens
ggcaggcggcctggcccagccccttctctaaggaagcgcatttcctgcctccctgggccggccgggctggatgagccaggagctccctgctgccggtcataccacagccttcatctgcgccctggggccaggactgctgctgtcactgccatccattggagcccagcaccccctccccgcccatccttcggacagcaactccagcccagccccgcgtccctgtgtccacttctcctgacccctcggccgccaccccagaaggctggagcagggacgccgtcgctccggccgcctgctcccctcgggtccccgtgcgagcccacgccggccccggtgcccgcccgcagccctgccactggacacaggataaggcccagcgcacaggcccccacgtggacagcatggaccgcggcacgctccctctggctgttgccctgctgctggccagctgcagcctcagccccacaagtcttgcagaaacagtccattgtgaccttcagcctgtgggccccgagaggggcgaggtgacatataccactagccaggtctcgaagggctgcgtggctcaggcccccaatgccatccttgaagtccatgtcctcttcctggagttcccaacgggcccgtcacagctggagctgactctccaggcatccaagcaaaatggcacctggccccgagaggtgcttctggtcctcagtgtaaacagcagtgtcttcctgcatctccaggccctgggaatcccactgcacttggcctacaattccagcctggtcaccttccaagagcccccgggggtcaacaccacagagctgccatccttccccaagacccagatccttgagtgggcagctgagaggggccccatcacctctgctgctgagctgaatgacccccagagcatcctcctccgactgggccaagcccaggggtcactgtccttctgcatgctggaagccagccaggacatgggccgcacgctcgagtggcggccgcgtactccagccttggtccggggctgccacttggaaggcgtggccggccacaaggaggcgcacatcctgagggtcctgccgggccactcggccgggccccggacggtgacggtgaaggtggaactgagctgcgcacccggggatctcgatgccgtcctcatcctgcagggtcccccctacgtgtcctggctcatcgacgccaaccacaacatgcagatctggaccactggagaatactccttcaagatctttccagagaaaaacattcgtggcttcaagctcccagacacacctcaaggcctcctgggggaggcccggatgctcaatgccagcattgtggcatccttcgtggagctaccgctggccagcattgtctcacttcatgcctccagctgcggtggtaggctgcagacctcacccgcaccgatccagaccactcctcccaaggacacttgtagcccggagctgctcatgtccttgatccagacaaagtgtgccgacgacgccatgaccctggtactaaagaaagagcttgttgcgcatttgaagtgcaccatcacgggcctgaccttctgggaccccagctgtgaggcagaggacaggggtgacaagtttgtcttgcgcagtgcttactccagctgtggcatgcaggtgtcagcaagtatgatcagcaatgaggcggtggtcaatatcctgtcgagctcatcaccacagcggaaaaaggtgcactgcctcaacatggacagcctctctttccagctgggcctctacctcagcccacacttcctccaggcctccaacaccatcgagccggggcagcagagctttgtgcaggtcagagtgtccccatccgtctccgagttcctgctccagttagacagctgccacctggacttggggcctgagggaggcaccgtggaactcatccagggccgggcggccaagggcaactgtgtgagcctgctgtccccaagccccgagggtgacccgcgcttcagcttcctcctccacttctacacagtacccatacccaaaaccggcaccctcagctgcacggtagccctgcgtcccaagaccgggtctcaagaccaggaagtccataggactgtcttcatgcgcttgaacatcatcagccctgacctgtctggttgcacaagcaaaggcctcgtcctgcccgccgtgctgggcatcacctttggtgccttcctcatcggggccctgctcactgctgcactctggtacatctactcgcacacgcgttcccccagcaagcgggagcccgtggtggcggtggctgccccggcctcctcggagagcagcagcaccaaccacagcatcgggagcacccagagcaccccctgctccaccagcagcatggcatagccccggccccccgcgctcgcccagcaggagagactgagcagccgccagctgggagcactggtgtgaactcaccctgggagccagtcctccactcgacccagaatggagcctgctctccgcgcctacccttcccgcctccctctcagaggcctgctgccagtgcagccactggcttggaacaccttggggtccctccaccccacagaaccttcaacccagtgggtctgggatatggctgcccaggagacagaccacttgccacgctgttgtaaaaacccaagtccctgtcatttgaacctggatccagcactggtgaactgagctgggcaggaagggagaacttgaaacagattcaggccagcccagccaggccaacagcacctccccgctgggaagagaagagggcccagcccagagccacctggatctatccctgcggcctccacacctgaacttgcctaactaactggcaggggagacaggagcctagcggagcccagcctgggagcccagagggtggcaagaacagtgggcgttgggagcctagctcctgccacatggagccccctctgccggtcgggcagccagcagagggggagtagccaagctgcttgtcctgggcctgcccctgtgtattcaccaccaataaatcagaccatgaaaccagtga

SEQ ID NO: 1454 - DNA, 2654 bp, Homo sapiens
accacagccttcatctgcgccctggggccaggactgctgctgtcactgccatccattggagcccagcaccccctccccgcccatccttcggacagcaactccagcccagccccgcgtccctgtgtccacttctcctgacccctcggccgccaccccagaaggctggagcagggacgccgtcgctccggccgcctgctcccctcgggtccccgtgcgagcccacgccggccccggtgcccgcccgcagccctgccactggacacaggataaggcccagcgcacaggcccccacgtggacagcatggaccgcggcacgctccctctggctgttgccctgctgctggccagctgcagcctcagccccacaagtcttgcagaaacagtccattgtgaccttcagcctgtgggccccgagaggggcgaggtgacatataccactagccaggtctcgaagggctgcgtggctcaggcccccaatgccatccttgaagtccatgtcctcttcctggagttcccaacgggcccgtcacagctggagctgactctccaggcatccaagcaaaatggcacctggccccgagaggtgcttctggtcctcagtgtaaacagcagtgtcttcctgcatctccaggccctgggaatcccactgcacttggcctacaattccagcctggtcaccttccaagagcccccgggggtcaacaccacagagctgccatccttccccaagacccagatccttgagtgggcagctgagaggggccccatcacctctgctgctgagctgaatgacccccagagcatcctcctccgactgggccaagcccaggggtcactgtccttctgcatgctggaagccagccaggacatgggccgcacgctcgagtggcggccgcgtactccagccttggtccggggctgccacttggaaggcgtggccggccacaaggaggcgcacatcctgagggtcctgccgggccactcggccgggccccggacggtgacggtgaaggtggaactgagctgcgcacccggggatctcgatgccgtcctcatcctgcagggtcccccctacgtgtcctggctcatcgacgccaaccacaacatgcagatctggaccactggagaatactccttcaagatctttccagagaaaaacattcgtggcttcaagctcccagacacacctcaaggcctcctgggggaggcccggatgctcaatgccagcattgtggcatccttcgtggagctaccgctggccagcattgtctcacttcatgcctccagctgcggtggtaggctgcagacctcacccgcaccgatccagaccactcctcccaaggacacttgtagcccggagctgctcatgtccttgatccagacaaagtgtgccgacgacgccatgaccctggtactaaagaaagagcttgttgcgcatttgaagtgcaccatcacgggcctgaccttctgggaccccagctgtgaggcagaggacaggggtgacaagtttgtcttgcgcagtgcttactccagctgtggcatgcaggtgtcagcaagtatgatcagcaatgaggcggtggtcaatatcctgtcgagctcatcaccacagcggaaaaaggtgcactgcctcaacatggacagcctctctttccagctgggcctctacctcagcccacacttcctccaggcctccaacaccatcgagccggggcagcagagctttgtgcaggtcagagtgtccccatccgtctccgagttcctgctccagttagacagctgccacctggacttggggcctgagggaggcaccgtggaactcatccagggccgggcggccaagggcaactgtgtgagcctgctgtccccaagccccgagggtgacccgcgcttcagcttcctcctccacttctacacagtacccatacccaaaaccggcaccctcagctgcacggtagccctgcgtcccaagaccgggtctcaagaccaggaagtccataggactgtcttcatgcgcttgaacatcatcagccctgacctgtctggttgcacaagcaaaggcctcgtcctgcccgccgtgctgggcatcacctttggtgccttcctcatcggggccctgctcactgctgcactctggtacatctactcgcacacgcgttcccccagcaagcgggagcccgtggtggcggtggctgccccggcctcctcggagagcagcagcaccaaccacagcatcgggagcacccagagcaccccctgctccaccagcagcatggcatagccccggccccccgcgctcgcccagcaggagagactgagcagccgccagctgggagcactggtgtgaactcaccctgggagccagtcctccactctcagaggcctgctgccagtgcagccactggcttggaacaccttggggtccctccaccccacagaaccttcaacccagtgggtctgggatatggctgcccaggagacagaccacttgccacgctgttgtaaaaacccaagtccctgtcatttgaacctggatccagcactggtgaactgagctgggcaggaagggagaacttgaaacagattcaggccagcccagccaggccaacagcacctccccgctgggaagagaagagggcccagcccagagccacctg

SEQ ID NO: 1455 - DNA, 2149 bp, Homo sapiens
aaggctgctgtgaggatcaaatgagttcactcgtgtaaagctgcctaggctcccagtaagcatgatgggagcatctgcagtgattattggtggtctgcaaatggggaaactgaggctcagagaggttaggcttctgctcaaggtgaccagcattttaagaggcagagctgggatttgatccaggccatctggctccagagctgtttttcttgatcatcctccaaggtcttgcagaaacagtccattgtgaccttcagcctgtgggccccgagaggggcgaggtgacatataccactagccaggtctcgaagggctgcgtggctcaggcccccaatgccatccttgaagtccatgtcctcttcctggagttcccaacgggcccgtcacagctggagctgactctccaggcatccaagcaaaatggcacctggccccgagaggtgcttctggtcctcagtgtaaacagcagtgtcttcctgcatctccaggccctgggaatcccactgcacttggcctacaattccagcctggtcaccttccaagagcccccgggggtcaacaccacagagctgccatccttccccaagacccagatccttgagtgggcagctgagaggggccccatcacctctgctgctgagctgaatgacccccagagcatcctcctccgactgggccaagcccaggggtcactgtccttctgcatgctggaagccagccaggacatgggccgcacgctcgagtggcggccgcgtactccagccttggtccggggctgccacttggaaggcgtggccggccacaaggaggcgcacatcctgagggtcctgccgggccactcggccgggccccggacggtgacggtgaaggtggaactgagctgcgcacccggggatctcgatgccgtcctcatcctgcagggtcccccctacgtgtcctggctcatcgacgccaaccacaacatgcagatctggaccactggagaatactccttcaagatctttccagagaaaaacattcgtggcttcaagctcccagacacacctcaaggcctcctgggggaggcccggatgctcaatgccagcattgtggcatccttcgtggagctaccgctggccagcattgtctcacttcatgcctccagctgcggtggtaggctgcagacctcacccgcaccgatccagaccactcctcccaaggacacttgtagcccggagctgctcatgtccttgatccagacaaagtgtgccgacgacgccatgaccctggtactaaagaaagagcttgttgcgcatttgaagtgcaccatcacgggcctgaccttctgggaccccagctgtgaggcagaggacaggggtgacaagtttgtcttgcgcagtgcttactccagctgtggcatgcaggtgtcagcaagtatgatcagcaatgaggcggtggtcaatatcctgtcgagctcatcaccacagcggaaaaaggtgcactgcctcaacatggacagcctctctttccagctgggcctctacctcagcccacacttcctccaggcctccaacaccatcgagccggggcagcagagctttgtgcaggtcagagtgtccccatccgtctccgagttcctgctccagttagacagctgccacctggacttggggcctgagggaggcaccgtggaactcatccagggccgggcggccaagggcaactgtgtgagcctgctgtccccaagccccgagggtgacccgcgcttcagcttcctcctccacttctacacagtacccatacccaaaaccggcaccctcagctgcacggtagccctgcgtcccaagaccgggtctcaagaccaggaagtccataggactgtcttcatgcgcttgaacatcatcagccctgacctgtctggttgcacaagcaaaggcctcgtcctgcccgccgtgctgggcatcacctttggtgccttcctcatcggggccctgctcactgctgcactctggtacatctactcgcacacgcgttcccccagcaagcgggagcccgtggtggcggtggctgccccggcctcctcggagagcagcagcaccaaccacagcatcgggagcacccagagcaccccctgctccaccagcagcatggcatagccccggccccccgc

SEQ ID NO: 1456 - DNA, 2033 bp, Homo sapiens
acgcgcctctgcatctgcgccaggcgaacgggtcctgcgcctcctgcagtcccagctctccaccgccgcgtgcgcctgcagacgctccgctcgctgccttctctcctggcaggcgctgccttttctccccgttaaaagggcacttgggctgaaggatcgctttgagatctgaggaacccgcagcgctttgagggacctgaagctgtttttcttcgttttcctttgggttcagtttgaacgggaggtttttgatccctttttttcagaatggattatttgctcatgattttctctctgctgtttgtggcttgccaaggagctccagaaacagcagtcttaggcgctgagctcagcgcggtgggtgagaacggcggggagaaacccactcccagtccaccctggcggctccgccggtccaagcgctgctcctgctcgtccctgatggataaagagtgtgtctacttctgccacctggacatcatttgggtcaacactcccgagcacgttgttccgtatggacttggaagccctaggtccaagagagccttggagaatttacttcccacaaaggcaacagaccgtgaaaatagatgccaatgtgctagccaaaaagacaagaagtgctggaatttttgccaagcaggaaaagaactcagggctgaagacattatggagaaagactggaataatcataagaaaggaaaagactgttccaagcttgggaaaaagtgtatttatcagcagttagtgagaggaagaaaaatcagaagaagttcagaggaacacctaagacaaaccaggtcggagaccatgagaaacagcgtcaaatcatcttttcatgatcccaagctgaaaggcaagccctccagagagcgttatgtgacccacaaccgagcacattggtgacagaccttcggggcctgtctgaagccatagcctccacggagagccctgtggccgactctgcactctccaccctggctgggatcagagcaggagcatcctctgctggttcctgactggcaaaggaccagcgtcctcgttcaaaacattccaagaaaggttaaggagttcccccaaccatcttcactggcttccatcagtggtaactgctttggtctcttctttcatctggggatgacaatggacctctcagcagaaacacacagtcacattcgaattcgggtggcatcctccggagagagagagaggaaggagattccacacaggggtggagtttctgacgaaggtcctaagggagtgtttgtgtctgactcaggcgcctggcacatttcagggagaaactccaaagtccacacaaagattttctaaggaatgcacaaattgaaaacacactcaaaagacaaacatgcaagtaaagaaaaaaaaaagaaagacttttgtttaaatttgtaaaatgcaaaactgaatgaaactgttactaccataaatcaggatatgtttcatgaatatgagtctacctcacctatattgcactctggcagaagtatttcccacatttaattattgcctccccaaactcttcccacccctgctgccccttcctccatcccccatactaaatcctagcctcgtagaagtctggtctaatgtgtcagcagtagatataatattttcatggtaatctactagctctgatccataagaaaaaaaagatcattaaatcaggagattccctgtccttgatttttggagacacaatggtatagggttgtttatgaaatatattgaaaagtaagtgtttgttacgctttaaagcagtaaaattattttcctttatataaccggctaatgaaagaggttggattgaattttgatgtacttatttttttatagatatttatattcaaacaatttattccttatatttaccatgttaaatatctgtttgggcaggccatattggtctatgtatttttaaaatatgtatttctaaatgaaattgagaacatgctttgttttgcctgtcaaggtaatgactttagaaaataaatatttttttccttactgta

SEQ ID NO: 1457 - DNA, 4277 bp, Homo sapiens
atcaggaaggagtttcgacccgcgctggcgagtcatgagcgccaagtttcccactggcgcgcaaacttgagttacttttgagcgtggatactggcgaagaggctgcgggcggtattagcgtttgcagcgacttggctcgggcagctgacccaagtgtcctgtcttccttcctctgcttgtctctaggctctgaaactgcggagcggccaccggacgccttctggagcaggtagcagcatgcagccgcctccaagtctgtgcggacgcgccctggttgcgctggttcttgcctgcggcctgtcgcggatctggggagaggagagaggcttcccgcctgacagggccactccgcttttgcaaaccgcagagataatgacgccacccactaagaccttatggcccaagggttccaacgccagtctggcgcggtcgttggcacctgcggaggtgcctaaaggagacaggacggcaggatctccgccacgcaccatctcccctcccccgtgccaaggacccatcgagatcaaggagactttcaaatacatcaacacggttgtgtcctgccttgtgttcgtgctggggatcatcgggaactccacacttctgagaattatctacaagaacaagtgcatgcgaaacggtcccaatatcttgatcgccagcttggctctgggagacctgctgcacatcgtcattgacatccctatcaatgtctacaagctgctggcagaggactggccatttggagctgagatgtgtaagctggtgcctttcatacagaaagcctctgtgggaatcactgtgctgagtctatgtgctctgagtattgacagatatcgagctgttgcttcttggagtagaattaaaggaattggggttccaaaatggacagcagtagaaattgttttgatttgggtggtctctgtggttctggctgtccctgaagccataggttttgatataattacgatggactacaaaggaagttatctgcgaatctgcttgcttcatcccgttcagaagacagctttcatgcagttttacaagacagcaaaagattggtggctattcagtttctatttctgcttgccattggccatcactgcatttttttatacactaatgacctgtgaaatgttgagaaagaaaagtggcatgcagattgctttaaatgatcacctaaagcagagacgggaagtggccaaaaccgtcttttgcctggtccttgtctttgccctctgctggcttccccttcacctcagcaggattctgaagctcactctttataatcagaatgatcccaatagatgtgaacttttgagctttctgttggtattggactatattggtatcaacatggcttcactgaattcctgcattaacccaattgctctgtatttggtgagcaaaagattcaaaaactgctttaagtcatgcttatgctgctggtgccagtcatttgaagaaaaacagtccttggaggaaaagcagtcgtgcttaaagttcaaagctaatgatcacggatatgacaacttccgttccagtaataaatacagctcatcttgaaagaagaactattcactgtatttcattttctttatattggaccgaagtcattaaaacaaaatgaaacatttgccaaaacaaaacaaaaaactatgtatttgcacagcacactattaaaatattaagtgtaattattttaacactcacagctacatatgacattttatgagctgtttacggcatggaaagaaaatcagtgggaattaagaaagcctcgtcgtgaaagcacttaattttttacagttagcacttcaacatagctcttaacaacttccaggatattcacacaacacttaggcttaaaaatgagctcactcagaatttctattctttctaaaaagagatttatttttaaatcaatgggactctgatataaaggaagaataagtcactgtaaaacagaacttttaaatgaagcttaaattactcaatttaaaattttaaaatcctttaaaacaacttttcaattaatattatcacactattatcagattgtaattagatgcaaatgagagagcagtttagttgttgcatttttcggacactggaaacatttaaatgatcaggagggagtaacagaaagagcaaggctgtttttgaaaatcattacactttcactagaagcccaaacctcagcattctgcaatatgtaaccaacatgtcacaaacaagcagcatgtaacagactggcacatgtgccagctgaatttaaaatataatacttttaaaaagaaaattattacatcctttacattcagttaagatcaaacctcacaaagagaaatagaatgtttgaaaggctatcccaaaagacttttttgaatctgtcattcacataccctgtgaagacaatactatctacaattttttcaggattattaaaatcttcttctttcactatcgtagcttaaactctgtttggttttgtcatctgtaaatacttacctacatacactgcatgtagatgattaaatgagggcaggccctgtgctcatagctttacgatggagagatgccagtgacctcataataaagactgtgaactgcctggtgcagtgtccacatgacaaaggggcaggtagcaccctctctcacccatgctgtggttaaaatggtttctagcatatgtataatgctatagttaaaatactatttttcaaaatcatacagattagtacatttaacagctacctgtaaagcttattactaatttttgtattatttttgtaaatagccaatagaaaagtttgcttgacatggtgcttttctttcatctagaggcaaaactgctttttgagaccgtaagaacctcttagctttgtgcgttcctgcctaatttttatatcttctaagcaaagtgccttaggatagcttgggatgagatgtgtgtgaaagtatgtacaagagaaaacggaagagagaggaaatgaggtggggttggaggaaacccatggggacagattcccattcttagcctaacgttcgtcattgcctcgtcacatcaatgcaaaaggtcctgattttgttccagcaaaacacagtgcaatgttctcagagtgactttcgaaataaattgggcccaagagctttaactcggtcttaaaatatgcccaaatttttactttgtttttcttttaataggctgggccacatgttggaaataagctagtaatgttgttttctgtcaatattgaatgtgatggtacagtaaaccaaaacccaacaatgtggccagaaagaaagagcaataataattaattcacacaccatatggattctatttataaatcacccacaaacttgttctttaatttcatcccaatcactttttcagaggcctgttatcatagaagtcattttagactctcaattttaaattaattttgaatcactaatattttcacagtttattaatatatttaatttctatttaaattttagattatttttattaccatgtactgaatttttacatcctgataccttttccttctccatgtcagtatcatgttctctaattatcttgccaaattttgaaactacacacaaaaagcatacttgcattatttataataaaattgcattcagtggctttttaaaaaaatgtttgattcaaaactttaacatactgataagtaagaaacaattataatttctttacatactcaaaaccaagatagaaaaaggtgctatcgttcaacttcaaaacatgtttcctagtattaaggactttaatatagcaacagacaaaattattgttaacatggatgttacagctcaaaagatttataaaagattttaacctattttctcccttattatccactgctaatgtggatgtatgttcaaacaccttttagtattgatagcttacatatggccaaaggaatacagtttatagcaaaacatgggtatgctgtagctaactttataaaagtgtaatataacaatgtaaaaaattatatatctgggaggattttttggttgcctaaagtggctatagttactgattttttattatgtaagcaaaaccaataaaaatttaagtttttttaacaactaccttatttttcactgtacagacactaattcattaaatactaattgattgtttaaaagaaatataaatgtgacaagtggacattatttatgttaaatatacaattatcaagcaagtatgaagttattcaattaaaatgccacatttctgg

SEQ ID NO: 1458 - DNA, 4471 bp, Homo sapiens
aaacagccttttgggacctgtccccggacgaggactgcccccctccctcgggcaactactactgatgctgtccaggcatcgcccaaggggaaaggttgcagcggggtcggaaggcgcgggaggagtctggcggtgattgatgggaagggatgaatgaataaaagtacttgtctgatggcagcagagaccccgagcaaacggtggaggctacactgtctggcattctcgcagcgtttcgtcagagccggacccgcctgcagctcaagggaggcgtgctcctctcccagagcaggctggaacccagctgggttccgcctcccgggaaggtggtctccattcgtcgctctgcatctggtttgtcagatccgagaggctctgaaactgcggagcggccaccggacgccttctggagcaggtagcagcatgcagccgcctccaagtctgtgcggacgcgccctggttgcgctggttcttgcctgcggcctgtcgcggatctggggagaggagagaggcttcccgcctgacagggccactccgcttttgcaaaccgcagagataatgacgccacccactaagaccttatggcccaagggttccaacgccagtctggcgcggtcgttggcacctgcggaggtgcctaaaggagacaggacggcaggatctccgccacgcaccatctcccctcccccgtgccaaggacccatcgagatcaaggagactttcaaatacatcaacacggttgtgtcctgccttgtgttcgtgctggggatcatcgggaactccacacttctgagaattatctacaagaacaagtgcatgcgaaacggtcccaatatcttgatcgccagcttggctctgggagacctgctgcacatcgtcattgacatccctatcaatgtctacaagctgctggcagaggactggccatttggagctgagatgtgtaagctggtgcctttcatacagaaagcctctgtgggaatcactgtgctgagtctatgtgctctgagtattgacagatatcgagctgttgcttcttggagtagaattaaaggaattggggttccaaaatggacagcagtagaaattgttttgatttgggtggtctctgtggttctggctgtccctgaagccataggttttgatataattacgatggactacaaaggaagttatctgcgaatctgcttgcttcatcccgttcagaagacagctttcatgcagttttacaagacagcaaaagattggtggctattcagtttctatttctgcttgccattggccatcactgcatttttttatacactaatgacctgtgaaatgttgagaaagaaaagtggcatgcagattgctttaaatgatcacctaaagcagagacgggaagtggccaaaaccgtcttttgcctggtccttgtctttgccctctgctggcttccccttcacctcagcaggattctgaagctcactctttataatcagaatgatcccaatagatgtgaacttttgagctttctgttggtattggactatattggtatcaacatggcttcactgaattcctgcattaacccaattgctctgtatttggtgagcaaaagattcaaaaactgctttaagtcatgcttatgctgctggtgccagtcatttgaagaaaaacagtccttggaggaaaagcagtcgtgcttaaagttcaaagctaatgatcacggatatgacaacttccgttccagtaataaatacagctcatcttgaaagaagaactattcactgtatttcattttctttatattggaccgaagtcattaaaacaaaatgaaacatttgccaaaacaaaacaaaaaactatgtatttgcacagcacactattaaaatattaagtgtaattattttaacactcacagctacatatgacattttatgagctgtttacggcatggaaagaaaatcagtgggaattaagaaagcctcgtcgtgaaagcacttaattttttacagttagcacttcaacatagctcttaacaacttccaggatattcacacaacacttaggcttaaaaatgagctcactcagaatttctattctttctaaaaagagatttatttttaaatcaatgggactctgatataaaggaagaataagtcactgtaaaacagaacttttaaatgaagcttaaattactcaatttaaaattttaaaatcctttaaaacaacttttcaattaatattatcacactattatcagattgtaattagatgcaaatgagagagcagtttagttgttgcatttttcggacactggaaacatttaaatgatcaggagggagtaacagaaagagcaaggctgtttttgaaaatcattacactttcactagaagcccaaacctcagcattctgcaatatgtaaccaacatgtcacaaacaagcagcatgtaacagactggcacatgtgccagctgaatttaaaatataatacttttaaaaagaaaattattacatcctttacattcagttaagatcaaacctcacaaagagaaatagaatgtttgaaaggctatcccaaaagacttttttgaatctgtcattcacataccctgtgaagacaatactatctacaattttttcaggattattaaaatcttcttctttcactatcgtagcttaaactctgtttggttttgtcatctgtaaatacttacctacatacactgcatgtagatgattaaatgagggcaggccctgtgctcatagctttacgatggagagatgccagtgacctcataataaagactgtgaactgcctggtgcagtgtccacatgacaaaggggcaggtagcaccctctctcacccatgctgtggttaaaatggtttctagcatatgtataatgctatagttaaaatactatttttcaaaatcatacagattagtacatttaacagctacctgtaaagcttattactaatttttgtattatttttgtaaatagccaatagaaaagtttgcttgacatggtgcttttctttcatctagaggcaaaactgctttttgagaccgtaagaacctcttagctttgtgcgttcctgcctaatttttatatcttctaagcaaagtgccttaggatagcttgggatgagatgtgtgtgaaagtatgtacaagagaaaacggaagagagaggaaatgaggtggggttggaggaaacccatggggacagattcccattcttagcctaacgttcgtcattgcctcgtcacatcaatgcaaaaggtcctgattttgttccagcaaaacacagtgcaatgttctcagagtgactttcgaaataaattgggcccaagagctttaactcggtcttaaaatatgcccaaatttttactttgtttttcttttaataggctgggccacatgttggaaataagctagtaatgttgttttctgtcaatattgaatgtgatggtacagtaaaccaaaacccaacaatgtggccagaaagaaagagcaataataattaattcacacaccatatggattctatttataaatcacccacaaacttgttctttaatttcatcccaatcactttttcagaggcctgttatcatagaagtcattttagactctcaattttaaattaattttgaatcactaatattttcacagtttattaatatatttaatttctatttaaattttagattatttttattaccatgtactgaatttttacatcctgataccttttccttctccatgtcagtatcatgttctctaattatcttgccaaattttgaaactacacacaaaaagcatacttgcattatttataataaaattgcattcagtggctttttaaaaaaatgtttgattcaaaactttaacatactgataagtaagaaacaattataatttctttacatactcaaaaccaagatagaaaaaggtgctatcgttcaacttcaaaacatgtttcctagtattaaggactttaatatagcaacagacaaaattattgttaacatggatgttacagctcaaaagatttataaaagattttaacctattttctcccttattatccactgctaatgtggatgtatgttcaaacaccttttagtattgatagcttacatatggccaaaggaatacagtttatagcaaaacatgggtatgctgtagctaactttataaaagtgtaatataacaatgtaaaaaattatatatctgggaggattttttggttgcctaaagtggctatagttactgattttttattatgtaagcaaaaccaataaaaatttaagtttttttaacaactaccttatttttcactgtacagacactaattcattaaatactaattgattgtttaaaagaaatataaatgtgacaagtggacattatttatgttaaatatacaattatcaagcaagtatgaagttattcaattaaaatgccacatttctggtctctggg

SEQ ID NO: 1459 - DNA, 2530 bp, Homo sapiens
aagaaaaacagctgagagggcatcaggaaggagtttcgacccgcgctggcgagtcatgagcgccaagtttcccactggcgcgcaaacttgagttacttttgagcgtggatactggcgaagaggctgcgggcggtattagcgtttgcagcgacttggctcgggcagctgacccaagtgtcctgtcttccttcctctgcttgtctctaggctctgaaactgcggagcggccaccggacgccttctggagcaggtagcagcatgcagccgcctccaagtctgtgcggacgcgccctggttgcgctggttcttgcctgcggcctgtcgcggatctggggagaggagagaggcttcccgcctgacagggccactccgcttttgcaaaccgcagagataatgacgccacccactaagaccttatggcccaagggttccaacgccagtctggcgcggtcgttggcacctgcggaggtgcctaaaggagacaggacggcaggatctccgccacgcaccatctcccctcccccgtgccaaggacccatcgagatcaaggagactttcaaatacatcaacacggttgtgtcctgccttgtgttcgtgctggggatcatcgggaactccacacttctgagaattatctacaagaacaagtgcatgcgaaacggtcccaatatcttgatcgccagcttggctctgggagacctgctgcacatcgtcattgacatccctatcaatgtctacaagctgctggcagaggactggccatttggagctgagatgtgtaagctggtgcctttcatacagaaagcctctgtgggaatcactgtgctgagtctatgtgctctgagtattgacagatatcgagctgttgcttcttggagtagaattaaaggaattggggttccaaaatggacagcagtagaaattgttttgatttgggtggtctctgtggttctggctgtccctgaagccataggttttgatataattacgatggactacaaaggaagttatctgcgaatctgcttgcttcatcccgttcagaagacagctttcatgcagttttacaagacagcaaaagattggtggctattcagtttctatttctgcttgccattggccatcactgcatttttttatacactaatgacctgtgaaatgttgagaaagaaaagtggcatgcagattgctttaaatgatcacctaaagcagagacgggaagtggccaaaaccgtcttttgcctggtccttgtctttgccctctgctggcttccccttcacctcagcaggattctgaagctcactctttataatcagaatgatcccaatagatgtgaacttttgagctttctgttggtattggactatattggtatcaacatggcttcactgaattcctgcattaacccaattgctctgtatttggtgagcaaaagattcaaaaactgctttaaggctgggccacatgttggaaataagctagtaatgttgttttctgtcaatattgaatgtgatggtacagtaaaccaaaacccaacaatgtggccagaaagaaagagcaataataattaattcacacaccatatggattctatttataaatcacccacaaacttgttctttaatttcatcccaatcactttttcagaggcctgttatcatagaagtcattttagactctcaattttaaattaattttgaatcactaatattttcacagtttattaatatatttaatttctatttaaattttagattatttttattaccatgtactgaatttttacatcctgataccttttccttctccatgtcagtatcatgttctctaattatcttgccaaattttgaaactacacacaaaaagcatacttgcattatttataataaaattgcattcagtggctttttaaaaaaatgtttgattcaaaactttaacatactgataagtaagaaacaattataatttctttacatactcaaaaccaagatagaaaaaggtgctatcgttcaacttcaaaacatgtttcctagtattaaggactttaatatagcaacagacaaaattattgttaacatggatgttacagctcaaaagatttataaaagattttaacctattttctcccttattatccactgctaatgtggatgtatgttcaaacaccttttagtattgatagcttacatatggccaaaggaatacagtttatagcaaaacatgggtatgctgtagctaactttataaaagtgtaatataacaatgtaaaaaattatatatctgggaggattttttggttgcctaaagtggctatagttactgattttttattatgtaagcaaaaccaataaaaatttaagtttttttaacaactaccttatttttcactgtacagacactaattcattaaatactaattgattgtttaaaagaaatataaatgtgacaagtggacattatttatgttaaatatacaattatcaagcaagtatgaagttattcaattaaaatgccacatttctggtctctggg

SEQ ID NO: 1460 - DNA, 2993 bp, Homo sapiens
attctgctggctgcgcggtggcggcggctgtgtgtgcgccgcgccttgccgccccccctggccccccgagcccggggcgcagccatggctctgcggaggctgggggccgcgctgctgctgctgccgctgctcgccgccgtggaagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgaggttgtccatctgggactttcaaggccaaccaaggggatgaggcctgtacccactgtcccatcaacagccggaccacttctgaaggggccaccaactgtgtctgccgcaatggctactacagagcagacctggaccccctggacatgccctgcacaaccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcagctccatcggcagtgtccatcatgcatcaggtgagccgcaccgtggacagcattaccctgtcgtggtcccagccggaccagcccaatggcgtgatcctggactatgagctgcagtactatgagaaggagctcagtgagtacaacgccacagccataaaaagccccaccaacacggtcaccgtgcagggcctcaaagccggcgccatctatgtcttccaggtgcgggcacgcaccgtggcaggttacgggcgctacagcggcaagatgtacttccagaccatgacagaagtgaccccaggcatgaagatctacatcgatcctttcacctacgaggaccccaacgaggcagtgcgggagtttgccaaggaaattgacatctcctgtgtcaaaattgagcaggtgatcggagcaggggagtttggcgaggtctgcagtggccacctgaagctgccaggcaagagagagatctttgtggccatcaagacgctcaagtcgggctacacggagaagcagcgccgggacttcctgagcgaagcctccatcatgggccagttcgaccatcccaacgtcatccacctggagggtgtcgtgaccaagagcacacctgtgatgatcatcaccgagttcatggagaatggctccctggactcctttctccggcaaaacgatgggcagttcacagtcatccagctggtgggcatgcttcggggcatcgcagctggcatgaagtacctggcagacatgaactatgttcaccgtgacctggctgcccgcaacatcctcgtcaacagcaacctggtctgcaaggtgtcggactttgggctctcacgctttctagaggacgatacctcagaccccacctacaccagtgccctgggcggaaagatccccatccgctggacagccccggaagccatccagtaccggaagttcacctcggccagtgatgtgtggagctacggcattgtcatgtgggaggtgatgtcctatggggagcggccctactgggacatgaccaaccaggatgtaatcaatgccattgagcaggactatcggctgccaccgcccatggactgcccgagcgccctgcaccaactcatgctggactgttggcagaaggaccgcaaccaccggcccaagttcggccaaattgtcaacacgctagacaagatgatccgcaatcccaacagcctcaaagccatggcgcccctctcctctggcatcaacctgccgctgctggaccgcacgatccccgactacaccagctttaacacggtggacgagtggctggaggccatcaagatggggcagtacaaggagagcttcgccaatgccggcttcacctcctttgacgtcgtgtctcagatgatgatggaggacattctccgggttggggtcactttggctggccaccagaaaaaaatcctgaacagtatccaggtgatgcgggcgcagatgaaccagattcagtctgtggaggtttgacattcacctgcctcggctcacctcttcctccaagccccgccccctctgccccacgtgccggccctcctggtgctctatccactgcagggccagccactcgccaggaggccacgggccacggg

SEQ ID NO: 1461 - DNA, 4014 bp, Homo sapiens
taacacagttgtgaaaatagatggatgtgggttccagtcctagccctgcctgtgtgcacttatgcagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgaggttgtccatctgggactttcaaggccaaccaaggggatgaggcctgtacccactgtcccatcaacagccggaccacttctgaaggggccaccaactgtgtctgccgcaatggctactacagagcagacctggaccccctggacatgccctgcacaaccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcagctccatcggcagtgtccatcatgcatcaggtgagccgcaccgtggacagcattaccctgtcgtggtcccagccggaccagcccaatggcgtgatcctggactatgagctgcagtactatgagaagcaggagctcagtgagtacaacgccacagccataaaaagccccaccaacacggtcaccgtgcagggcctcaaagccggcgccatctatgtcttccaggtgcgggcacgcaccgtggcaggttacgggcgctacagcggcaagatgtacttccagaccatgacagaagccgagtaccagacaagcatccaggagaagttgccactcatcatcggctcctcggccgctggcctggtcttcctcattgctgtggttgtcatcgccatcgtgtgtaacagacgggggtttgagcgtgctgactcggagtacacggacaagctgcaacactacaccagtggccacatgaccccaggcatgaagatctacatcgatcctttcacctacgaggaccccaacgaggcagtgcgggagtttgccaaggaaattgacatctcctgtgtcaaaattgagcaggtgatcggagcaggggagtttggcgaggtctgcagtggccacctgaagctgccaggcaagagagagatctttgtggccatcaagacgctcaagtcgggctacacggagaagcagcgccgggacttcctgagcgaagcctccatcatgggccagttcgaccatcccaacgtcatccacctggagggtgtcgtgaccaagagcacacctgtgatgatcatcaccgagttcatggagaatggctccctggactcctttctccggcaaaacgatgggcagttcacagtcatccagctggtgggcatgcttcggggcatcgcagctggcatgaagtacctggcagacatgaactatgttcaccgtgacctggctgcccgcaacatcctcgtcaacagcaacctggtctgcaaggtgtcggactttgggctctcacgctttctagaggacgatacctcagaccccacctacaccagtgccctgggcggaaagatccccatccgctggacagccccggaagccatccagtaccggaagttcacctcggccagtgatgtgtggagctacggcattgtcatgtgggaggtgatgtcctatggggagcggccctactgggacatgaccaaccaggatgtaatcaatgccattgagcaggactatcggctgccaccgcccatggactgcccgagcgccctgcaccaactcatgctggactgttggcagaaggaccgcaaccaccggcccaagttcggccaaattgtcaacacgctagacaagatgatccgcaatcccaacagcctcaaagccatggcgcccctctcctctggcatcaacctgccgctgctggaccgcacgatccccgactacaccagctttaacacggtggacgagtggctggaggccatcaagatggggcagtacaaggagagcttcgccaatgccggcttcacctcctttgacgtcgtgtctcagatgatgatggagtaagtgcccagccacttctgcttgtcaccttagcaccccctctccaccggccccaccagccaagtggggtgatctggagggtgaggaatagatcatgtcccaatagggaagcagggaccaaggggcaagatggccaactttggagtcacctgtggactgatacccaggtctgcctgccacctacaagctctgtgaccttggtcaaatcatagcacctccctcagcctccgttttctcacctacaaactgggggttggtaggaaggttgagggagatataaaggaagcgggtgcttagaaaatgcaagctggcagccgggcacagtggctcatgcctgtaatcttagtacattgggaggccgaggcgggcagatcacaaggtcaggagttcaagaccagcctgaccaacatggtgaaaccccgtctctactaaaatgcaaaaaattagccacgcaaggtggcatgcacctgtaatgccagctactcgggaggctgaggcaggggaattgcttgaaccaaggaggtagaggttgcagtgagctgagatcacgccactgcacaccagcctgggtgacagagcgagactctgtctcgaaaaagaaagaaaatgtaagctggcttccccctcccaatagcaggggagagaaggccccctagggaccctgattccgactcaagtgctcttccacctcacaccatagtcgctccctccagctgtggctgcctgcccactccccactccccactccccagtactccttgctttgccatcttcctcccggggaagcccaggcagctctctaccaggcacaggaccccttcacccgcatatttccctaacacacgtgcttctctcccaaagggacattctccgggttggggtcactttggctggccaccagaaaaaaatcctgaacagtatccaggtgatgcgggcgcagatgaaccagattcagtctgtggaggtttgacattcacctgcctcggctcacctcttcctccaagccccgccccctctgccccacgtgccggccctcctggtgctctatccactgcagggccagccactcgccaggaggccacgggccacgggaagaaccaagcggtgccagccacgagacgtcaccaagaaaacatgcaactcaaacgacgg

SEQ ID NO: 1462 - DNA, 3152 bp, Homo sapiens
gccccgggaagcgcagccatggctctgcggaggctgggggccgcgctgctgctgctgccgctgctcgccgccgtggaagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgaggttgtccatctgggactttcaaggccaaccaaggggatgaggcctgtacccactgtcccatcaacagccggaccacttctgaaggggccaccaactgtgtctgccgcaatggctactacagagcagacctggaccccctggacatgccctgcacaaccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcagctccatcggcagtgtccatcatgcatcaggtgagccgcaccgtggacagcattaccctgtcgtggtcccagccggaccagcccaatggcgtgatcctggactatgagctgcagtactatgagaaggagctcagtgagtacaacgccacagccataaaaagccccaccaacacggtcaccgtgcagggcctcaaagccggcgccatctatgtcttccaggtgcgggcacgcaccgtggcaggttacgggcgctacagcggcaagatgtacttccagaccatgacagaagccgagtaccagacaagcatccaggagaagttgccactcatcatcggctcctcggccgctggcctggtcttcctcattgctgtggttgtcatcgccatcgtgtgtaacagacgggggtttgagcgtgctgactcggagtacacggacaagctgcaacactacaccagtggccacatgaccccaggcatgaagatctacatcgatcctttcacctacgaggaccccaacgaggcagtgcgggagtttgccaaggaaattgacatctcctgtgtcaaaattgagcaggtgatcggagcaggggagtttggcgaggtctgcagtggccacctgaagctgccaggcaagagagagatctttgtggccatcaagacgctcaagtcgggctacacggagaagcagcgccgggacttcctgagcgaagcctccatcatgggccagttcgaccatcccaacgtcatccacctggagggtgtcgtgaccaagagcacacctgtgatgatcatcaccgagttcatggagaatggctccctggactcctttctccggcaaaacgatgggcagttcacagtcatccagctggtgggcatgcttcggggcatcgcagctggcatgaagtacctggcagacatgaactatgttcaccgtgacctggctgcccgcaacatcctcgtcaacagcaacctggtctgcaaggtgtcggactttgggctctcacgctttctagaggacgatacctcagaccccacctacaccagtgccctgggcggaaagatccccatccgctggacagccccggaagccatccagtaccggaagttcacctcggccagtgatgtgtggagctacggcattgtcatgtgggaggtgatgtcctatggggagcggccctactgggacatgaccaaccaggatgtaatcaatgccattgagcaggactatcggctgccaccgcccatggactgcccgagcgccctgcaccaactcatgctggactgttggcagaaggaccgcaaccaccggcccaagttcggccaaattgtcaacacgctagacaagatgatccgcaatcccaacagcctcaaagccatggcgcccctctcctctggcatcaacctgccgctgctggaccgcacgatccccgactacaccagctttaacacggtggacgagtggctggaggccatcaagatggggcagtacaaggagagcttcgccaatgccggcttcacctcctttgacgtcgtgtctcagatgatgatggaggacattctccgggttggggtcactttggctggccaccagaaaaaaatcctgaacagtatccaggtgatgcgggcgcagatgaaccagattcagtctgtggaggtttgacattcacctgcctcggctcacctcttcctccaagccccgccccctctgccccacgtgccggccctcctggtgctctatccactgcagggccagccactcgccaggaggccacgggccacgggaagaaccaagcggtgccagccacgagacgtcaccaagaaaacatgcaactc

SEQ ID NO: 1463 - DNA, 3677 bp, Homo sapiens
gggaagcgcagccatggctctgcggaggctgggggccgcgctgctgctgctgccgctgctcgccgccgtggaagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgaggttgtccatctgggactttcaaggccaaccaaggggatgaggcctgtacccactgtcccatcaacagccggaccacttctgaaggggccaccaactgtgtctgccgcaatggctactacagagcagacctggaccccctggacatgccctgcacaaccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcagctccatcggcagtgtccatcatgcatcaggtgagccgcaccgtggacagcattaccctgtcgtggtcccagccggaccagcccaatggcgtgatcctggactatgagctgcagtactatgagaaggagctcagtgagtacaacgccacagccataaaaagccccaccaacacggtcaccgtgcagggcctcaaagccggcgccatctatgtcttccaggtgcgggcacgcaccgtggcaggttacgggcgctacagcggcaagatgtacttccagaccatgacagaagccgagtaccagacaagcatccaggagaagttgccactcatcatcggctcctcggccgctggcctggtcttcctcattgctgtggttgtcatcgccatcgtgtgtaacagaagacgggggtttgagcgtgctgactcggagtacacggacaagctgcaacactacaccagtggccacatgaccccaggcatgaagatctacatcgatcctttcacctacgaggaccccaacgaggcagtgcgggagtttgccaaggaaattgacatctcctgtgtcaaaattgagcaggtgatcggagcaggggagtttggcgaggtctgcagtggccacctgaagctgccaggcaagagagagatctttgtggccatcaagacgctcaagtcgggctacacggagaagcagcgccgggacttcctgagcgaagcctccatcatgggccagttcgaccatcccaacgtcatccacctggagggtgtcgtgaccaagagcacacctgtgatgatcatcaccgagttcatggagaatggctccctggactcctttctccggcaaaacgatgggcagttcacagtcatccagctggtgggcatgcttcggggcatcgcagctggcatgaagtacctggcagacatgaactatgttcaccgtgacctggctgcccgcaacatcctcgtcaacagcaacctggtctgcaaggtgtcggactttgggctctcacgctttctagaggacgatacctcagaccccacctacaccagtgccctgggcggaaagatccccatccgctggacagccccggaagccatccagtaccggaagttcacctcggccagtgatgtgtggagctacggcattgtcatgtgggaggtgatgtcctatggggagcggccctactgggacatgaccaaccaggatgtaatcaatgccattgagcaggactatcggctgccaccgcccatggactgcccgagcgccctgcaccaactcatgctggactgttggcagaaggaccgcaaccaccggcccaagttcggccaaattgtcaacacgctagacaagatgatccgcaatcccaacagcctcaaagccatggcgcccctctcctctggcatcaacctgccgctgctggaccgcacgatccccgactacaccagctttaacacggtggacgagtggctggaggccatcaagatggggcagtacaaggagagcttcgccaatgccggcttcacctcctttgacgtcgtgtctcagatgatgatggaggacattctccgggttggggtcactttggctggccaccagaaaaaaatcctgaacagtatccaggtgatgcgggcgcagatgaaccagattcagtctgtggaggtttgacattcacctgcctcggctcacctcttcctccaagccccgccccctctgccccacgtgccggccctcctggtgctctatccactgcagggccagccactcgccaggaggccacgggccacgggaagaaccaagcggtgccagccacgagacgtcaccaagaaaacatgcaactcaaacgacggaaaaaaaaagggaatgggaaaaaagaaaacagatcctgggagggggcgggaaatacaaggaatattttttaaagaggattctcataaggaaagcaatgactgttcttgcgggggataaaaaagggcttgggagattcatgcgatgtgtccaatcggagacaaaagcagtttctctccaactccctctgggaaggtgacctggccagagccaagaaacactttcagaaaaacaaatgtgaaggggagagacaggggccgcccttggctcctgtccctgctgctcctctaggcctcactcaacaaccaagcgcctggaggacgggacagatggacagacagccaccctgagaacccctctgggaaaatctattcctgccaccactgggcaaacagaagaatttttctgtctttggagagtattttagaaactccaatgaaagacactgtttctcctgttggctcacagggctgaaaggggcttttgtcctcctgggtcagggagaacgcggggaccccag

SEQ ID NO: 1464 - DNA, 4641 bp, Homo sapiens
gccccgggaagcgcagccatggctctgcggaggctgggggccgcgctgctgctgctgccgctgctcgccgccgtggaagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgaggttgtccatctgggactttcaaggccaaccaaggggatgaggcctgtacccactgtcccatcaacagccggaccacttctgaaggggccaccaactgtgtctgccgcaatggctactacagagcagacctggaccccctggacatgccctgcacaaccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcagctccatcggcagtgtccatcatgcatcaggtgagccgcaccgtggacagcattaccctgtcgtggtcccagccggaccagcccaatggcgtgatcctggactatgagctgcagtactatgagaaggagctcagtgagtacaacgccacagccataaaaagccccaccaacacggtcaccgtgcagggcctcaaagccggcgccatctatgtcttccaggtgcgggcacgcaccgtggcaggttacgggcgctacagcggcaagatgtacttccagaccatgacagaagccgagtaccagacaagcatccaggagaagttgccactcatcatcggctcctcggccgctggcctggtcttcctcattgctgtggttgtcatcgccatcgtgtgtaacagacgggggtttgagcgtgctgactcggagtacacggacaagctgcaacactacaccagtggccacatgaccccaggcatgaagatctacatcgatcctttcacctacgaggaccccaacgaggcagtgcgggagtttgccaaggaaattgacatctcctgtgtcaaaattgagcaggtgatcggagcaggggagtttggcgaggtctgcagtggccacctgaagctgccaggcaagagagagatctttgtggccatcaagacgctcaagtcgggctacacggagaagcagcgccgggacttcctgagcgaagcctccatcatgggccagttcgaccatcccaacgtcatccacctggagggtgtcgtgaccaagagcacacctgtgatgatcatcaccgagttcatggagaatggctccctggactcctttctccggcaaaacgatgggcagttcacagtcatccagctggtgggcatgcttcggggcatcgcagctggcatgaagtacctggcagacatgaactatgttcaccgtgacctggctgcccgcaacatcctcgtcaacagcaacctggtctgcaaggtgtcggactttgggctctcacgctttctagaggacgatacctcagaccccacctacaccagtgccctgggcggaaagatccccatccgctggacagccccggaagccatccagtaccggaagttcacctcggccagtgatgtgtggagctacggcattgtcatgtgggaggtgatgtcctatggggagcggccctactgggacatgaccaaccaggatgtaatcaatgccattgagcaggactatcggctgccaccgcccatggactgcccgagcgccctgcaccaactcatgctggactgttggcagaaggaccgcaaccaccggcccaagttcggccaaattgtcaacacgctagacaagatgatccgcaatcccaacagcctcaaagccatggcgcccctctcctctggcatcaacctgccgctgctggaccgcacgatccccgactacaccagctttaacacggtggacgagtggctggaggccatcaagatggggcagtacaaggagagcttcgccaatgccggcttcacctcctttgacgtcgtgtctcagatgatgatggaggacattctccgggttggggtcactttggctggccaccagaaaaaaatcctgaacagtatccaggtgatgcgggcgcagatgaaccagattcagtctgtggagggccagccactcgccaggaggccacgggccacgggaagaaccaagcggtgccagccacgagacgtcaccaagaaaacatgcaactcaaacgacggaaaaaaaaagggaatgggaaaaaagaaaacagatcctgggagggggcgggaaatacaaggaatattttttaaagaggattctcataaggaaagcaatgactgttcttgcgggggataaaaaagggcttgggagattcatgcgatgtgtccaatcggagacaaaagcagtttctctccaactccctctgggaaggtgacctggccagagccaagaaacactttcagaaaaacaaatgtgaaggggagagacaggggccgcccttggctcctgtccctgctgctcctctaggcctcactcaacaaccaagcgcctggaggacgggacagatggacagacagccaccctgagaacccctctgggaaaatctattcctgccaccactgggcaaacagaagaatttttctgtctttggagagtattttagaaactccaatgaaagacactgtttctcctgttggctcacagggctgaaaggggcttttgtcctcctgggtcagggagaacgcggggaccccagaaaggtcagccttcctgaggatgggcaacccccaggtctgcagctccaggtacatatcacgcgcacagcctggcagcctggccctcctggtgcccactcccgccagcccctgcctcgaggactgatactgcagtgactgccgtcagctccgactgccgctgagaagggttgatcctgcatctgggtttgtttacagcaattcctggactcgggggtattttggtcacagggtggttttggtttagggggtttgtttgttgggttgttttttgttttttggttttttttaatgacaatgaagtgacactttgacatttcctaccttttgaggacttgatccttctccaggaagaaggtgctttctgcttactgacttaggcaatacaccaagggcgagattttatatgcacatttctggatttttttatacggttttcattgacactcttccctcctcccacctgccaccaggcctcaccaaagcccactgccatggggccatctgggccattcagagactggagtgagatttgggtgtggagggggaggcgccaaggtggaggagcttcccactccaggactgttgatgaaagggacagattgaggaggaagtgggctctgaggctgcagggctggaagtccttgcccacttcccactctcctgccccaatctatctagtacttcccaggcaaataggcccctttgaggctcctgagtgccctcagatggtcaaaacccagttttccctctgggagcctaaaccaggctgcatcggaggccaggacccggatcattcactgtgataccctgccctccagagggtgcgctcagagacacgggcaagcatgcctcttcccttccctggagagaaagtgtgtgatttctctcccacctccttccccccaccagacctttgctgggcctaaaggtcttggccatggggacgccctcagtctagggatctggccacagactccctcctgtgaaccaacacagacacccaagcagagcaatcagttagtgaattgaatggaaataaacgctttagttataa

SEQ ID NO: 1465 - DNA, 1709 bp, Homo sapiens
attctgctggctgcgcggtggcggcggctgtgtgtgcgccgcgccttgccgccccccctggccccccgagcccggggcgcgcgctcccgcccgggccgtccgggccccgcggcgccgcggcccgaggccccgggaagcgcagccatggctctgcggaggctgggggccgcgctgctgctgctgccgctgctcgccgccgtggaagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgaggttgtccatctgggactttcaaggccaaccaaggggatgaggcctgtacccactgtcccatcaacagccggaccacttctgaaggggccaccaactgtgtctgccgcaatggctactacagagcagacctggaccccctggacatgccctgcacaaccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcagctccatcggcagtgtccatcatgcatcaggtgagccgcaccgtggacagcattaccctgtcgtggtcccagccggaccagcccaatggcgtgatcctggactatgagctgcagtactatgagaagatgaagacacagagaagttaaggaacttgcccaaggtcacagaggtcatatatactagagccaggatttgaacccaagaagtctggctccagcttgtgatcttaacctccatgctataaagcctgtaataacattgc

SEQ ID NO: 1466 - DNA, 4329 bp, Homo sapiens
cccggcccggcccgcccggctccgcgccgcagtctccctccctcccgctccgtccccgctcgggctcccaccatccccgcccgcgaggagagcactcggcccggcggcgcgagcagagccactccagggagggggggagaccgcgagcggccggctcagcccccgccacccggggcgggaccccgaggccccggagggaccccaactccagccacgtcttgctgcgcgcccgcccggcgcggccactgccagcacgctccgggcccgccgcccgcgcgcgcggcacagacgcggggccacacttggcgccgccgcccggtgccccgcacgctcgcatgggcccgcgctgagggccccgacgaggagtcccgcgcggagtatcggcgtccacccgcccagggagagtcagacctgggggggcgagggccccccaaactcagttcggatcctacccgagtgaggcggcgccatggagctccgggtgctgctctgctgggcttcgttggccgcagctttggaagagaccctgctgaacacaaaattggaaactgctgatctgaagtgggtgacattccctcaggtggacgggcagtgggaggaactgagcggcctggatgaggaacagcacagcgtgcgcacctacgaagtgtgtgacgtgcagcgtgccccgggccaggcccactggcttcgcacaggttgggtcccacggcggggcgccgtccacgtgtacgccacgctgcgcttcaccatgctcgagtgcctgtccctgcctcgggctgggcgctcctgcaaggagaccttcaccgtcttctactatgagagcgatgcggacacggccacggccctcacgccagcctggatggagaacccctacatcaaggtggacacggtggccgcggagcatctcacccggaagcgccctggggccgaggccaccgggaaggtgaatgtcaagacgctgcgtctgggaccgctcagcaaggctggcttctacctggccttccaggaccagggtgcctgcatggccctgctatccctgcacctcttctacaaaaagtgcgcccagctgactgtgaacctgactcgattcccggagactgtgcctcgggagctggttgtgcccgtggccggtagctgcgtggtggatgccgtccccgcccctggccccagccccagcctctactgccgtgaggatggccagtgggccgaacagccggtcacgggctgcagctgtgctccggggttcgaggcagctgaggggaacaccaagtgccgagcctgtgcccagggcaccttcaagcccctgtcaggagaagggtcctgccagccatgcccagccaatagccactctaacaccattggatcagccgtctgccagtgccgcgtcgggtacttccgggcacgcacagacccccggggtgcaccctgcaccacccctccttcggctccgcggagcgtggtttcccgcctgaacggctcctccctgcacctggaatggagtgcccccctggagtctggtggccgagaggacctcacctacgccctccgctgccgggagtgccgacccggaggctcctgtgcgccctgcgggggagacctgacttttgaccccggcccccgggacctggtggagccctgggtggtggttcgagggctacgtcctgacttcacctatacctttgaggtcactgcattgaacggggtatcctccttagccacggggcccgtcccatttgagcctgtcaatgtcaccactgaccgagaggtacctcctgcagtgtctgacatccgggtgacgcggtcctcacccagcagcttgagcctggcctgggctgttccccgggcacccagtggggctgtgctggactacgaggtcaaataccatgagaagggcgccgagggtcccagcagcgtgcggttcctgaagacgtcagaaaaccgggcagagctgcgggggctgaagcggggagccagctacctggtgcaggtacgggcgcgctctgaggccggctacgggcccttcggccaggaacatcacagccagacccaactggatgagagcgagggctggcgggagcagctggccctgattgcgggcacggcagtcgtgggtgtggtcctggtcctggtggtcattgtggtcgcagttctctgcctcaggaagcagagcaatgggagagaagcagaatattcggacaaacacggacagtatctcatcggacatggtactaaggtctacatcgaccccttcacttatgaagaccctaatgaggctgtgagggaatttgcaaaagagatcgatgtctcctacgtcaagattgaagaggtgattggtgcaggtgagtttggcgaggtgtgccgggggcggctcaaggccccagggaagaaggagagctgtgtggcaatcaagaccctgaagggtggctacacggagcggcagcggcgtgagtttctgagcgaggcctccatcatgggccagttcgagcaccccaatatcatccgcctggagggcgtggtcaccaacagcatgcccgtcatgattctcacagagttcatggagaacggcgccctggactccttcctgcggctaaacgacggacagttcacagtcatccagctcgtgggcatgctgcggggcatcgcctcgggcatgcggtaccttgccgagatgagctacgtccaccgagacctggctgctcgcaacatcctagtcaacagcaacctcgtctgcaaagtgtctgactttggcctttcccgattcctggaggagaactcttccgatcccacctacacgagctccctgggaggaaagattcccatccgatggactgccccggaggccattgccttccggaagttcacttccgccagtgatgcctggagttacgggattgtgatgtgggaggtgatgtcatttggggagaggccgtactgggacatgagcaatcaggacgtgatcaatgccattgaacaggactaccggctgcccccgcccccagactgtcccacctccctccaccagctcatgctggactgttggcagaaagaccggaatgcccggccccgcttcccccaggtggtcagcgccctggacaagatgatccggaaccccgccagcctcaaaatcgtggcccgggagaatggcggggcctcacaccctctcctggaccagcggcagcctcactactcagcttttggctctgtgggcgagtggcttcgggccatcaaaatgggaagatacgaagaaagtttcgcagccgctggctttggctccttcgagctggtcagccagatctctgctgaggacctgctccgaatcggagtcactctggcgggacaccagaagaaaatcttggccagtgtccagcacatgaagtcccaggccaagccgggaaccccgggtgggacaggaggaccggccccgcagtactgacctgcaggaactccccaccccagggacaccgcctccccattttccggggcagagtggggactcacagaggcccccagccctgtgccccgctggattgcactttgagcccgtggggtgaggagttggcaatttggagagacaggatttgggggttctgccataataggaggggaaaatcaccccccagccacctcggggaactccagaccaagggtgagggcgcctttccctcaggactgggtgtgaccagaggaaaaggaagtgcccaacatctcccagcctccccaggtgcccccctcaccttgatgggtgcgttcccgcagaccaaagagagtgtgactcccttgccagctccagagtgggggggctgtcccagggggcaagaaggggtgtcagggcccagtgacaaaatcattggggtttgtagtcccaacttgctgctgtcaccaccaaactcaatcatttttttcccttgtaaatgcccctcccccagctgctgccttcatattgaaggtttttgagttttgtttttggtcttaatttttctccccgttccctttttgtttcttcgttttgtttttctaccgtccttgtcataactttgtgttggagggaacctgtttcactatggcctcctttgcccaagttgaaacaggggcccatcatcatgtctgtttccagaacagtgccttggtcatcccacatccccggaccccgcctgggacccccaagctgtgtcctatgaaggggtgtggggtgaggtagtgaaaagggcggtagttggtggtggaacccagaaacggacgccggtgcttggaggggttcttaaattatatttaaaaaagtaactttttgtataaataaaagaaaatgggacgtgtcccagctccaggggt

SEQ ID NO: 1467 - DNA, 3789 bp, Homo sapiens
cgtccacccgcccagggagagtcagacctgggggggcgagggccccccaaactcagttcggatcctacccgagtgaggcggcgccatggagctccgggtgctgctctgctgggcttcgttggccgcagctttggaagagaccctgctgaacacaaaattggaaactgctgatctgaagtgggtgacattccctcaggtggacgggcagtgggaggaactgagcggcctggatgaggaacagcacagcgtgcgcacctacgaagtgtgtgacgtgcagcgtgccccgggccaggcccactggcttcgcacaggttgggtcccacggcggggcgccgtccacgtgtacgccacgctgcgcttcaccatgctcgagtgcctgtccctgcctcgggctgggcgctcctgcaaggagaccttcaccgtcttctactatgagagcgatgcggacacggccacggccctcacgccagcctggatggagaacccctacatcaaggtggacacggtggccgcggagcatctcacccggaagcgccctggggccgaggccaccgggaaggtgaatgtcaagacgctgcgtctgggaccgctcagcaaggctggcttctacctggccttccaggaccagggtgcctgcatggccctgctatccctgcacctcttctacaaaaagtgcgcccagctgactgtgaacctgactcgattcccggagactgtgcctcgggagctggttgtgcccgtggccggtagctgcgtggtggatgccgtccccgcccctggccccagccccagcctctactgccgtgaggatggccagtgggccgaacagccggtcacgggctgcagctgtgctccggggttcgaggcagctgaggggaacaccaagtgccgagcctgtgcccagggcaccttcaagcccctgtcaggagaagggtcctgccagccatgcccagccaatagccactctaacaccattggatcagccgtctgccagtgccgcgtcgggtacttccgggcacgcacagacccccggggtgcaccctgcaccacccctccttcggctccgcggagcgtggtttcccgcctgaacggctcctccctgcacctggaatggagtgcccccctggagtctggtggccgagaggacctcacctacgccctccgctgccgggagtgccgacccggaggctcctgtgcgccctgcgggggagacctgacttttgaccccggcccccgggacctggtggagccctgggtggtggttcgagggctacgtcctgacttcacctatacctttgaggtcactgcattgaacggggtatcctccttagccacggggcccgtcccatttgagcctgtcaatgtcaccactgaccgagaggtacctcctgcagtgtctgacatccgggtgacgcggtcctcacccagcagcttgagcctggcctgggctgttccccgggcacccagtggggctgtgctggactacgaggtcaaataccatgagaagggcgccgagggtcccagcagcgtgcggttcctgaagacgtcagaaaaccgggcagagctgcgggggctgaagcggggagccagctacctggtgcaggtacgggcgcgctctgaggccggctacgggcccttcggccaggaacatcacagccagacccaactggatgagagcgagggctggcgggagcagctggccctgattgcgggcacggcagtcgtgggtgtggtcctggtcctggtggtcattgtggtcgcagttctctgcctcaggaagcagagcaatgggagagaagcagaatattcggacaaacacggacagtatctcatcggacatggtactaaggtctacatcgaccccttcacttatgaagaccctaatgaggctgtgagggaatttgcaaaagagatcgatgtctcctacgtcaagattgaagaggtgattggtgcaggtgagtttggcgaggtgtgccgggggcggctcaaggccccagggaagaaggagagctgtgtggcaatcaagaccctgaagggtggctacacggagcggcagcggcgtgagtttctgagcgaggcctccatcatgggccagttcgagcaccccaatatcatccgcctggagggcgtggtcaccaacagcatgcccgtcatgattctcacagagttcatggagaacggcgccctggactccttcctgcggctaaacgacggacagttcacagtcatccagctcgtgggcatgctgcggggcatcgcctcgggcatgcggtaccttgccgagatgagctacgtccaccgagacctggctgctcgcaacatcctagtcaacagcaacctcgtctgcaaagtgtctgactttggcctttcccgattcctggaggagaactcttccgatcccacctacacgagctccctgggaggaaagattcccatccgatggactgccccggaggccattgccttccggaagttcacttccgccagtgatgcctggagttacgggattgtgatgtgggaggtgatgtcatttggggagaggccgtactgggacatgagcaatcaggacgtgatcaatgccattgaacaggactaccggctgcccccgcccccagactgtcccacctccctccaccagctcatgctggactgttggcagaaagaccggaatgcccggccccgcttcccccaggtggtcagcgccctggacaagatgatccggaaccccgccagcctcaaaatcgtggcccgggagaatggcggggacctgctccgaatcggagtcactctggcgggacaccagaagaaaatcttggccagtgtccagcacatgaagtcccaggccaagccgggaaccccgggtgggacaggaggaccggccccgcagtactgacctgcaggaactccccaccccagggacaccgcctccccattttccggggcagagtggggactcacagaggcccccagccctgtgccccgctggattgcactttgagcccgtggggtgaggagttggcaatttggagagacaggatttgggggttctgccataataggaggggaaaatcaccccccagccacctcggggaactccagaccaagggtgagggcgcctttccctcaggactgggtgtgaccagaggaaaaggaagtgcccaacatctcccagcctccccaggtgcccccctcaccttgatgggtgcgttcccgcagaccaaagagagtgtgactcccttgccagctccagagtgggggggctgtcccagggggcaagaaggggtgtcagggcccagtgacaaaatcattggggtttgtagtcccaacttgctgctgtcaccaccaaactcaatcatttttttcccttgtaaatgcccctcccccagctgctgccttcatattgaaggtttttgagttttgtttttggtcttaatttttctccccgttccctttttgtttcttcgttttgtttttctaccgtccttgtcataactttgtgttggagggaacctgtttcactatggcctcctttgcccaagttgaaacaggggcccatcatcatgtctgtttccagaacagtgccttggtcatcccacatccccggaccccgcctgggacccccaagctgtgtcctatgaaggggtgtggggtgaggtagtgaaaagggcggtagttggtggtggaacccagaaacggacgccggtgcttggaggggttcttaaattatatttaaaaaagtaactttttgtataaataaaagaaaatgggacgtgtcccagctccaggggt

SEQ ID NO: 1468 - DNA, 1444 bp, Homo sapiens
agatctgtgagcccagcgctgactgcgccgcggagaaagccagtgggaacccagacccataggagacccgcgtccccgctcggcctggccaggccccgcgctatggagttcctctgggcccctctcttgggtctgtgctgcagtctggccgctgctgatcgccacaccgtcttctggaacagttcaaatcccaagttccggaatgaggactacaccatacatgtgcagctgaatgactacgtggacatcatctgtccgcactatgaagatcactctgtggcagacgctgccatggagcagtacatactgtacctggtggagcatgaggagtaccagctgtgccagccccagtccaaggaccaagtccgctggcagtgcaaccggcccagtgccaagcatggcccggagaagctgtctgagaagttccagcgcttcacacctttcaccctgggcaaggagttcaaagaaggacacagctactactacatctctcacagtcctcaggcccatgacaatccacaggagaagagacttgcagcagatgacccagaggtgcgggttctacatagcatcggtcacagtgctgccccacgcctcttcccacttgcctggactgtgctgctccttccacttctgctgctgcaaaccccgtgaaggtgtatgccacacctggccttaaagagggacaggctgaagagagggacaggcactccaaacctgtcttggggccactttcagagcccccagccctgggaaccactcccaccacaggcataagctatcacctagcagcctcaaaacgggtcagtattaaggttttcaaccggaaggaggccaaccagcccgacagtgccatccccaccttcacctcggagggatggagaaagaagtggagacagtcctttcccaccattcctgcctttaagccaaagaaacaagctgtgcaggcatggtcccttaaggcacagtgggagctgagctggaaggggccacgtggatgggcaaagcttgtcaaagatgccccctccaggagagagccaggatgcccagatgaactgactgaaggaaaagcaagaaacagtttcttgcttggaagccaggtacaggagaggcagcatgcttgggctgacccagcatctcccagcaagacctcatctgtggagctgccacagagaagtttgtagccaggtactgcattctctcccatcctggggcagcactccccagagctgtgccagcaggggggctgtgccaacctgttcttagagtgtagctgtaagggcagtgcccatgtgtacattctgcctagagtgtagcctaaagggcagggcccacgtgtatagtatctgtatataagttgctgtgtgtctgtcctgatttctacaactggagtttttttatacaatgttctttgtctcaaaataaagcaatgtgttttttcgga

SEQ ID NO: 1469 - DNA, 1926 bp, Homo sapiens
atgcgaggctcagaaaggtgcggggcatgtcaacaacctcgcaccctgcaaggtccgcgcgcggagcagcaaagccgtgtcccgcacccccgcgttcgcagactcgcacttgcgagttcttcccttctcccgcacgcgactgcgcccagggacgcaagcccaccaccgggacaggctcacaaagctccacgcagacccacaagtgagcgaacacacatctctgagcagatctgcgggggcagaggagcgcgcttcgctctttcctgcacccccagcctcctcgcctccccaccccgcccctcctccacctccccagcccccaagcccccaggcagccgcgcgccgggcggggcgagggcggggcggggtgtcgggcggcgccggcccaaaaggcggagtcgctaggcgaaggggccagatctgtgagcccagcgctgactgcgccgcggagaaagccagtgggaacccagacccataggagacccgcgtccccgctcggcctggccaggccccgcgctatggagttcctctgggcccctctcttgggtctgtgctgcagtctggccgctgctgatcgccacaccgtcttctggaacagttcaaatcccaagttccggaatgaggactacaccatacatgtgcagctgaatgactacgtggacatcatctgtccgcactatgaagatcactctgtggcagacgctgccatggagcagtacatactgtacctggtggagcatgaggagtaccagctgtgccagccccagtccaaggaccaagtccgctggcagtgcaaccggcccagtgccaagcatggcccggagaagctgtctgagaagttccagcgcttcacacctttcaccctgggcaaggagttcaaagaaggacacagctactactacatctccaaacccatccaccagcatgaagaccgctgcttgaggttgaaggtgactgtcagtggcaaaatcactcacagtcctcaggcccatgacaatccacaggagaagagacttgcagcagatgacccagaggtgcgggttctacatagcatcggtcacagtgctgccccacgcctcttcccacttgcctggactgtgctgctccttccacttctgctgctgcaaaccccgtgaaggtgtatgccacacctggccttaaagagggacaggctgaagagagggacaggcactccaaacctgtcttggggccactttcagagcccccagccctgggaaccactcccaccacaggcataagctatcacctagcagcctcaaaacgggtcagtattaaggttttcaaccggaaggaggccaaccagcccgacagtgccatccccaccttcacctcggagggatggagaaagaagtggagacagtcctttcccaccattcctgcctttaagccaaagaaacaagctgtgcaggcatggtcccttaaggcacagtgggagctgagctggaaggggccacgtggatgggcaaagcttgtcaaagatgccccctccaggagagagccaggatgcccagatgaactgactgaaggaaaagcaagaaacagtttcttgcttggaagccaggtacaggagaggcagcatgcttgggctgacccagcatctcccagcaagacctcatctgtggagctgccacagagaagtttgtagccaggtactgcattctctcccatcctggggcagcactccccagagctgtgccagcaggggggctgtgccaacctgttcttagagtgtagctgtaagggcagtgcccatgtgtacattctgcctagagtgtagcctaaagggcagggcccacgtgtatagtatctgtatataagttgctgtgtgtctgtcctgatttctacaactggagtttttttatacaatgttctttgtctcaaaataaagcaatgtgttttttcgga

SEQ ID NO: 1470 - DNA, 4447 bp, Homo sapiens
gaccgctggagctgcgcagcgcgcctcggagctgcctgcgggcgcacgccgtcttccccgccagtctgccccggaggattgggggtcccagcctgcgtcccgtcagtcccttcttggcccggagtgcgcggagctgggagtggcttcgccatggctgtgagaagggactccgtgtggaagtactgctggggtgttttgatggttttatgcagaactgcgatttccaaatcgatagttttagagcctatctattggaattcctcgaactccaaatttctacctggacaaggactggtactatacccacagataggagacaaattggatattatttgccccaaagtggactctaaaactgttggccagtatgaatattataaagtttatatggttgataaagaccaagcagacagatgcactattaagaaggaaaatacccctctcctcaactgtgccaaaccagaccaagatatcaaattcaccatcaagtttcaagaattcagccctaacctctggggtctagaatttcagaagaacaaagattattacattatatctacatcaaatgggtctttggagggcctggataaccaggagggaggggtgtgccagacaagagccatgaagatcctcatgaaagttggacaagatgcaagttctgctggatcaaccaggaataaagatccaacaagacgtccagaactagaagctggtacaaatggaagaagttcgacaacaagtccctttgtaaaaccaaatccaggttctagcacagacggcaacagcgccggacattcggggaacaacatcctcggttccgaagtggccttatttgcagggattgcttcaggatgcatcatcttcatcgtcatcatcatcacgctggtggtcctcttgctgaagtaccggaggagacacaggaagcactcgccgcagcacacgaccacgctgtcgctcagcacactggccacacccaagcgcagcggcaacaacaacggctcagagcccagtgacattatcatcccgctaaggactgcggacagcgtcttctgccctcactacgagaaggtcagcggcgactacgggcacccggtgtacatcgtccaggagatgcccccgcagagcccggcgaacatttactacaaggtctgagagggaccctggtggtacctgtgctttcccagaggacacctaatgtcccgatgcctcccttgagggtttgagagcccgcgtgctggagaattgactgaagcacagcaccgggggagagggacactcctcctcggaagagcccgtcgcgctggacagcttacctagtcttgtagcattcggccttggtgaacacacacgctccctggaagctggaagactgtgcagaagacgcccattcggactgctgtgccgcgtcccacgtctcctcctcgaagccatgtgctgcggtcactcaggcctctgcagaagccaagggaagacagtggtttgtggacgagagggctgtgagcatcctggcaggtgccccaggatgccacgcctggaagggccggcttctgcctggggtgcatttcccccgcagtgcataccggacttgtcacacggacctcgggctagttaaggtgtgcaaagatctctagagtttagtccttactgtctcactcgttctgttacccagggctctgcagcacctcacctgagacctccactccacatctgcatcactcatggaacactcatgtctggagtcccctcctccagccgctggcaacaacagcttcagtccatgggtaatccgttcatagaaattgtgtttgctaacaaggtgccctttagccagatgctaggctgtctgcgaagaaggctaggagttcatagaagggagtggggctggggaaagggctggctgcaattgcagctcactgctgctgcctctgaaacagaaagttggaaaggaaaaaagaaaaaagcaattaggtagcacagcactttggttttgctgagatcgaagaggccagtaggagacacgacagcacacacagtggattccagtgcatggggaggcactcgctgttatcaaatagcgatgtgcaggaagaaaagcccctcttcattccggggaacaaagacgggtattgttgggaaaggaacaggcttggagggaagggagaaagtaggccgctgatgatatattcgggcaggactgttgtggtactggcaataagatacacagctccgagctgtaggagagtcggtctgctttggatgattttttaagcagactcagctgctatacttatcacattttattaaacacagggaaagcatttaggagaatagcagagagccaaatctgacctaaaagttgaaaagccaaaggtcaaacaggctgtaattccatcatcatcgttgttattaaagaatccttatctataaaaggtaggtcagatccccctccccccaggttcctccttcccctcccgattgagccttacgacactttggtttatgcggtgctgtccgggtgccagggctgcagggtcggtactgatggaggctgcagcgcccggtgctctgtgtcaaggtgaagcacatacggcagacctcttagagtccttaagacggaagtaaattatgatgtccagggggagaaggaagataggacgtatttataataggtatatagaacacaagggatataaaatgaaagatttttactaatatatattttaaggttgcacacagtacacaccagaagatgtgaaattcatttgtggcaattaagtggtcccaatgctcagcgcttaaaaaaacaaattggacagctacttctgggaaaaacaacatcattccaaaaagaacaataatgagagcaaatgcaaaaataaccaagtcctccgaaggcatctcacggaaccgtagactaggaagtacgagccccacagagcaggaagccgatgtgactgcatcatatatttaacaatgacaagatgttccggcgtttatttctgcgttgggttttcccttgccttatgggctgaagtgttctctagaatccagcaggtcacactgggggcttcaggtgacgatttagctgtggctccctcctcctgtcctcccccgcaccccctcccttctgggaaacaagaagagtaaacaggaaacctactttttatgtgctatgcaaaatagacatctttaacatagtcctgttactatggtaacactttgctttctgaattggaagggaaaaaaaatgtagcgacagcattttaaggttctcagacctccagtgagtacctgcaaaaatgagttgtcacagaaattatgatcctctatttcctgaacctggaaatgatgttggtccaaagtgcgtgtgtgtatgtgtgagtgggtgcgtggtatacatgtgtacatatatgtataatatatatctacaatatatattatatatatctatatcatatttctgtggagggttgccatggtaaccagccacagtacatatgtaattctttccatcaccccaacctctcctttctgtgcattcatgcaagagtttcttgtaagccatcagaagttacttttaggatgggggagaggggcgagaaggggaaaaatgggaaatagtctgattttaatgaaatcaaatgtatgtatcatcagttggctacgttttggttctatgctaaactgtgaaaaatcagatgaattgataaaagagttccctgcaaccaattgaaaagtgttctgtgcgtctgttttgtgtctggtgcagaatatgacaatctaccaactgtccctttgtttgaagttggtttagctttggaaagttactgtaaatgccttgcttgtatgatcgtccctggtcacccgactttggaatttgcaccatcatgtttcagtgaagatgctgtaaataggttcagattttactgtctatggatttggggtgttacagtagccttattcacctttttaataaaaatacacatgaaaacaagaaagaaatggcttttcttacccagattgtgtacatagagcaatgttggttttttataaagtctaagcaagatgttttgtataaaatctgaattttgcaatgtatttagctacagcttgtttaacggcagtgtcattcccctttgcactgtaatgaggaaaaaatggtataaaaggttgccaaattgctgcatatttgtgccgtaattatgtaccatgaatatttatttaaaatttcgttgtccaatttgtaagtaacacagtattatgcctgagttataaatatttttttctttctttgttttattttaatagcctgtcataggttttaaatctgctttagtttcacattgcagttagccccagaaaatgaaatccgtgaagtcacattccacatctgtttcaaactgaatttgttcttaaaaaaataaaatatttttttcctatggaaaaa

SEQ ID NO: 1471 - DNA, 4880 bp, Homo sapiens
gaaactgttgggagaggaatcgtatctccatatttcttctttcagccccaatccaagggttgtagctggaactttccatcagttcttcctttctttttcctctctaagcctttgccttgctctgtcacagtgaagtcagccagagcagggctgttaaactctgtgaaatttgtcataagggtgtcaggtatttcttactggcttccaaagaaacatagataaagaaatctttcctgtggcttcccttggcaggctgcattcagaaggtctctcagttgaagaaagagcttggaggacaacagcacaacaggagagtaaaagatgccccagggctgaggcctccgctcaggcagccgcatctggggtcaatcatactcaccttgcccgggccatgctccagcaaaatcaagctgttttcttttgaaagttcaaactcatcaagattatgctgctcactcttatcattctgttgccagtagtttcaaaatttagttttgttagtctctcagcaccgcagcactggagctgtcctgaaggtactctcgcaggaaatgggaattctacttgtgtgggtcctgcacccttcttaattttctcccatggaaatagtatctttaggattgacacagaaggaaccaattatgagcaattggtggtggatgctggtgtctcagtgatcatggattttcattataatgagaaaagaatctattgggtggatttagaaagacaacttttgcaaagagtttttctgaatgggtcaaggcaagagagagtatgtaatatagagaaaaatgtttctggaatggcaataaattggataaatgaagaagttatttggtcaaatcaacaggaaggaatcattacagtaacagatatgaaaggaaataattcccacattcttttaagtgctttaaaatatcctgcaaatgtagcagttgatccagtagaaaggtttatattttggtcttcagaggtggctggaagcctttatagagcagatctcgatggtgtgggagtgaaggctctgttggagacatcagagaaaataacagctgtgtcattggatgtgcttgataagcggctgttttggattcagtacaacagagaaggaagcaattctcttatttgctcctgtgattatgatggaggttctgtccacattagtaaacatccaacacagcataatttgtttgcaatgtccctttttggtgaccgtatcttctattcaacatggaaaatgaagacaatttggatagccaacaaacacactggaaaggacatggttagaattaacctccattcatcatttgtaccacttggtgaactgaaagtagtgcatccacttgcacaacccaaggcagaagatgacacttgggagcctgagcagaaactttgcaaattgaggaaaggaaactgcagcagcactgtgtgtgggcaagacctccagtcacacttgtgcatgtgtgcagagggatacgccctaagtcgagaccggaagtactgtgaagatgttaatgaatgtgctttttggaatcatggctgtactcttgggtgtaaaaacacccctggatcctattactgcacgtgccctgtaggatttgttctgcttcctgatgggaaacgatgtcatcaacttgtttcctgtccacgcaatgtgtctgaatgcagccatgactgtgttctgacatcagaaggtcccttatgtttctgtcctgaaggctcagtgcttgagagagatgggaaaacatgtagcggttgttcctcacccgataatggtggatgtagccagctctgcgttcctcttagcccagtatcctgggaatgtgattgctttcctgggtatgacctacaactggatgaaaaaagctgtgcagcttcaggaccacaaccatttttgctgtttgccaattctcaagatattcgacacatgcattttgatggaacagactatggaactctgctcagccagcagatgggaatggtttatgccctagatcatgaccctgtggaaaataagatatactttgcccatacagccctgaagtggatagagagagctaatatggatggttcccagcgagaaaggcttattgaggaaggagtagatgtgccagaaggtcttgctgtggactggattggccgtagattctattggacagacagagggaaatctctgattggaaggagtgatttaaatgggaaacgttccaaaataatcactaaggagaacatctctcaaccacgaggaattgctgttcatccaatggccaagagattattctggactgatacagggattaatccacgaattgaaagttcttccctccaaggccttggccgtctggttatagccagctctgatctaatctggcccagtggaataacgattgacttcttaactgacaagttgtactggtgcgatgccaagcagtctgtgattgaaatggccaatctggatggttcaaaacgccgaagacttacccagaatgatgtaggtcacccatttgctgtagcagtgtttgaggattatgtgtggttctcagattgggctatgccatcagtaatgagagtaaacaagaggactggcaaagatagagtacgtctccaaggcagcatgctgaagccctcatcactggttgtggttcatccattggcaaaaccaggagcagatccctgcttatatcaaaacggaggctgtgaacatatttgcaaaaagaggcttggaactgcttggtgttcgtgtcgtgaaggttttatgaaagcctcagatgggaaaacgtgtctggctctggatggtcatcagctgttggcaggtggtgaagttgatctaaagaaccaagtaacaccattggacatcttgtccaagactagagtgtcagaagataacattacagaatctcaacacatgctagtggctgaaatcatggtgtcagatcaagatgactgtgctcctgtgggatgcagcatgtatgctcggtgtatttcagagggagaggatgccacatgtcagtgtttgaaaggatttgctggggatggaaaactatgttctgatatagatgaatgtgagatgggtgtcccagtgtgcccccctgcctcctccaagtgcatcaacaccgaaggtggttatgtctgccggtgctcagaaggctaccaaggagatgggattcactgtcttgatattgatgagtgccaactgggggagcacagctgtggagagaatgccagctgcacaaatacagagggaggctatacctgcatgtgtgctggacgcctgtctgaaccaggactgatttgccctgactctactccaccccctcacctcagggaagatgaccaccactattccgtaagaaatagtgactctgaatgtcccctgtcccacgatgggtactgcctccatgatggtgtgtgcatgtatattgaagcattggacaagtatgcatgcaactgtgttgttggctacatcggggagcgatgtcagtaccgagacctgaagtggtgggaactgcgccacgctggccacgggcagcagcagaaggtcatcgtggtggctgtctgcgtggtggtgcttgtcatgctgctcctcctgagcctgtggggggcccactactacaggactcagaagctgctatcgaaaaacccaaagaatccttatgaggagtcgagcagagatgtgaggagtcgcaggcctgctgacactgaggatgggatgtcctcttgccctcaaccttggtttgtggttataaaagaacaccaagacctcaagaatgggggtcaaccagtggctggtgaggatggccaggcagcagatgggtcaatgcaaccaacttcatggaggcaggagccccagttatgtggaatgggcacagagcaaggctgctggattccagtatccagtgataagggctcctgtccccaggtaatggagcgaagctttcatatgccctcctatgggacacagacccttgaagggggtgtcgagaagccccattctctcctatcagctaacccattatggcaacaaagggccctggacccaccacaccaaatggagctgactcagtgaaaactggaattaaaaggaaagtcaagaagaatgaactatgtcgatgcacagtatcttttctttcaaaagtagagcaaaactataggttttggttccacaatctctacgactaatcacctactcaatgcctggagacagatacgtagttgtgcttttgtttgctcttttaagcagtctcactgcagtcttatttccaagtaagagtactgggagaatcactaggtaacttattagaaacccaaattgggacaacagtgctttgtaaattgtgttgtcttcagcagtcaatacaaatagatttttgtttttgttgttcctgcagccccagaagaaattaggggttaaagcagacagtcacactggtttggtcagttacaaagtaatttctttgatctggacagaacatttatatcagtttcatgaaatgattggaatattacaataccgttaagatacagtgtaggcatttaactcctcattggcgtggtccatgctgatgattttgcaaaatgagttgtgatgaatcaatgaaaaatgtaatttagaaactgatttcttcagaattagatggcttattttttaaaatatttgaatgaaaacattttatttttaaaatattacacaggaggcttcggagtttcttagtcattactgtccttttcccctacagaattttccctcttggtgtgattgcacagaatttgtatgtattttcagttacaagattgtaagtaaattgcctgatttgttttcattatagacaacgatgaatttcttctaattatttaaataaaatcaccaaaaacataaa

SEQ ID NO: 1472 - DNA, 3642 bp, Homo sapiens
cagccgcatctggggtcaatcatactcaccttgcccgggccatgctccagcaaaatcaagctgttttcttttgaaagttcaaactcatcaagattatgctgctcactcttatcattctgttgccagtagtttcaaaatttagttttgttagtctctcagcaccgcagcactggagctgtcctgaaggtactctcgcaggaaatgggaattctacttgtgtgggtcctgcacccttcttaattttctcccatggaaatagtatctttaggattgacacagaaggaaccaattatgagcaattggtggtggatgctggtgtctcagtgatcatggattttcattataatgagaaaagaatctattgggtggatttagaaagacaacttttgcaaagagtttttctgaatgggtcaaggcaagagagagtatgtaatatagagaaaaatgtttctggaatggcaataaattggataaatgaagaagttatttggtcaaatcaacaggaaggaatcattacagtaacagatatgaaaggaaataattcccacattcttttaagtgctttaaaatatcctgcaaatgtagcagttgatccagtagaaaggtttatattttggtcttcagaggtggctggaagcctttatagagcagatctcgatggtgtgggagtgaaggctctgttggagacatcagagaaaataacagctgtgtcattggatgtgcttgataagcggctgttttggattcagtacaacagagaaggaagcaattctcttatttgctcctgtgattatgatggaggttctgtccacattagtaaacatccaacacagcataatttgtttgcaatgtccctttttggtgaccgtatcttctattcaacatggaaaatgaagacaatttggatagccaacaaacacactggaaaggacatggttagaattaacctccattcatcatttgtaccacttggtgaactgaaagtagtgcatccacttgcacaacccaaggcagaagatgacacttgggagcctgagcagaaactttgcaaattgaggaaaggaaactgcagcagcactgtgtgtgggcaagacctccagtcacacttgtgcatgtgtgcagagggatacgccctaagtcgagaccggaagtactgtgaagatgttaatgaatgtgctttttggaatcatggctgtactcttgggtgtaaaaacacccctggatcctattactgcacgtgccctgtaggatttgttctgcttcctgatgggaaacgatgtcatcaacttgtttcctgtccacgcaatgtgtctgaatgcagccatgactgtgttctgacatcagaaggtcccttatgtttctgtcctgaaggctcagtgcttgagagagatgggaaaacatgtagcggttgttcctcacccgataatggtggatgtagccagctctgcgttcctcttagcccagtatcctgggaatgtgattgctttcctgggtatgacctacaactggatgaaaaaagctgtgcagcttcaggaccacaaccatttttgctgtttgccaattctcaagatattcgacacatgcattttgatggaacagactatggaactctgctcagccagcagatgggaatggtttatgccctagatcatgaccctgtggaaaataagatatactttgcccatacagccctgaagtggatagagagagctaatatggatggttcccagcgagaaaggcttattgaggaaggagtagatgtgccagaaggtcttgctgtggactggattggccgtagattctattggacagacagagggaaatctctgattggaaggagtgatttaaatgggaaacgttccaaaataatcactaaggagaacatctctcaaccacgaggaattgctgttcatccaatggccaagagattattctggactgatacagggattaatccacgaattgaaagttcttccctccaaggccttggccgtctggttatagccagctctgatctaatctggcccagtggaataacgattgacttcttaactgacaagttgtactggtgcgatgccaagcagtctgtgattgaaatggccaatctggatggttcaaaacgccgaagacttacccagaatgatgtaggtcacccatttgctgtagcagtgtttgaggattatgtgtggttctcagattgggctatgccatcagtaatgagagtaaacaagaggactggcaaagatagagtacgtctccaaggcagcatgctgaagccctcatcactggttgtggttcatccattggcaaaaccaggagcagatccctgcttatatcaaaacggaggctgtgaacatatttgcaaaaagaggcttggaactgcttggtgttcgtgtcgtgaaggttttatgaaagcctcagatgggaaaacgtgtctggctctggatggtcatcagctgttggcaggtggtgaagttgatctaaagaaccaagtaacaccattggacatcttgtccaagactagagtgtcagaagataacattacagaatctcaacacatgctagtggctgaaatcatggtgtcagatcaagatgactgtgctcctgtgggatgcagcatgtatgctcggtgtatttcagagggagaggatgccacatgtcagtgtttgaaaggatttgctggggatggaaaactatgttctgatatagatgaatgtgagatgggtgtcccagtgtgcccccctgcctcctccaagtgcatcaacaccgaaggtggttatgtctgccggtgctcagaaggctaccaaggagatgggattcactgtcttgactctactccaccccctcacctcagggaagatgaccaccactattccgtaagaaatagtgactctgaatgtcccctgtcccacgatgggtactgcctccatgatggtgtgtgcatgtatattgaagcattggacaagtatgcatgcaactgtgttgttggctacatcggggagcgatgtcagtaccgagacctgaagtggtgggaactgcgccacgctggccacgggcagcagcagaaggtcatcgtggtggctgtctgcgtggtggtgcttgtcatgctgctcctcctgagcctgtggggggcccactactacaggactcagaagctgctatcgaaaaacccaaagaatccttatgaggagtcgagcagagatgtgaggagtcgcaggcctgctgacactgaggatgggatgtcctcttgccctcaaccttggtttgtggttataaaagaacaccaagacctcaagaatgggggtcaaccagtggctggtgaggatggccaggcagcagatgggtcaatgcaaccaacttcatggaggcaggagccccagttatgtggaatgggcacagagcaaggctgctggattccagtatccagtgataagggctcctgtccccaggtaatggagcgaagctttcatatgccctcctatgggacacagacccttgaagggggtgtcgagaagccccattctctcctatcagctaacccattatggcaacaaagggccctggacccaccacaccaaatggagctgactcagtgaaaactggaattaaaaggaaagtcaagaagaatgaactatgtcgatg

SEQ ID NO: 1473 - DNA, 4489 bp, Homo sapiens
aaaaagagaaactgttgggagaggaatcgtatctccatatttcttctttcagccccaatccaagggttgtagctggaactttccatcagttcttcctttctttttcctctctaagcctttgccttgctctgtcacagtgaagtcagccagagcagggctgttaaactctgtgaaatttgtcataagggtgtcaggtatttcttactggcttccaaagaaacatagataaagaaatctttcctgtggcttcccttggcaggctgcattcagaaggtctctcagttgaagaaagagcttggaggacaacagcacaacaggagagtaaaagatgccccagggctgaggcctccgctcaggcagccgcatctggggtcaatcatactcaccttgcccgggccatgctccagcaaaatcaagctgttttcttttgaaagttcaaactcatcaagattatgctgctcactcttatcattctgttgccagtagtttcaaaatttagttttgttagtctctcagcaccgcagcactggagctgtcctgaaggtactctcgcaggaaatgggaattctacttgtgtgggtcctgcacccttcttaattttctcccatggaaatagtatctttaggattgacacagaaggaaccaattatgagcaattggtggtggatgctggtgtctcagtgatcatggattttcattataatgagaaaagaatctattgggtggatttagaaagacaacttttgcaaagagtttttctgaatgggtcaaggcaagagagagtatgtaatatagagaaaaatgtttctggaatggcaataaattggataaatgaagaagttatttggtcaaatcaacaggaaggaatcattacagtaacagatatgaaaggaaataattcccacattcttttaagtgctttaaaatatcctgcaaatgtagcagttgatccagtagaaaggtttatattttggtcttcagaggtggctggaagcctttatagagcagatctcgatggtgtgggagtgaaggctctgttggagacatcagagaaaataacagctgtgtcattggatgtgcttgataagcggctgttttggattcagtacaacagagaaggaagcaattctcttatttgctcctgtgattatgatggaggttctgtccacattagtaaacatccaacacagcataatttgtttgcaatgtccctttttggtgaccgtatcttctattcaacatggaaaatgaagacaatttggatagccaacaaacacactggaaaggacatggttagaattaacctccattcatcatttgtaccacttggtgaactgaaagtagtgcatccacttgcacaacccaaggcagaagatgacacttgggagcctgatgttaatgaatgtgctttttggaatcatggctgtactcttgggtgtaaaaacacccctggatcctattactgcacgtgccctgtaggatttgttctgcttcctgatgggaaacgatgtcatcaacttgtttcctgtccacgcaatgtgtctgaatgcagccatgactgtgttctgacatcagaaggtcccttatgtttctgtcctgaaggctcagtgcttgagagagatgggaaaacatgtagcggttgttcctcacccgataatggtggatgtagccagctctgcgttcctcttagcccagtatcctgggaatgtgattgctttcctgggtatgacctacaactggatgaaaaaagctgtgcagcttcaggaccacaaccatttttgctgtttgccaattctcaagatattcgacacatgcattttgatggaacagactatggaactctgctcagccagcagatgggaatggtttatgccctagatcatgaccctgtggaaaataagatatactttgcccatacagccctgaagtggatagagagagctaatatggatggttcccagcgagaaaggcttattgaggaaggagtagatgtgccagaaggtcttgctgtggactggattggccgtagattctattggacagacagagggaaatctctgattggaaggagtgatttaaatgggaaacgttccaaaataatcactaaggagaacatctctcaaccacgaggaattgctgttcatccaatggccaagagattattctggactgatacagggattaatccacgaattgaaagttcttccctccaaggccttggccgtctggttatagccagctctgatctaatctggcccagtggaataacgattgacttcttaactgacaagttgtactggtgcgatgccaagcagtctgtgattgaaatggccaatctggatggttcaaaacgccgaagacttacccagaatgatgtaggtcacccatttgctgtagcagtgtttgaggattatgtgtggttctcagattgggctatgccatcagtaatgagagtaaacaagaggactggcaaagatagagtacgtctccaaggcagcatgctgaagccctcatcactggttgtggttcatccattggcaaaaccaggagcagatccctgcttatatcaaaacggaggctgtgaacatatttgcaaaaagaggcttggaactgcttggtgttcgtgtcgtgaaggttttatgaaagcctcagatgggaaaacgtgtctggctctggatggtcatcagctgttggcaggtggtgaagttgatctaaagaaccaagtaacaccattggacatcttgtccaagactagagtgtcagaagataacattacagaatctcaacacatgctagtggctgaaatcatggtgtcagatcaagatgactgtgctcctgtgggatgcagcatgtatgctcggtgtatttcagagggagaggatgccacatgtcagtgtttgaaaggatttgctggggatggaaaactatgttctgatatagatgaatgtgagatgggtgtcccagtgtgcccccctgcctcctccaagtgcatcaacaccgaaggtggttatgtctgccggtgctcagaaggctaccaaggagatgggattcactgtcttgatattgatgagtgccaactgggggagcacagctgtggagagaatgccagctgcacaaatacagagggaggctatacctgcatgtgtgctggacgcctgtctgaaccaggactgatttgccctgactctactccaccccctcacctcagggaagatgaccaccactattccgtaagaaatagtgactctgaatgtcccctgtcccacgatgggtactgcctccatgatggtgtgtgcatgtatattgaagcattggacaagtatgcatgcaactgtgttgttggctacatcggggagcgatgtcagtaccgagacctgaagtggtgggaactgcgccacgctggccacgggcagcagcagaaggtcatcgtggtggctgtctgcgtggtggtgcttgtcatgctgctcctcctgagcctgtggggggcccactactacaggactcagaagctgctatcgaaaaacccaaagaatccttatgaggagtcgagcagagatgtgaggagtcgcaggcctgctgacactgaggatgggatgtcctcttgccctcaaccttggtttgtggttataaaagaacaccaagacctcaagaatgggggtcaaccagtggctggtgaggatggccaggcagcagatgggtcaatgcaaccaacttcatggaggcaggagccccagttatgtggaatgggcacagagcaaggctgctggattccagtatccagtgataagggctcctgtccccaggtaatggagcgaagctttcatatgccctcctatgggacacagacccttgaagggggtgtcgagaagccccattctctcctatcagctaacccattatggcaacaaagggccctggacccaccacaccaaatggagctgactcagtgaaaactggaattaaaaggaaagtcaagaagaatgaactatgtcgatgcacagtatcttttctttcaaaagtagagcaaaactataggttttggttccacaatctctacgactaatcacctactcaatgcctggagacagatacgtagttgtgcttttgtttgctcttttaagcagtctcactgcagtcttatttccaagtaagagtactgggagaatcactaggtaacttattagaaacccaaattgggacaacagtgctttgtaaattgtgttgtcttcagcagtcaatacaaatagatttttgtttttgttgttcctgcagccccagaagaaattaggggttaaagcagacagtcacactggtttggtcagttacaaagtaatttctttgatctggacagaacatttatatcagtttcatgaaatgattggaatattacaataccgttaagatacagtgtaggcatttaactcctcattggcgtggtccatgctgatgattttgcaaaatgagttgtgatgaatcaatgaaaaatgta

SEQ ID NO: 1474 - DNA, 9821 bp, Homo sapiens
gccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgactgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactctattatgctctcaaatacccctaagcatctatactagcctggtatgggtatgaaagatacaaagataaataaaacatagtccctgattctaagaaattcacaatttagcaaaggaaatggactcatagatgctaaccttaaaacaacgtgacaaatgccagacaggacccatcagccaggcactgtgagagcacagagcagggaggttgggtcctgcctgaggagacctggaagggaggcctcacaggaggatgaccaggtctcagtcagcggggaggtggaaagtgcaggtgcatcaggggcaccctgaccgaggaaacagctgccagaggcctccactgctaaagtccacataaggctgaggtcagtcaccctaaacaacctgctccctctaagccaggggatgagcttggagcatcccacaagttccctaaaagttgcagcccccagggggattttgagctatcatctctgcacatgcttagtgagaagactacacaacatttctaagaatctgagattttatattgtcagttaaccactttcattattcattcacctcaggacatgcagaaatatttcagtcagaactgggaaacagaaggacctacattctgctgtcacttatgtgtcaagaagcagatgatcgatgaggcaggtcagttgtaagtgagtcacattgtagcattaaattctagtatttttgtagtttgaaacagtaacttaataaaagagcaaaagctattctagctttcttcttcatattttaattttccaccataaagtttagttgctaaattctattaattttaagattgtgcttcccaaaatagttctcacttcatctgtccagggaggcacagttctgtctggtagaagccgcaaagcccttagcctcttcacggatctggcgactgtgatgggcaggtcaggagaggagctgcccaaagtcccatgattttcacctaacagccctgatcagtcagtactcaaagcttggactccatccctgaaggtcttcctgattgatagcctggccttaataccctacagaaagcctgtccattggctgtttcttcctcagtcagttcctggaagaccttaccccatgaccccagcttcagatgtggtctttggaaacagaggtcgaaggaaagtaaggagctgagagctcacattcataggtgccgccagccttcgtgcatcttcttgcatcatctctaaggagctcctctaattacaccatgcccgtcaccccatgagggatcagagaagggatgagtcttctaaactctatattcgctgtgagtccaggttgtaagggggagcactgtggatgcatcctattgcactccagctgatgacaccaaagcttaggtgtttgctgaaagttcttgatgttgtgacttaccacccctgcctcacaactgcagacataaggggactatggattgcttagcaggaaaggcactggttctcaagggcggctgcccttgggaatcttctggtcccaaccagaaagactgtggcttgattttctcaggtgcagcccagccgtagggccttttcagagcaccccctggttattgcaacattcatcaaagtttctagaacctctggcctaaaggaagggcctggtgggatctacttggcactcgctggggggccaccccccagtgccactctcactaggcctctgattgcacttgtgtaggatgaagctggtgggtgatgggaactcagcacctcccctcaggcagaaaagaatcatctgtggagcttcaaaagaaggggcctggagtctctgcagaccaattcaacccaaatctcgggggctctttcatgattctaatgggcaaccagggttgaaacccttatttctagggtcttcagttgtacaagactgtgggtctgtaccagagcccccgtcagagtagaataaaaggctgggtagggtagagattcccatgtgcagtggagagaacaatctgcagtcactgataagcctgagacttggctcatttcaaaagcgttcaattcatcctcaccagcagttcagctggaaaggggcaaatacccccacctgagctttgaaaacgccctgggaccctctgcattctctaagtaagttatagaaaccagtctcttccctcctttgtgagtgagctgctattccacgtaggcaacacctgttgaaattgccctcaatgtctactctgcatttctttcttgtgataagcacacacttttattgcaacataatgatctgctcacatttccttgcctgggggctgtaaaaccttacagaacagaaatccttgcctctttcaccagccacacctgccataccaggggtacagctttgtactattgaagacacagacaggatttttaaatgtaaatctatttttgtaactttgttgcgggatatagttctctttatgtagcactgaactttgtacaatatatttttagaaactcatttttctactaaaacaaacacagtttactttagagagactgcaatagaatcaaaatttgaaactgaaatctttgtttaaaagggttaagttgaggcaagaggaaagccctttctctctcttataaaaaggcacaacctcattggggagctaagctaggtcattgtcatggtgaagaagagaagcatcgtttttatatttaggaaattttaaaagatgatggaaagcacatttagcttggtctgaggcaggttctgttggggcagtgttaatggaaagggctcactgttgttactactagaaaaatccagttgcatgccatactctcatcatctgccagtgtaaccctgtacatgtaagaaaagcaataacatagcactttgttggtttatatatataatgtgacttcaatgcaaattttatttttatatttacaattgatatgcatttaccagtataaactagacatgtctggagagcctaataatgttcagcacactttggttagttcaccaacagtcttaccaagcctgggcccagccaccctagagaagttattcagccctggctgcagtgacatcacctgaggagcttttaaaagcttgaagcccagctacacctcagaccgattaaacgcaaatctctggggctgaaacccaagcattcgtagtttttaaagctcctgaggtcattccaatgtgcggccaaagttgagaactactggcctagggattagccacaaggacatggacttggaggcaaattctgcaggtgtatgtgattctcaggcctagagagctaagacacaaagacctccacatctgtcgctgagagtcaagaacctgaacagagtttccatgaaggttctccaagcactagaagggagagtgtctaaacaatggttgaaaagcaaaggaaatataaaacagacacctctttccatttcctaaggtttctctctttattaagggtggactagtaataaaatataatattcttgctgcttatgcagctgacattgttgccctccctaaagcaaccaagtagcctttatttcccacagtgaaagaaaacgctggcctatcagttacattacaaaaggcagatttcaagaggattgagtaagtagttggatggctttcataaaaacaagaattcaagaagaggattcatgctttaagaaacatttgttatacattcctcacaaattatacctgggataaaaactatgtagcaggcagtgtgttttccttccatgtctctctgcactacctgcagtgtgtcctctgaggctgcaagtctgtcctatctgaattcccagcagaagcactaagaagctccaccctatcacctagcagataaaactatggggaaaacttaaatctgtgcatacatttctggatgcatttacttatctttaaaaaaaaaggaatcctatgacctgatttggccacaaaaataatcttgctgtacaatacaatctcttggaaattaagagatcctatggatttgatgactggtattagaggtgacaatgtaaccgattaacaacagacagcaataacttcgttttagaaacattcaagcaatagctttatagcttcaacatatggtacgttttaaccttgaaagttttgcaatgatgaaagcagtatttgtacaaatgaaaagcagaattctcttttatatggtttatactgttgatcagaaatgttgattgtgcattgagtattaaaaaattagatgtatattattcattgttctttactcctgagtaccttataataataataatgtattctttgttaacaa

SEQ ID NO: 1475 - DNA, 2239 bp, Homo sapiens
ccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacgggtcctaataaatcttcactgtctgactttagtctcccactaaaactgcatttcctttctacaatttcaatttctccctttgcttcaaataaagtcctgacactattcatttga

SEQ ID NO: 1476 - DNA, 2864 bp, Homo sapiens
cccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacgggccaggaaatgagagtctcaaagccatgttattctgcctttttaaactatcatcctgtaatcaaagtaatgatggcagcgtgtcccaccagagcgggagcccagctgctcaggagtcatgcttaggatggatcccttctcttctgccgtcagagtttcagctgggttggggtggatgcagccacctccatgcctggccttctgcatctgtgatcatcacggcctcctcctgccactgagcctcatgccttcacgtgtctgttccccccgcttttcctttctgccacccctgcacgtgggccgccaggttcccaagagtatcctacccatttccttccttccactccctttgccagtgcctctcaccccaactagtagctaaccatcacccccaggactgacctcttcctcctcgctgccagatgattgttcaaagcacagaatttgtcagaaacctgcagggactccatgctgccagccttctccgtaattagcatggccccagtccatgcttctagccttggttccttctgcccctctgtttgaaattctagagccagctgtgggacaattatctgtgtcaaaagccagatgtgaaaacatctcaataacaaactggctgctttgttcaatgctagaacaacgcctgtcacagagtagaaactcaaaaatatttgctgagtgaatgaacaaatgaataaatgcataataaataattaaccaccaatccaacatccaga

SEQ ID NO: 1477 - DNA, 5595 bp, Homo sapiens
ccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtggtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgactgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactct

SEQ ID NO: 1478 - DNA, 1570 bp, Homo sapiens
ccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacaggtttgagctgaattatcacatgaatataaatgggaaatcagtgttttagagagagaacttttcgacatatttcctgttcccttggaataaaaacatttcttctgaaattttaccgttaa

SEQ ID NO: 1479 - DNA, 2529 bp, Homo sapiens
gccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatggaagctacatagtgtctcactttccaagatcattctacaagatgtcagtgcactgaaacatgcaggggcgtgttgagtgccaaggatcttgacaagttgttttgaagatggcattttgctaagtccctgagggtcactggtcctcaaagcggcatggcggcatggcgtggctggttctgccacatgccagctgtgtgacctctgagactccacttcttcagtgctgaaaataaagaaggagttttactaaggaccaaacaagataatgaatgtgaaactgctccacgaaccccaaagaattatgcacatagatgcgatcattaagatgcgaagccatcgagttaccacctggcatgcttaaactgtaaagagtgggtcaaagtaaactgaattggaaaatccaaagttatgcagaaaaacaataaagaggtcttacgtagcaataccgaac

SEQ ID NO: 1480 - DNA, 3938 bp, Homo sapiens
actggacttcagaacaagagggagctctgggctgctggctggttgtgcatttgctgtgggttccctccggcaggcgacctctccgcgctgagaaggttatccggataaccaatttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgactgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttg

SEQ ID NO: 1481 - DNA, 3844 bp, Homo sapiens
gtccgggcagcccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacagggccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgactgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctggtgagtggcttgtctggaaacagtcctgctcctcaacctcctcgacccactcagcagcagccagtctccagtgtccaagccaggtgctccctccagcatctccagagggggaaacagtggcagatttgcagacacagtgaagggcgtaaggagcagataaacacatgaccgagcctgcacaagctctttgttgtgtctggttgtttgctgtacctctgttgtaagaatgaatctgcaaaatttctagcttatgaagcaaatcacggacatacacatctgtgtgtgtgagtgttcatgatgtgtgtacatctgtgtatgtgtgtgtgtgtatgtgtgtgtttgtgacagatttgatccctgttctctctgctggctctatcttgacctgtgaaacgtatatttaactaattaaatattagttaatattaataaattttaagctttatccaga

SEQ ID NO: 1482 - DNA, 4735 bp, Homo sapiens
atgagttctctgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgactgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactct

SEQ ID NO: 1483 - DNA, 4087 bp, Homo sapiens
tctggagactcctgcctatgggaaagaggttgacatcacgcgccaatcggcatggctcttagagagagcagcttagtttttgaatcggttgtggcggccgccggcgaggaatggcggtatttgtgagaggagtcggcgtttgaagaggtggaactcctagggcttttttgagagtgctgatttagaagaatacaaatcatggctgaaaatagtgtattaacatccactactgggaggactagcttggcagactcttccatttttgattctaaagttactgagatttccaaggaaaacttacttattggatctacttcatatgtagaagaagagatgcctcagattgaaacaagagtgatattggttcaagaagctggaaaacaagaagaacttataaaagccttaaaggacattaaagtgggctttgtaaagatggagtcagtggaagaatttgaaggtttggattctccggaatttgaaaatgtatttgtagtcacggactttcaggattctgtctttaatgacctctacaaggctgattgtagagttattggaccaccagttgtattaaattgttcacaaaaaggagagcctttgccattttcatgtcgcccgttgtattgtacaagtatgatgaatctagtactatgctttactggatttaggaaaaaagaagaactagtcaggttggtgacattggtccatcacatgggtggagttattcgaaaagactttaattcaaaagttacacatttggtggcaaattgtacacaaggagaaaaattcagggttgctgtgagtctaggtactccaattatgaagccagaatggatttataaagcttgggaaaggcggaatgaacaggatttctatgcagcagttgatgactttagaaatgaatttaaagttcctccatttcaagattgtattttaagtttcctgggattttcagatgaagagaaaaccaatatggaagaaatgactgaaatgcaaggaggtaaatatttaccgcttggagatgaaagatgcactcaccttgtagttgaagagaatatagtaaaagatcttccctttgaaccttcaaagaaactttatgttgtcaagcaagagtggttctggggaagcattcaaatggatgcccgagctggagaaactatgtatttatatgaaaaggcaaatactcctgagctcaagaaatcagtgtcaatgctttctctaaatacccctaacagcaatcgcaaacgacgtcgtttaaaagaaacacttgctcagctttcaagagagacagacgtgtcaccatttccaccccgtaagcgcccatcagctgagcattccctttccatagggtcactcctagatatctccaacacaccagagtctagcattaactatggagacaccccaaagtcttgtactaagtcttctaaaagctccactccagttccttcaaagcagtcagcaaggtggcaagttgcaaaagagctttatcaaactgaaagtaattatgttaatatattggcaacaattattcagttatttcaagtaccattggaagaggaaggacaacgtggtggacctatccttgcaccagaggagattaagactatttttggtagcatcccagatatctttgatgtacacactaagataaaggatgatcttgaagaccttatagttaattgggatgagagcaaaagcattggtgacatttttctgaaatattcaaaagatttggtaaaaacctaccctccctttgtaaacttctttgaaatgagcaaggaaacaattattaaatgtgaaaaacagaaaccaagatttcatgcttttctcaagataaaccaagcaaaaccagaatgtggacggcagagccttgttgaacttcttatccgaccagtacagaggttacccagtgttgcattacttttaaatgatcttaagaagcatacagctgatgaaaatccagacaaaagcactttagaaaaagctattggatcactgaaggaagtaatgacgcatattaatgaggataagagaaaaacagaagctcaaaagcaaatttttgatgttgtttatgaagtagatggatgcccagctaatcttttatcttctcaccgaagcttagtacagcgggttgaaacaatttctctaggtgagcacccctgtgacagaggagaacaagtaactctcttcctcttcaatgattgcctagagatagcaagaaaacggcacaaggttattggcacttttaggagtcctcatggccaaacccgacccccagcttctcttaagcatattcacctaatgcctctttctcagattaagaaggtattggacataagagagacagaagattgccataatgcttttgccttgcttgtgaggccaccaacagagcaggcaaatgtgctactcagtttccagatgacatcagatgaacttccaaaagaaaactggctaaagatgctgtgtcgacatgtagctaacaccatttgtaaagcagatgctgagaatcttatttatactgctgatccagaatcctttgaagtaaatacaaaagatatggacagtacattgagtagagcatcaagagcaataaaaaagacttcaaaaaaggttacaagagcattctctttctccaaaactccaaaaagagctcttcgaagggctcttatgacatcccacggctcagtggagggaagaagtccttccagcaatgataagcatgtaatgagtcgtctttctagcacatcatcattagcaggtatcccttctccctcccttgtcagccttccttccttctttgaaaggagaagtcatacgttaagtagatctacaactcatttgatatgaagcgttaccaaaatcttaaattatagaaatgtatagacacctcatactcaaataagaaactgacttaaatggtacttgtaattagcacttggtgaaagctggaaggaagataaataacactaaactatgctatttgatttttcttcttgaaagagtaaggtttacctgttacattttcaagttaattcatgtaaaaaatgatagtgattttgatgtaatttatctcttgtttgaatctgtcattcaaaggccaataatttaagttgctatcagctgatattagtagctttgcaaccctgatagagtaaataaattttatgggcgggtgccaaatactgctgtgaatctatttgtatagtatccatgaatgaatttatggaaatagatatttgtgcagctcaatttatgcagagattaaatgacatcataatactggatgaaaacttgcatagaattctgattaaatagtgggtctgtttcacatgtgcagtttgaagtatttaaataaccactcctttcacagtttattttcttctcaagcgttttcaagatctagcatgtggattttaaaagatttgccctcattaacaagaataacatttaaaggagattgtttcaaaatatttttgcaaattgagataaggacagaaagattgagaaacattgtatattttgcaaaaacaagatgtttgtagctgtttcagagagagtacggtatatttatggtaattttatccactagcaaatcttgatttagtttgatagtgtgtggaattttattttgaaggataagaccatgggaaaattgtggtaaagactgtttgtacccttcatgaaataattctgaagttgccatcagttttactaatcttctgtgaaatgcatagatatgcgcatgttcaactttttattgtggtcttataattaaatgtaaaattgaaaattcatttgctgtttcaaagtgtgatatctttcacaatagcctttttatagtcagtaattcagaataatcaagttcatatggataaatgcatttttatttcctatttctttagggagtgctacaaatgtttgtcacttaaatttcaagtttctgttttaatagttaactgactatagattgttttctatgccatgtatgtgccacttctgagagtagtaaatgactctttgctacattttaaaagcaattgtattagtaagaactttgtaaataaatacctaaaacccaagtgta

SEQ ID NO: 1484 - DNA, 558 bp, Homo sapiens
aattccggagcgccccagctcaggcttcccggatccgggaactccctcgccgcaccccacccccagcagccgggccctgacgcggagtgggagaccgaagcccccagtattgctgggcatcttcgccctcacctgttggctcttttggacagaagagtacggagtctacctcttgttacctagactggagtgcagtggcacgatctcggctcactgcaacctctgcctcccgggttcaagcgattctcctgcctcagcctcctgagtagctgggattacaggtgcctgccaccaagcccagctaatttttgtatttttagtagagacggggtttcattgtgttggccaggctggtctcgaactcctgacctcgtgatccgcccgccttggcctcccaaagtgctaggattacaagtgtgagccaccgcgtccggcctttcaaatggtatttttgattttcctcttccagtccttaaagcagctgatttagaagaatacaaatcatggctgaaaatagtgtattaacatccactactgggaggactagcttggcagact

SEQ ID NO: 1485 - DNA, 4158 bp, Homo sapiens
aaagaggttgacatcacgcgccaatcggcatggctcttagagagagcagcttagtttttgaatcggttgtggcggccgccggcgaggaatggcggtatttgtgagaggagtcggcgtttgaagaggtggaactcctagggcttttttgagagtgctgatttagaagaatacaaatcatggctgaaaatagtgtattaacatccactactgggaggactagcttggcagactcttccatttttgattctaaagttactgagatttccaaggaaaacttacttattggatctacttcatatgtagaagaagagatgcctcagattgaaacaagagtgatattggttcaagaagctggaaaacaagaagaacttataaaagccttaaagactattaaaataatggaagtccctgttataaagataaaagaaagttgtcctggaaaatcggatgaaaaattaataaaaagtgttattaatatggacattaaagtgggctttgtaaagatggagtcagtggaagaatttgaaggtttggattctccggaatttgaaaatgtatttgtagtcacggactttcaggattctgtctttaatgacctctacaaggctgattgtagagttattggaccaccagttgtattaaattgttcacaaaaaggagagcctttgccattttcatgtcgcccgttgtattgtacaagtatgatgaatctagtactatgctttactggatttaggaaaaaagaagaactagtcaggttggtgacattggtccatcacatgggtggagttattcgaaaagactttaattcaaaagttacacatttggtggcaaattgtacacaaggagaaaaattcagggttgctgtgagtctaggtactccaattatgaagccagaatggatttataaagcttgggaaaggcggaatgaacaggatttctatgcagcagttgatgactttagaaatgaatttaaagttcctccatttcaagattgtattttaagtttcctgggattttcagatgaagagaaaaccaatatggaagaaatgactgaaatgcaaggaggtaaatatttaccgcttggagatgaaagatgcactcaccttgtagttgaagagaatatagtaaaagatcttccctttgaaccttcaaagaaactttatgttgtcaagcaagagtggttctggggaagcattcaaatggatgcccgagctggagaaactatgtatttatatgaaaaggcaaatactcctgagctcaagaaatcagtgtcaatgctttctctaaatacccctaacagcaatcgcaaacgacgtcgtttaaaagaaacacttgctcagctttcaagagagacagacgtgtcaccatttccaccccgtaagcgcccatcagctgagcattccctttccatagggtcactcctagatatctccaacacaccagagtctagcattaactatggagacaccccaaagtcttgtactaagtcttctaaaagctccactccagttccttcaaagcagtcagcaaggtggcaagttgcaaaagagctttatcaaactgaaagtaattatgttaatatattggcaacaattattcagttatttcaagtaccattggaagaggaaggacaacgtggtggacctatccttgcaccagaggagattaagactatttttggtagcatcccagatatctttgatgtacacactaagataaaggatgatcttgaagaccttatagttaattgggatgagagcaaaagcattggtgacatttttctgaaatattcaaaagatttggtaaaaacctaccctccctttgtaaacttctttgaaatgagcaaggaaacaattattaaatgtgaaaaacagaaaccaagatttcatgcttttctcaagataaaccaagcaaaaccagaatgtggacggcagagccttgttgaacttcttatccgaccagtacagaggttacccagtgttgcattacttttaaatgatcttaagaagcatacagctgatgaaaatccagacaaaagcactttagaaaaagctattggatcactgaaggaagtaatgacgcatattaatgaggataagagaaaaacagaagctcaaaagcaaatttttgatgttgtttatgaagtagatggatgcccagctaatcttttatcttctcaccgaagcttagtacagcgggttgaaacaatttctctaggtgagcacccctgtgacagaggagaacaagtaactctcttcctcttcaatgattgcctagagatagcaagaaaacggcacaaggttattggcacttttaggagtcctcatggccaaacccgacccccagcttctcttaagcatattcacctaatgcctctttctcagattaagaaggtattggacataagagagacagaagattgccataatgcttttgccttgcttgtgaggccaccaacagagcaggcaaatgtgctactcagtttccagatgacatcagatgaacttccaaaagaaaactggctaaagatgctgtgtcgacatgtagctaacaccatttgtaaagcagatgctgagaatcttatttatactgctgatccagaatcctttgaagtaaatacaaaagatatggacagtacattgagtagagcatcaagagcaataaaaaagacttcaaaaaaggttacaagagcattctctttctccaaaactccaaaaagagctcttcgaagggctcttatgacatcccacggctcagtggagggaagaagtccttccagcaatgataagcatgtaatgagtcgtctttctagcacatcatcattagcaggtatcccttctccctcccttgtcagccttccttccttctttgaaaggagaagtcatacgttaagtagatctacaactcatttgatatgaagcgttaccaaaatcttaaattatagaaatgtatagacacctcatactcaaataagaaactgacttaaatggtacttgtaattagcacttggtgaaagctggaaggaagataaataacactaaactatgctatttgatttttcttcttgaaagagtaaggtttacctgttacattttcaagttaattcatgtaaaaaatgatagtgattttgatgtaatttatctcttgtttgaatctgtcattcaaaggccaataatttaagttgctatcagctgatattagtagctttgcaaccctgatagagtaaataaattttatgggcgggtgccaaatactgctgtgaatctatttgtatagtatccatgaatgaatttatggaaatagatatttgtgcagctcaatttatgcagagattaaatgacatcataatactggatgaaaacttgcatagaattctgattaaatagtgggtctgtttcacatgtgcagtttgaagtatttaaataaccactcctttcacagtttattttcttctcaagcgttttcaagatctagcatgtggattttaaaagatttgccctcattaacaagaataacatttaaaggagattgtttcaaaatatttttgcaaattgagataaggacagaaagattgagaaacattgtatattttgcaaaaacaagatgtttgtagctgtttcagagagagtacggtatatttatggtaattttatccactagcaaatcttgatttagtttgatagtgtgtggaattttattttgaaggataagaccatgggaaaattgtggtaaagactgtttgtacccttcatgaaataattctgaagttgccatcagttttactaatcttctgtgaaatgcatagatatgcgcatgttcaactttttattgtggtcttataattaaatgtaaaattgaaaattcatttgctgtttcaaagtgtgatatctttcacaatagcctttttatagtcagtaattcagaataatcaagttcatatggataaatgcatttttatttcctatttctttagggagtgctacaaatgtttgtcacttaaatttcaagtttctgttttaatagttaactgactatagattgttttctatgccatgtatgtgccacttctgagagtagtaaatgactctttgctacattttaaaagcaattgtattagtaagaactttgtaaataaatacctaaaacccaagtgta

SEQ ID NO: 1486 - DNA, 637 bp, Homo sapiens
aggcttcccggatccgggaactccctcgccgcaccccacccccagcagccgggccctgacgcggagtgggagaccgaagcccccagtattgctgggcatcttcgccctcacctgttggctcttttggacagaagagtctgatttagaagaatacaaatcatggctgaaaatagtgtattaacatccactactgggaggactagcttggcagactcttccatttttgattctaaagttactgagatttccaaggaaaacttacttattggatctacttcatatgtagaagaagagatgcctcagattgaaacaagagtgatattggttcaagaagctggaaaacaagaagaacttataaaagccttaaaggacattaaagtgggctttgtaaagatggagtcagtggaagaatttgaaggtttggattctccggaatttgaaaatgtatttgtagtcacggactttcaggattctgtctttaatgacctctacaaggctgattgtagagttattggaccaccagttgtattaaattgttcacaaaaaggagagcctttgccattttcatgtcgcccgttgtattgtacaagtatgatgaatctagtactatgctttactggatttaggaaaaaagaag

SEQ ID NO: 1487 - DNA, 4363 bp, Homo sapiens
aatcggcatggctcttagagagagcagcttagtttttgaatcggttgtggcggccgccggcgaggaatggcggtatttgtgagaggagtcggcgtttgaagaggtggaactcctagggcttttttgagagtgacggagtctacctcttgttacctagactggagtgcagtggcacgatctcggctcactgcaacctctgcctcccgggttcaagcgattctcctgcctcagcctcctgagtagctgggattacaggtgcctgccaccaagcccagctaatttttgtatttttagtagagacggggtttcattgtgttggccaggctggtctcgaactcctgacctcgtgatccgcccgccttggcctcccaaagtgctaggattacaagtgtgagccaccgcgtccggcctttcaaatggtatttttgattttcctcttccagtccttaaagcagctgatttagaagaatacaaatcatggctgaaaatagtgtattaacatccactactgggaggactagcttggcagactcttccatttttgattctaaagttactgagatttccaaggaaaacttacttattggatctacttcatatgtagaagagatgcctcagattgaaacaagagtgatattggttcaagaagctggaaaacaagaagaacttataaaagccttaaaggacattaaagtgggctttgtaaagatggagtcagtggaagaatttgaaggtttggattctccggaatttgaaaatgtatttgtagtcacggactttcaggattctgtctttaatgacctctacaaggctgattgtagagttattggaccaccagttgtattaaattgttcacaaaaaggagagcctttgccattttcatgtcgcccgttgtattgtacaagtatgatgaatctagtactatgctttactggatttaggaaaaaagaagaactagtcaggttggtgacattggtccatcacatgggtggagttattcgaaaagactttaattcaaaagttacacatttggtggcaaattgtacacaaggagaaaaattcagggttgctgtgagtctaggtactccaattatgaagccagaatggatttataaagcttgggaaaggcggaatgaacaggatttctatgcagcagttgatgactttagaaatgaatttaaagttcctccatttcaagattgtattttaagtttcctgggattttcagatgaagagaaaaccaatatggaagaaatgactgaaatgcaaggaggtaaatatttaccgcttggagatgaaagatgcactcaccttgtagttgaagagaatatagtaaaagatcttccctttgaaccttcaaagaaactttatgttgtcaagcaagagtggttctggggaagcattcaaatggatgcccgagctggagaaactatgtatttatatgaaaaggcaaatactcctgagctcaagaaatcagtgtcaatgctttctctaaatacccctaacagcaatcgcaaacgacgtcgtttaaaagaaacacttgctcagctttcaagagagacagacgtgtcaccatttccaccccgtaagcgcccatcagctgagcattccctttccatagggtcactcctagatatctccaacacaccagagtctagcattaactatggagacaccccaaagtcttgtactaagtcttctaaaagctccactccagttccttcaaagcagtcagcaaggtggcaagttgcaaaagagctttatcaaactgaaagtaattatgttaatatattggcaacaattattcagttatttcaagtaccattggaagaggaaggacaacgtggtggacctatccttgcaccagaggagattaagactatttttggtagcatcccagatatctttgatgtacacactaagataaaggatgatcttgaagaccttatagttaattgggatgagagcaaaagcattggtgacatttttctgaaatattcaaaagatttggtaaaaacctaccctccctttgtaaacttctttgaaatgagcaaggaaacaattattaaatgtgaaaaacagaaaccaagatttcatgcttttctcaagataaaccaagcaaaaccagaatgtggacggcagagccttgttgaacttcttatccgaccagtacagaggttacccagtgttgcattacttttaaatgatcttaagaagcatacagctgatgaaaatccagacaaaagcactttagaaaaagctattggatcactgaaggaagtaatgacgcatattaatgaggataagagaaaaacagaagctcaaaagcaaatttttgatgttgtttatgaagtagatggatgcccagctaatcttttatcttctcaccgaagcttagtacagcgggttgaaacaatttctctaggtgagcacccctgtgacagaggagaacaagtaactctcttcctcttcaatgattgcctagagatagcaagaaaacggcacaaggttattggcacttttaggagtcctcatggccaaacccgacccccagcttctcttaagcatattcacctaatgcctctttctcagattaagaaggtattggacataagagagacagaagattgccataatgcttttgccttgcttgtgaggccaccaacagagcaggcaaatgtgctactcagtttccagatgacatcagatgaacttccaaaagaaaactggctaaagatgctgtgtcgacatgtagctaacaccatttgtaaagcagatgctgagaatcttatttatactgctgatccagaatcctttgaagtaaatacaaaagatatggacagtacattgagtagagcatcaagagcaataaaaaagacttcaaaaaaggttacaagagcattctctttctccaaaactccaaaaagagctcttcgaagggctcttatgacatcccacggctcagtggagggaagaagtccttccagcaatgataagcatgtaatgagtcgtctttctagcacatcatcattagcaggtatcccttctccctcccttgtcagccttccttccttctttgaaaggagaagtcatacgttaagtagatctacaactcatttgatatgaagcgttaccaaaatcttaaattatagaaatgtatagacacctcatactcaaataagaaactgacttaaatggtacttgtaattagcacttggtgaaagctggaaggaagataaataacactaaactatgctatttgatttttcttcttgaaagagtaaggtttacctgttacattttcaagttaattcatgtaaaaaatgatagtgattttgatgtaatttatctcttgtttgaatctgtcattcaaaggccaataatttaagttgctatcagctgatattagtagctttgcaaccctgatagagtaaataaattttatgggcgggtgccaaatactgctgtgaatctatttgtatagtatccatgaatgaatttatggaaatagatatttgtgcagctcaatttatgcagagattaaatgacatcataatactggatgaaaacttgcatagaattctgattaaatagtgggtctgtttcacatgtgcagtttgaagtatttaaataaccactcctttcacagtttattttcttctcaagcgttttcaagatctagcatgtggattttaaaagatttgccctcattaacaagaataacatttaaaggagattgtttcaaaatatttttgcaaattgagataaggacagaaagattgagaaacattgtatattttgcaaaaacaagatgtttgtagctgtttcagagagagtacggtatatttatggtaattttatccactagcaaatcttgatttagtttgatagtgtgtggaattttattttgaaggataagaccatgggaaaattgtggtaaagactgtttgtacccttcatgaaataattctgaagttgccatcagttttactaatcttctgtgaaatgcatagatatgcgcatgttcaactttttattgtggtcttataattaaatgtaaaattgaaaattcatttgctgtttcaaagtgtgatatctttcacaatagcctttttatagtcagtaattcagaataatcaagttcatatggataaatgcatttttatttcctatttctttagggagtgctacaaatgtttgtcacttaaatttcaagtttctgttttaatagttaactgactatagattgttttctatgccatgtatgtgccacttctgagagtagtaaatgactctttgctacattttaaaagcaattgtattagtaagaactttgtaaataaatacctaaaacccaagtgta

SEQ ID NO: 1488 - DNA, 560 bp, Homo sapiens
gaatcggttgtggcggccgccggcgaggaatggcggtatttgtgagaggagtcggcgtttgaagaggtggaactcctagggcttttttgagagtgacggagtctacctcttgttacctagactggagtgcagtggcacgatctcggctcactgcaacctctgcctcccgggttcaagcgattctcctgcctcagcctcctgagtagctgggattacagctgatttagaagaatacaaatcatggctgaaaatagtgtattaacatccactactgggaggactagcttggcagactcttccatttttgattctaaagttactgagatttccaaggaaaacttacttattggatctacttcatatgtagaagaagagatgcctcagattgaaacaagagtgatattggttcaagaagctggaaaacaagaagaacttataaaagccttaaaggacattaaagtgggctttgtaaagatggagtcagtggaagaatttgaaggtttggattctccggaatttgaaaatgtatttgtagtcacggactttcaggattctgtctt

SEQ ID NO: 1489 - DNA, 2941 bp, Homo sapiens
gccaatcggcatggctcttagagagagcagcttagtttttgaatcggttgtggcggccgccggcgaggaatggcggtatttgtgagaggagtcggcgtttgaagaggtggaactcctagggcttttttgagagtgctgatttagaagaatacaaatcatggctgaaaatagtgtattaacatccactactgggaggactagcttggcagactcttccatttttgattctaaagttactgagatttccaaggaaaacttacttattggatctacttcatatgtagaagaagagatgcctcagattgaaacaagagtgatattggttcaagaagctggaaaacaagaagaacttataaaagccttaaaggacattaaagtgggctttgtaaagatggagtcagtggaagaatttgaaggtttggattctccggaatttgaaaatgtatttgtagtcacggactttcaggattctgtctttaatgacctctacaaggctgattgtagagttattggaccaccagttgtattaaattgttcacaaaaaggagagcctttgccattttcatgtcgcccgttgtattgtacaagtatgatgaatctagtactatgctttactggatttaggaaaaaagaagaactagtcaggttggtgacattggtccatcacatgggtggagttattcgaaaagactttaattcaaaagttacacatttggtggcaaattgtacacaaggagaaaaattcagggttgctgtgagtctaggtactccaattatgaagccagaatggatttataaagcttgggaaaggcggaatgaacaggatttctatgcagcagttgatgactttagaaatgaatttaaagttcctccatttcaagattgtattttaagtttcctgggattttcagatgaagagaaaaccaatatggaagaaatgactgaaatgcaaggaggtaaatatttaccgcttggagatgaaagatgcactcaccttgtagttgaagagaatatagtaaaagatcttccctttgaaccttcaaagaaactttatgttgtcaagcaagagtggttctggggaagcattcaaatggatgcccgagctggagaaactatgtatttatatgaaaaggcaaatactcctgagctcaagaaatcagtgtcaatgctttctctaaatacccctaacagcaatcgcaaacgacgtcgtttaaaagaaacacttgctcagctttcaagagagacagacgtgtcaccatttccaccccgtaagcgcccatcagctgagcattccctttccatagggtcactcctagatatctccaacacaccagagtctagcattaactatggagacaccccaaagtcttgtactaagtcttctaaaagctccactccagttccttcaaagcagtcagcaaggtggcaagttgcaaaagagctttatcaaactgaaagtaattatgttaatatattggcaacaattattcagttatttcaagtaccattggaagaggaaggacaacgtggtggacctatccttgcaccagaggagattaagactatttttggtagcatcccagatatctttgatgtacacactaagataaaggatgatcttgaagaccttatagttaattgggatgagagcaaaagcattggtgacatttttctgaaatattcaaaagatttggtaaaaacctaccctccctttgtaaacttctttgaaatgagcaaggaaacaattattaaatgtgaaaaacagaaaccaagatttcatgcttttctcaagataaaccaagcaaaaccagaatgtggacggcagagccttgttgaacttcttatccgaccagtacagaggttacccagtgttgcattacttttaaatgatcttaagaagcatacagctgatgaaaatccagacaaaagcactttagaaaaagctattggatcactgaaggaagtaatgacgcatattaatgaggataagagaaaaacagaagctcaaaagcaaatttttgatgttgtttatgaagtagatggatgcccagctaatcttttatcttctcaccgaagcttagtacagcgggttgaaacaatttctctaggtgagcacccctgtgacagaggagaacaagtaactctcttcctcttcaatgattgcctagagatagcaagaaaacggcacaaggttattggcacttttaggagtcctcatggccaaacccgacccccagcttctcttaagcatattcacctaatgcctctttctcagattaagaaggtattggacataagagagacagaagattgccataatgcttttgccttgcttgtgaggccaccaacagagcaggcaaatgtgctactcagtttccagatgacatcagatgaacttccaaaagaaaactggctaaagatgctgtgtcgacatgtagctaacaccatttgtaaagcagatgctgagaatcttatttatactgctgatccagaatcctttgaagtaaatacaaaagatatggacagtacattgagtagagcatcaagagcaataaaaaagacttcaaaaaaggttacaagagcattctctttctccaaaactccaaaaagagctcttcgaagggctcttatgacatcccacggctcagtggagggaagaagtccttccagcaatgataagcatgtaatgagtcgtctttctagcacatcatcattagcaattacccattctgtttccacaagcaatgtaattggatttactaagcatgtttatgttcagcgcctaaactctactggtgggcgctctcagtactcctggtttcaatctgtacgtcattctgctttccgagctagtttttcagagatactagaaggaaatactgatttttcaaatttcaaaaaagttctttccaagtcatctttgacatttgtgaagaattag

SEQ ID NO: 1490 - DNA, 2825 bp, Homo sapiens
ttttgcccaatgaccatgtttatgtatttttattcaaattttattttttcagctgatttagaagaatacaaatcatggctgaaaatagtgtattaacatccactactgggaggactagcttggcagactcttccatttttgattctaaagttactgagatttccaaggaaaacttacttattggatctacttcatatgtagaagaagagatgcctcagattgaaacaagagtgatattggttcaagaagctggaaaacaagaagaacttataaaagccttaaaggacattaaagtgggctttgtaaagatggagtcagtggaagaatttgaaggtttggattctccggaatttgaaaatgtatttgtagtcacggactttcaggattctgtctttaatgacctctacaaggctgattgtagagttattggaccaccagttgtattaaattgttcacaaaaaggagagcctttgccattttcatgtcgcccgttgtattgtacaagtatgatgaatctagtactatgctttactggatttaggaaaaaagaagaactagtcaggttggtgacattggtccatcacatgggtggagttattcgaaaagactttaattcaaaagttacacatttggtggcaaattgtacacaaggagaaaaattcagggttgctgtgagtctaggtactccaattatgaagccagaatggatttataaagcttgggaaaggcggaatgaacaggatttctatgcagcagttgatgactttagaaatgaatttaaagttcctccatttcaagattgtattttaagtttcctgggattttcagatgaagagaaaaccaatatggaagaaatgactgaaatgcaaggaggtaaatatttaccgcttggagatgaaagatgcactcaccttgtagttgaagagaatatagtaaaagatcttccctttgaaccttcaaagaaactttatgttgtcaagcaagagtggttctggggaagcattcaaatggatgcccgagctggagaaactatgtatttatatgaaaaggcaaatactcctgagctcaagaaatcagtgtcaatgctttctctaaatacccctaacagcaatcgcaaacgacgtcgtttaaaagaaacacttgctcagctttcaagagagacagacgtgtcaccatttccaccccgtaagcgcccatcagctgagcattccctttccatagggtcactcctagatatctccaacacaccagagtctagcattaactatggagacaccccaaagtcttgtactaagtcttctaaaagctccactccagttccttcaaagcagtcagcaaggtggcaagttgcaaaagagctttatcaaactgaaagtaattatgttaatatattggcaacaattattcagttatttcaagtaccattggaagaggaaggacaacgtggtggacctatccttgcaccagaggagattaagactatttttggtagcatcccagatatctttgatgtacacactaagataaaggatgatcttgaagaccttatagttaattgggatgagagcaaaagcattggtgacatttttctgaaatattcaaaagatttggtaaaaacctaccctccctttgtaaacttctttgaaatgagcaaggaaacaattattaaatgtgaaaaacagaaaccaagatttcatgcttttctcaagataaaccaagcaaaaccagaatgtggacggcagagccttgttgaacttcttatccgaccagtacagaggttacccagtgttgcattacttttaaatgatcttaagaagcatacagctgatgaaaatccagacaaaagcactttagaaaaagctattggatcactgaaggaagtaatgacgcatattaatgaggataagagaaaaacagaagctcaaaagcaaatttttgatgttgtttatgaagtagatggatgcccagctaatcttttatcttctcaccgaagcttagtacagcgggttgaaacaatttctctaggtgagcacccctgtgacagaggagaacaagtaactctcttcctcttcaatgattgcctagagatagcaagaaaacggcacaaggttattggcacttttaggagtcctcatggccaaacccgacccccagcttctcttaagcatattcacctaatgcctctttctcagattaagaaggtattggacataagagagacagaagattgccataatgcttttgccttgcttgtgaggccaccaacagagcaggcaaatgtgctactcagtttccagatgacatcagatgaacttccaaaagaaaactggctaaagatgctgtgtcgacatgtagctaacaccatttgtaaagcagatgctgagaatcttatttatactgctgatccagaatcctttgaagtaaatacaaaagatatggacagtacattgagtagagcatcaagagcaataaaaaagacttcaaaaaaggttacaagagcattctctttctccaaaactccaaaaagagctcttcgaagggctcttatgacatcccacggctcagtggagggaagaagtccttccagcaatgataagcatgtaatgagtcgtctttctagcacatcatcattagcaggtatcccttctccctcccttgtcagccttccttccttctttgaaaggagaagtcatacgttaagtagatctacaactcatttgatatgaagcgttaccaaaatcttaaattatagaaatgtatagacacctcatactcaaataagaaactgacttaaatggtacttgtaattagcacttggtgaaagc

SEQ ID NO: 1491 - DNA, 2745 bp, Homo sapiens
atggctgaaaatagtgtattaacatccactactgggaggactagcttggcagactcttccatttttgattctaaagttactgagatttccaaggaaaacttacttattggatctacttcatatgtagaagaagagatgcctcagattgaaacaagagtgatattggttcaagaagctggaaaacaagaagaacttataaaagccttaaagactattaaaataatggaagtccctgttataaagataaaagaaagttgtcctggaaaatcggatgaaaaattaataaaaagtgttattaatatggacattaaagtgggctttgtaaagatggagtcagtggaagaatttgaaggtttggattctccggaatttgaaaatgtatttgtagtcacggactttcaggattctgtctttaatgacctctacaaggctgattgtagagttattggaccaccagttgtattaaattgttcacaaaaaggagagcctttgccattttcatgtcgcccgttgtattgtacaagtatgatgaatctagtactatgctttactggatttaggaaaaaagaagaactagtcaggttggtgacattggtccatcacatgggtggagttattcgaaaagactttaattcaaaagttacacatttggtggcaaattgtacacaaggagaaaaattcagggttgctgtgagtctaggtactccaattatgaagccagaatggatttataaagcttgggaaaggcggaatgaacaggatttctatgcagcagttgatgactttagaaatgaatttaaagttcctccatttcaagattgtattttaagtttcctgggattttcagatgaagagaaaaccaatatggaagaaatgactgaaatgcaaggaggtaaatatttaccgcttggagatgaaagatgcactcaccttgtagttgaagagaatatagtaaaagatcttccctttgaaccttcaaagaaactttatgttgtcaagcaagagtggttctggggaagcattcaaatggatgcccgagctggagaaactatgtatttatatgaaaaggcaaatactcctgagctcaagaaatcagtgtcaatgctttctctaaatacccctaacagcaatcgcaaacgacgtcgtttaaaagaaacacttgctcagctttcaagagagacagacgtgtcaccatttccaccccgtaagcgcccatcagctgagcattccctttccatagggtcactcctagatatctccaacacaccagagtctagcattaactatggagacaccccaaagtcttgtactaagtcttctaaaagctccactccagttccttcaaagcagtcagcaaggtggcaagttgcaaaagagctttatcaaactgaaagtaattatgttaatatattggcaacaattattcagttatttcaagtaccattggaagaggaaggacaacgtggtggacctatccttgcaccagaggagattaagactatttttggtagcatcccagatatctttgatgtacacactaagataaaggatgatcttgaagaccttatagttaattgggatgagagcaaaagcattggtgacatttttctgaaatattcaaaagatttggtaaaaacctaccctccctttgtaaacttctttgaaatgagcaaggaaacaattattaaatgtgaaaaacagaaaccaagatttcatgcttttctcaagataaaccaagcaaaaccagaatgtggacggcagagccttgttgaacttcttatccgaccagtacagaggttacccagtgttgcattacttttaaatgatcttaagaagcatacagctgatgaaaatccagacaaaagcactttagaaaaagctattggatcactgaaggaagtaatgacgcatattaatgaggataagagaaaaacagaagctcaaaagcaaatttttgatgttgtttatgaagtagatggatgcccagctaatcttttatcttctcaccgaagcttagtacagcgggttgaaacaatttctctaggtgagcacccctgtgacagaggagaacaagtaactctcttcctcttcaatgattgcctagagatagcaagaaaacggcacaaggttattggcacttttaggagtcctcatggccaaacccgacccccagcttctcttaagcatattcacctaatgcctctttctcagattaagaaggtattggacataagagagacagaagattgccataatgcttttgccttgcttgtgaggccaccaacagagcaggcaaatgtgctactcagtttccagatgacatcagatgaacttccaaaagaaaactggctaaagatgctgtgtcgacatgtagctaacaccatttgtaaagcagatgctgagaatcttatttatactgctgatccagaatcctttgaagtaaatacaaaagatatggacagtacattgagtagagcatcaagagcaataaaaaagacttcaaaaaaggttacaagagcattctctttctccaaaactccaaaaagagctcttcgaagggctcttatgacatcccacggctcagtggagggaagaagtccttccagcaatgataagcatgtaatgagtcgtctttctagcacatcatcattagcaggtatcccttctccctcccttgtcagccttccttccttctttgaaaggagaagtcatacgttaagtagatctacaactcatttgatatga

SEQ ID NO: 1492 - DNA, 3104 bp, Homo sapiens
acggcggtccggtgcgaggcagagtgctagcgggagcgcgagccagcaagaggcgcctgcgcgatgtccgggcccctgagcccgcggcgctgagccagccgggacggacatgcgcgggagggcgccgcggggcagccgccgctcctccgggggaatgaaagctactggttgattttaaagtgcctgggcctcacaggtttggagatgtcccagaataaggcacaatgtcaatagcaggagttgctgctcaggagatcagagtcccattaaaaactggatttctacataatggccgagccatggggaatatgaggaagacctactggagcagtcgcagtgagtttaaaaacaactttttaaatattgacccgataaccatggcctacagtctgaactcttctgctcaggagcgcctaataccacttgggcatgcttccaaatctgctccgatgaatggccactgctttgcagaaaatggtccatctcaaaagtccagcttgccccctcttcttattcccccaagtgaaaacttgggaccacatgaagaggatcaagttgtatgtggttttaagaaactcacagtgaatggggtttgtgcttccacccctccactgacacccataaaaaactccccttcccttttcccctgtgcccctctttgtgaacggggttctaggcctcttccaccgttgccaatctctgaagccctctctctggatgacacagactgtgaggtggaattcctaactagctcagatacagacttccttttagaagactctacactttctgatttcaaatatgatgttcctggcaggcgaagcttccgtgggtgtggacaaatcaactatgcatattttgataccccagctgtttctgcagcagatctcagctatgtgtctgaccaaaatggaggtgtcccagatccaaatcctcctccacctcagacccaccgaagattaagaaggtctcattcgggaccagctggctcctttaacaagccagccataaggatatccaactgttgtatacacagagcttctcctaactccgatgaagacaaacctgaggttccccccagagttcccatacctcctagaccagtaaagccagattatagaagatggtcagcagaagttacttcgagcacctatagtgatgaagacaggcctcccaaagtaccgccaagagaacctttgtcaccgagtaactcgcgcacaccgagtcccaaaagccttccgtcttacctcaatggggtcatgcccccgacacagagctttgcccctgatcccaagtatgtcagcagcaaagcactgcaaagacagaacagcgaaggatctgccagtaaggttccttgcattctgcccattattgaaaatgggaagaaggttagttcaacacattattacctactacctgaacgaccaccatacctggacaaatatgaaaaattttttagggaagcagaagaaacaaatggaggcgcccaaatccagccattacctgctgactgcggtatatcttcagccacagaaaagccagactcaaaaacaaaaatggatctgggtggccacgtgaagcgtaaacatttatcctatgtggtttctccttagaccttggggtcatggttcagcagaggttacataggagcaaatggttctcaattttccagtttgattgaagtgcagagaaaaatcccttagattgcaaaataaaatagttgaactctctgtcttcatgtggaaggtttagagcagttgtgagatgctgttatgctgagaaaccctgactttgttagtgttggaaaaaagtcttacaagtctataatttaaagatgtgatggtggggaggggaggatggggaagctttttatatatgcatacattacatacctatatataaacttgtggtataaccatagaccatagctgcaggttaaccaattagttactatcgtagagtaatatatattcagaataataaactcaagctggagaaatgagtcctgatagactgaaaattgagcaaatggaagaagatacagtattgtttagatcagaatcattaaaaaatatttttgtttagtaagtttgaagatttctggcttttaggccttttctattttgttccatttatttttgcaggcaatcttttccatggagggcagggtatccattctttaccatgggtgtacctgcttaggttaaaaatcataccaaggcctcatacttccaggtttcatgttgcgtcttgttgagggagggagagcaggttacttggcaaccatattgtcacctgtacctgtcacacatcttgaaaaataaaacgataatagaactagtgactaattttcccttacagttcctgcttggtcccacccactgaagtagctcatcgtagtgcgggccgtattagaggcagtggggtacgttagactcagatggaaaagtattctaggtgccagtgttaggatgtcagttttacaaaataatgaagcaattagctatgtgattgagagttattgtttggggatgtgtgttgtggttttgctttttttttttagactgtattaataaacatacaacacaagctggccttgtgttgctggttcctattcagtatttcctggggattgtttgctttttaagtaaaacacttctgacccatagctcagtatgtctgaattccagaggtcacatcagcatctttctgctttgaaaactctcacagctgtggctgcttcacttagatgcagtgagacacatagttggtgttccgattttcacatccttccatgtatttatcttgaagagataagcacagaagagaaggtgctcactaacagaggtacattactgcaatgttctcttaacagttaaacaagctgtttacagtttaaactgctgaatattatttgagctatttaaagcttattatattttagtatgaactaaatgaaggttaaaacatgcttaagaaaaatgcactgatttctgcattatgtgtacagtattggacaaaggattttattcattttgttgcattattttgaatattgtcttttcattttaataaagttataatacttatttatgataccatta

SEQ ID NO: 1493 - DNA, 2281 bp, Homo sapiens
aggagatctacttccgggccctgcgtggcagttgaaagagtggcgggagaagttgcagggaattatttgatagcacatactgatggctctaaagaagtcatcaccctcactggattctggtgatagtgactctgaggagttgccaacatttgcctttctgaagaaggaaccatcttcaacaaagaggagacagcctgaaagggaagagaagattgtagtggttgacatctcagattgtgaagcctcctgtcctccagcaccagagttattttcaccacctgtcccagaaatagctgaaactgtcacacaaacacagccagtcaggttgctaagcagtgaaagtgaagatgaagaagaatttattcctctggctcaaaggcttacatgtaagtttctgacccacaagcaactgagccctgaggactctagctccccagttaaaagtgttttggatcatcaaaataatgaaggtgcatcatgtgactggaaaaagccctttccaaagatccctgaagttcccctccatgataccccagagaggagtgcagcagataacaaggacctgatcttagatccatgctgtcagcttccagcctacctgtctacctgccctggccagagcagcagcttggcagtaaccaaaacaaattctgacatccttccaccccagaagaaaaccaagccgagtcagaaggtccagggaagaggctcacacggatgccggcagcagagacaagcaaggcagaaggaaagcaccctgagaagacaggaaagaaagaatgcagcactggttaccaggatgaaagcccagaggccagaggaatgcttaaaacacatcattgtagtgctggatccagtgctcttacagatggaaggtgggggccagctcctaggagcactgcagaccatggagtgccgctgtgtgattgaggcgcaggctgtgccttgcagtgtcacttggaggagaagggctgggccgtctgaggacagagaggactgggtggaggagccaacagtactggtgttgctccgggcagaggcatttgtgtccatgatcgacaatggaaagcagggaagcctggacagcactatgaaagggaaggaaacgcttcagggctttgtaactgacatcacagcaaagacagcagggaaagctctgtcactggtgattgtggatcaggagaaatgcttcagtgctcagaatcctccaagaagagggaaacagggagcaaataaacagaccaagaagcagcagcagagacaaccagaggccagcatagggtccatggtatccagggtagacgctgaagaggcattggtggatctgcagctacacacagaagcccaggctcaaattgtgcagagctggaaagagctggccgacttcacatgcgcattcacaaaggctgtggctgaggcgcccttcaagaagctccgagatgaaactaccttctccttctgtctggagagtgactgggctggaggggtgaaggtggaccttgctggcaggggactcgcactagtctggaggagacagattcagcagctgaaccgagtcagcctggaaatggccagtgcagttgtgaatgcctatccctccccacagctcctggtacaggcttatcagcagtgtttttcggataaagaacgccagaatttgctcgcagacatacaggtgcgccgtggggaaggtgtgacatccacttctcgccgcattggaccagaactatccaggcgtatctaccttcagatgaccactttacagccacatctctctttagatagtgctgactgattctagccctcagggatgaggatgaaaagctggaaacttccacttccccaacctcagagcctgactgtaatgaagagactggcagcacctcctggaacacaagcctaggtgaggcccagtctttcttgggtcttattatttgtgaaggtctctctgcctgtcggctggggcagagactgaaatactgccacctacctttggcatttaatgttcctctcctggcaaaaattcactgccacagacaaaccacccccactcctacccagccagccctcaaaacacaaaggaacaaagacagtccactcagacacttatttaataactgtagaaatccaaaagaattagcatcaaatcttgaagtcgtgagtgaagctgcgggttggcttgactgggctcagccactgagctgcctcaaccggccaaggaacgggattatgatgactatgcggacttctatattgtcttcatctcattgtgtgtattatg

SEQ ID NO: 1494 - DNA, 2354 bp, Homo sapiens
aggagatctacttccgggccctgcgtggcagttgaaagagtggcgggagaagttgcagggaattatttgatagcacatactgatggctctaaagaagtcatcaccctcactggattctggtgatagtgactctgaggagttgccaacatttgcctttctgaagaaggaaccatcttcaacaaagaggagacagcctgaaagggaagagaagattgtagtggttgacatctcagattgtgaagcctcctgtcctccagcaccagagttattttcaccacctgtcccagaaatagctgaaactgtcacacaaacacagccagtcaggttgctaagcagtgaaagtgaagatgaagaagaatttattcctctggctcaaaggcttacatgtaagtttctgacccacaagcaactgagccctgaggactctagctccccagttaaaagtgttttggatcatcaaaataatgaaggtgcatcatgtgactggaaaaagccctttccaaagatccctgaagttcccctccatgataccccagagaggagtgcagcagataacaaggacctgatcttagatccatgctgtcagcttccagcctacctgtctacctgccctggccagagcagcagcttggcagtaaccaaaacaaattctgacatccttccaccccagaagaaaaccaagccgagtcagaaggtccagggaagaggctcacacggatgccggcagcagagacaagcaaggcagaaggaaagcaccctgagaagacaggaaagaaagaatgcagcactggttaccaggatgaaagcccagaggccagaggaatgcttaaaacacatcattgtagtgctggatccagtgctcttacagatggaaggtgggggccagctcctaggagcactgcagaccatggagtgccgctgtgtgattgaggcgcaggctgtgccttgcagtgtcacttggaggagaagggctgggccgtctgaggacagagaggactgggtggaggagccaacagtactggtgttgctccgggcagaggcatttgtgtccatgatcgacaatggaaagcagggaagcctggacagcactatgaaagggaaggaaacgcttcagggctttgtaactgacatcacagcaaagacagcagggaaagctctgtcactggtgattgtggatcaggagaaatgcttcagcctggagctgctgttctttgatttcctcccctgcaccagtgctcagaatcctccaagaagagggaaacagggagcaaataaacagaccaagaagcagcagcagagacaaccagaggccagcatagggtccatggtatccagggtagacgctgaagaggcattggtggatctgcagctacacacagaagcccaggctcaaattgtgcagagctggaaagagctggccgacttcacatgcgcattcacaaaggctgtggctgaggcgcccttcaagaagctccgagatgaaactaccttctccttctgtctggagagtgactgggctggaggggtgaaggtggaccttgctggcaggggactcgcactagtctggaggagacagattcagcagctgaaccgagtcagcctggaaatggccagtgcagttgtgaatgcctatccctccccacagctcctggtacaggcttatcagcagtgtttttcggataaagaacgccagaatttgctcgcagacatacaggtgcgccgtggggaaggtgtgacatccacttctcgccgcattggaccagaactatccaggcgtatctaccttcagatgaccactttacagccacatctctctttagatagtgctgactgattctagccctcagggatgaggatgaaaagctggaaacttccacttccccaacctcagagcctgactgtaatgaagagactggcagcacctcctggaacacaagcctaggtgaggcccagtctttcttgggtcttattatttgtgaaggtctctctgcctgtcggctggggcagagactgaaatactgccacctacctttggcatttaatgttcctctcctggcaaaaattcactgccacagacaaaccacccccactcctacccagccagccctcaaaacacaaaggaacaaagacagtccactcagacacttatttaataactgtagaaatccaaaagaattagcatcaaatcttgaagtcgtgagtgaagctgcgggttggcttgactgggctcagccactgagctgcctcaaccggccaaggaacgggattatgatgactatgcggacttctatattgtcttcatctcattgtgtgtattatgtatttagtttcaataaagcatttgtaccaatggc

SEQ ID NO: 1495 - DNA, 2296 bp, Homo sapiens
ggaattatttgatagcacatactgatggctctaaagaagtcatcaccctcactggattctggtgatagtgactctgaggagttgccaacatttgcctttctgaagaaggaaccatcttcaacaaagaggagacagcctgaaagggaagagaagattgtagtggttgacatctcagattgtgaagcctcctgtcctccagcaccagagttattttcaccacctgtcccagaaatagctgaaactgtcacacaaacacagccagtcaggttgctaagcagtgaaagtgaagatgaagaagaatttattcctctggctcaaaggcttacatgtaagtttctgacccacaagcaactgagccctgaggactctagctccccagttaaaagtgttttggatcatcaaaataatgaaggtgcatcatgtgactggaaaaagccctttccaaagatccctgaagttcccctccatgataccccagagaggagtgcagcagataacaaggacctgatcttagatccatgctgtcagcttccagcctacctgtctacctgccctggccagagcagcagcttggcagtaaccaaaacaaattctgacatccttccaccccagaagaaaaccaagccgagtcagaaggtccagggaagaggctcacacggatgccggcagcagagacaagcaaggcagaaggaaagcaccctgagaagacaggaaagaaagaatgcagcactggttaccaggatgaaagcccagaggccagaggaatgcttaaaacacatcattgtagtgctggatccagtgctcttacagatggaaggtgggggccagctcctaggagcactgcagaccatggagtgccgctgtgtgattgaggcgcaggctgtgccttgcagtgtcacttggaggagaagggctgggccgtctgaggacagagaggactgggtggaggagccaacagtactggtgttgctccgggcagaggcatttgtgtccatgatcgacaatggaaagcagggaagcctggacagcactatgaaagggaaggaaacgcttcagggctttgtaactgacatcacagcaaagacagcagggaaagctctgtcactggtgattgtggatcaggagaaatgcttcagcctggagctgctgttctttgatttcctcccctgcaccagtgctcagaatcctccaagaagagggaaacagggagcaaataaacagaccaagaagcagcagcagagacaaccagaggccagcatagggtccatggtatccagggtagacgctgaagaggcattggtggatctgcagctacacacagaagcccaggctcaaattgtgcagagctggaaagagctggccgacttcacatgcgcattcacaaaggctgtggctgaggcgcccttcaagaagctccgagatgaaactaccttctccttctgtctggagagtgactgggctggaggggtgaaggtggaccttgctggcaggggactcgcactagtctggaggagacagattcagcagctgaaccgagtcagcctggaaatggccagtgcagttgtgaatgcctatccctccccacagctcctggtacaggcttatcagcagtgtttttcggataaagaacgccagaatttgctcgcagacatacaggtgcgccgtggggaaggtgtgacatccacttctcgccgcattggaccagaactatccaggcgtatctaccttcagatgaccactttacagccacatctctctttagatagtgctgactgattctagccctcagggatgaggatgaaaagctggaaacttccacttccccaacctcagagcctgactgtaatgaagagactggcagcacctcctggaacacaagcctaggtgaggcccagtctttcttgggtcttattatttgtgaaggtctctctgcctgtcggctggggcagagactgaaatactgccacctacctttggcatttaatgttcctctcctggcaaaaattcactgccacagacaaaccacccccactcctacccagccagccctcaaaacacaaaggaacaaagacagtccactcagacacttatttaataactgtagaaatccaaaagaattagcatcaaatcttgaagtcgtgagtgaagctgcgggttggcttgactgggctcagccactgagctgcctcaaccggccaaggaacgggattatgatgactatgcggacttctatattgtcttcatctcattgtgtgtattatgtatttagtttcaataaagcatttgtaccaatggc

SEQ ID NO: 1496 - DNA, 6455 bp, Homo sapiens
gagttgtgcctggagtgatgtttaagccaatgtcagggcaaggcaacagtccctggccgtcctccagcacctttgtaatgcatatgagctcgggagaccagtacttaaagttggaggcccgggagcccaggagctggcggagggcgttcgtcctgggactgcacttgctcccgtcgggtcgcccggcttcaccggacccgcaggctcccggggcagggccggggccagagctcgcgtgtcggcgggacatgcgctgcgtcgcctctaacctcgggctgtgctctttttccaggtggcccgccggtttctgagccttctgccctgcggggacacggtctgcaccctgcccgcggccacggaccatgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggccaaattcagataatcgacgccagggtggcagagaaagattggccagtaccaatgacaagggaagtatggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgtaaatgctacgaagtgggaatgatgaaaggtgggatacgaaaagaccgaagaggagggagaatgttgaaacacaagcgccagagagatgatggggagggcaggggtgaagtggggtctgctggagacatgagagctgccaacctttggccaagcccgctcatgatcaaacgctctaagaagaacagcctggccttgtccctgacggccgaccagatggtcagtgccttgttggatgctgagcccccgatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagggaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggagatgctggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacggtctgagagctccctggctcccacacggttcagataatccctgctgcattttaccctcatcatgcaccactttagccaaattctgtctcctgcatacactccggcatgcatccaacaccaatggctttctagatgagtggccattcatttgcttgctcagttcttagtggcacatcttctgtcttctgttgggaacagccaaagggattccaaggctaaatctttgtaacagctctctttcccccttgctatgttactaagcgtgaggattcccgtagctcttcacagctgaactcagtctatgggttggggctcagataactctgtgcatttaagctacttgtagagacccaggcctggagagtagacattttgcctctgataagcactttttaaatggctctaagaataagccacagcaaagaatttaaagtggctcctttaattggtgacttggagaaagctaggtcaagggtttattatagcaccctcttgtattcctatggcaatgcatccttttatgaaagtggtacaccttaaagcttttatatgactgtagcagagtatctggtgattgtcaattcattccccctataggaatacaaggggcacacagggaaggcagatcccctagttggcaagactattttaacttgatacactgcagattcagatgtgctgaaagctctgcctctggctttccggtcatgggttccagttaattcatgcctcccatggacctatggagagcagcaagttgatcttagttaagtctccctatatgagggataagttcctgatttttgtttttatttttgtgttacaaaagaaagccctccctccctgaacttgcagtaaggtcagcttcaggacctgttccagtgggcactgtacttggatcttcccggcgtgtgtgtgccttacacaggggtgaactgttcactgtggtgatgcatgatgagggtaaatggtagttgaaaggagcaggggccctggtgttgcatttagccctggggcatggagctgaacagtacttgtgcaggattgttgtggctactagagaacaagagggaaagtagggcagaaactggatacagttctgaggcacagccagacttgctcagggtggccctgccacaggctgcagctacctaggaacattccttgcagaccccgcattgccctttgggggtgccctgggatccctggggtagtccagctcttcttcatttcccagcgtggccctggttggaagaagcagctgtcacagctgctgtagacagctgtgttcctacaattggcccagcaccctggggcacgggagaagggtggggaccgttgctgtcactactcaggctgactggggcctggtcagattacgtatgcccttggtggtttagagataatccaaaatcagggtttggtttggggaagaaaatcctcccccttcctcccccgccccgttccctaccgcctccactcctgccagctcatttccttcaatttcctttgacctataggctaaaaaagaaaggctcattccagccacagggcagccttccctgggcctttgcttctctagcacaattatgggttacttcctttttcttaacaaaaaagaatgtttgatttcctctgggtgaccttattgtctgtaattgaaaccctattgagaggtgatgtctgtgttagccaatgacccaggtgagctgctcgggcttctcttggtatgtcttgtttggaaaagtggatttcattcatttctgattgtccagttaagtgatcaccaaaggactgagaatctgggagggcaaaaaaaaaaaaaaagtttttatgtgcacttaaatttggggacaattttatgtatctgtgttaaggatatgtttaagaacataattcttttgttgctgtttgtttaagaagcaccttagtttgtttaagaagcaccttatatagtataatatatatttttttgaaattacattgcttgtttatcagacaattgaatgtagtaattctgttctggatttaatttgactgggttaacatgcaaaaaccaaggaaaaatatttagtttttttttttttttttgtatacttttcaagctaccttgtcatgtatacagtcatttatgcctaaagcctggtgattattcatttaaatgaagatcacatttcatatcaacttttgtatccacagtagacaaaatagcactaatccagatgcctattgttggatactgaatgacagacaatcttatgtagcaaagattatgcctgaaaaggaaaattattcagggcagctaattttgcttttaccaaaatatcagtagtaatatttttggacagtagctaatgggtcagtgggttctttttaatgtttatacttagattttcttttaaaaaaattaaaataaaacaaaaaaaaatttctaggactagacgatgtaataccagctaaagccaaacaattatacagtggaaggttttacattattcatccaatgtgtttctattcatgttaagatactactacatttgaagtgggcagagaacatcagatgattgaaatgttcgcccaggggtctccagcaactttggaaatctctttgtatttttacttgaagtgccactaatggacagcagatattttctggctgatgttggtattgggtgtaggaacatgatttaaaaaaaaactcttgcctctgctttcccccactctgaggcaagttaaaatgtaaaagatgtgatttatctggggggctcaggtatggtggggaagtggattcaggaatctggggaatggcaaatatattaagaagagtattgaaagtatttggaggaaaatggttaattctgggtgtgcaccagggttcagtagagtccacttctgccctggagaccacaaatcaactagctccatttacagccatttctaaaatggcagcttcagttctagagaagaaagaacaacatcagcagtaaagtccatggaatagctagtggtctgtgtttcttttcgccattgcctagcttgccgtaatgattctataatgccatcatgcagcaattatgagaggctaggtcatccaaagagaagaccctatcaatgtaggttgcaaaatctaacccctaaggaagtgcagtctttgatttgatttccctagtaaccttgcagatatgtttaaccaagccatagcccatgccttttgagggctgaacaaataagggacttactgataatttacttttgatcacattaaggtgttctcaccttgaaatcttatacactgaaatggccattgatttaggccactggcttagagtactccttcccctgcatgacactgattacaaatactttcctattcatactttccaattatgagatggactgtgggtactgggagtgatcactaacaccatagtaatgtctaatattcacaggcagatctgcttggggaagctagttatgtgaaaggcaaatagagtcatacagtagctcaaaaggcaaccataattctctttggtgcaggtcttgggagcgtgatctagattacactgcaccattcccaagttaatcccctgaaaacttactctcaactggagcaaatgaactttggtcccaaatatccatcttttcagtagcgttaattatgctctgtttccaactgcatttcctttccaattgaattaaagtgtggcctcgtttttagtcatttaaaattgttttctaagtaattgctgcctctattatggcacttcaattttgcactgtcttttgagattcaagaaaaatttctattcttttttttgcatccaattgtgcctgaacttttaaaatatgtaaatgctgccatgttccaaacccatcgtcagtgtgtgtgtttagagctgtgcaccctagaaacaacatattgtcccatgagcaggtgcctgagacacagacccctttgcattcacagagaggtcattggttatagagacttgaattaataagtgacattatgccagtttctgttctctcacaggtgataaacaatgctttttgtgcactacatactcttcagtgtagagctcttgttttatgggaaaaggctcaaatgccaaattgtgtttgatggattaatatgcccttttgccgatgcatactattactgatgtgactcggttttgtcgcagctttgctttgtttaatgaaacacacttgtaaacctcttttgcactttgaaaaagaatccagcgggatgctcgagcacctgtaaacaattttctcaacctatttgatgttcaaataaagaattaaact

SEQ ID NO: 1497 - DNA, 3335 bp, Homo sapiens
ctagagcatgggtggccattgttgacctacaggaggcaccactgtcaccaacaaagggtaacagtctttcttttcaatatttatttatatccagtatttattttcaatactgactatggagagagctctcctgtgctcaaacactgcaatactgggggtctttcaaagcacaaaaacatatatttgcatgatggcatcattaacatttttatggctttctatttcttttttgtactggtctcaagagccactcataaatctctcagtaactgcatagtgtcccagggccagagaccggccactcctggcattgtgattagagtcatttaatatccaaggtggtgactaatgtctggcaacaaagcctccattgggtgtcatgtgtcctgggaccctgagcgtgggcactctaggagcacctcagtattgcgtgttagtactatggccgagagaatagttgagaaagtggtcaagaggtggatccatgtgaacgccactgggaaatgagagacctcgttcccaatcacggtcagtgcaactcgaaagcctaaaatcagtttaaaacaaaggtatctacctttatcttatgttcatatcctaggcttttaataatacgtatttttcacatgtttacagaaagcagtcaactgagctattcatggaaaggtttgtgggtttggttaacgaagtggaggagtattacatttcagctggaaacacatccctagaatgccaaaacatttattccaaagtctggtttcctggtgcaatcggaggcatggcaatgcctctgttcagagactgggggctagggccagtaaggcatttgatccacatgtatcccagaaggcttttattgttaaattatattctttcggaaaaaccacccatgtcctattttgtaaacttgatatccatacacttttgactggcattctattttagccgtaagactatgattcacagcaagcctgtttttcctcttgcttggggtggcagcagaaagcatagggtactttccagcctccaagggtaggggcaaaggggctggggtttctcctccccagtacagctttctctggctgtgccacactgctccctgtgagcagacagcaagtctcccctcactccccactgccattcatccagcgctgtgcagtagcccagctgcgtgtctgccgggaggggctgccaagtgccctgcctactggctgcttcccgaatccctgccattccacgcacaaacacatccacacactctctctgcctagttcacacactgagccactcgcacatgcgagcacattccttccttccttctcactctctcggcccttgacttctacaagcccatggaacatttctggaaagacgttcttgatccagcagggtggcccgccggtttctgagccttctgccctgcggggacacggtctgcaccctgcccgcggccacggaccatgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggccaaattcagataatcgacgccagggtggcagagaaagattggccagtaccaatgacaagggaagtatggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgtaaatgctacgaagtgggaatgatgaaaggtgggatacgaaaagaccgaagaggagggagaatgttgaaacacaagcgccagagagatgatggggagggcaggggtgaagtggggtctgctggagacatgagagctgccaacctttggccaagcccgctcatgatcaaacgctctaagaagaacagcctggccttgtccctgacggccgaccagatggtcagtgccttgttggatgctgagcccccgatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagggaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggagatgctggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacggtctgagagctccctggctcccacacggttcagataatccctgctgcattttaccctcatcatgcaccactttagccaaattctgtctcctgc

SEQ ID NO: 1498 - DNA, 2165 bp, Homo sapiens
gtcgcctctaacctcgggctgtgctctttttccaggtggcccgccggtttctgagccttctgccctgcggggacacggtctgcaccctgcccgcggccacggaccatgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggccaaattcagataatcgacgccagggtggcagagaaagattggccagtaccaatgacaagggaagtatggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgtaaatgctacgaagtgggaatgatgaaaggtgggatacgaaaagaccgaagaggagggagaatgttgaaacacaagctcctcctcatcctctcccacatcaggcacatgagtaacaaaggcatggagcatctgtacagcatgaagtgcaagaacgtggtgcccctctatgacctgctgctggagatgctggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacggtctgagagctccctggctcccacacggttcagataatccctgctgcattttaccctcatcatgcaccactttagccaaattctgtctcctgcatacactccggcatgcatccaacaccaatggctttctagatgagtggccattcatttgcttgctcagttcttagtggcacatcttctgtcttctgttgggaacagccaaagggattccaaggctaaatctttgtaacagctctctttcccccttgctatgttactaagcgtgaggattcccgtagctcttcacagctgaactcagtctatgggttggggctcagataactctgtgcatttaagctacttgtagagacccaggcctggagagtagacattttgcctctgataagcactttttaaatggctctaagaataagccacagcaaagaatttaaagtggctcctttaattggtgacttggagaaagctaggtcaagggtttattatagcaccctcttgtattcctatggcaatgcatccttttatgaaagtggtacaccttaaagcttttatatgactgtagcagagtatctggtgattgtcaattcattccccctataggaatacaaggggcacacagggaaggcagatcccctagttggcaagactattttaacttgatacactgcagattcagatgtgctgaaagctctgcctctggctttccggtcatgggttccagttaattcatgcctcccatggacctatggagagcagcaagttgatcttagttaagtctccctatatgagggataagttcctgatttttgtttttatttttgtgttacaaaagaaagccctccctccctgaacttgcagtaaggtcagcttcaggacctgttccagtgggcactgtacttggatcttcccggcgtgtgtgtgccttacacaggggtgaactgttcactgtggtgatgcatgatgagggtaaatggtagttgaaaggagcaggggcc

SEQ ID NO: 1499 - DNA, 624 bp, Homo sapiens
atggtcataacagcctcctgtctaccgactcagaacggattttaccaaaactgaaaatgcaggctccatgctcagaagctctttaacaggctcgaaaggtccatgctcctttctcctgcccattctatagcataagaagacagtctctgagtgataatcttctcttcaagaagaagaaaactaggaaggagtaagcacaaagatctcttcacattctccgggactgcggtaccaaatatcagcacagcacttcttgaaaaaggatgtagattttaatctgaactttgaaccatcactgaggtggcccgccggtttctgagccttctgccctgcggggacacggtctgcaccctgcccgcggccacggaccatgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctga

SEQ ID NO: 1500 - DNA, 1251 bp, Homo sapiens
aggagctggcggagggcgttcgtcctgggactgcacttgctcccgtcgggtcgcccggcttcaccggacccgcaggctcccggggcagggccggggccagagctcgcgtgtcggcgggacatgcgctgcgtcgcctctaacctcgggctgtgctctttttccaggtggcccgccggtttctgagccttctgccctgcggggacacggtctgcaccctgcccgcggccacggaccatgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggagatgctggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacggtctgagagctccctggc

SEQ ID NO: 1501 - DNA, 323 bp, Homo sapiens
cataacgactatatgtgtccagccaccaaccagtgcaccattgataaaaacaggaggaagagctgccaggcctgccggctccgtaaatgctacgaagtgggaatgatgaaaggtggctttgtggatttgaccctccatgatcaggtccaccttctagaatgtgcctggctagagatcctgatgattggtctcgtctggcgctccatggagcacccagggaagctactgtttgctcctaacttgctcttggacaggaaccagggaaaatgtgtagagggcatggtggagatcttcgacatgctgctggctacatcatctcggtt

SEQ ID NO: 1502 - DNA, 5437 bp, Homo sapiens
gcttaaaaataatctcctgccagcccagtgacaagcctgtcccacccggggagaatgccccggagtggcgtgcgggtcagccagggtctgcgcctcgcagccactgtggaaggagcgcggccggtccaggacacaggagaccactttgtgacttcaatggcgaagggccaaattcagataatcgacgccagggtggcagagaaagattggccagtaccaatgacaagggaagtatggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgtaaatgctacgaagtgggaatgatgaaaggtgggatacgaaaagaccgaagaggagggagaatgttgaaacacaagcgccagagagatgatggggagggcaggggtgaagtggggtctgctggagacatgagagctgccaacctttggccaagcccgctcatgatcaaacgctctaagaagaacagcctggccttgtccctgacggccgaccagatggtcagtgccttgttggatgctgagcccccgatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagggaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggtatctcacatgtagaagcaaagaagagaatcctgaacttgcatcctaaaatatttggaaacaagtggtttcctcgtgtctaaagcctctggtcataaggcctcacagtatcctgcagatcatcaaatccgtgtgtggacgtggggacattttgttttgaggcagttacatgaccatgggcaagtaaattagtctctctggccttcagttttctcatttgcaatgattcaatggtttgccttaaagtgtcttaagaaggataggatagctacccacaaactttggatcaaattttcttcaaaacatccttcccctgactttaaaatatgccctggcaaccaacactcaacacctgtagctagatgagttataacagagtgactgaagagagctcccacaattcctagttattaaatacctgactaattttcattaggagacatttaagaactttagtgatgggaagatttacatatataattgatagtacaatctgacagagctgaatagctcctgtttgtcaactgttaaattctttgtgcaattaggtcaaagatcaagatcaaaacaagggctgcccattgacctgttcactcctgagaaaaatggcaaaccattgaatcataaatcatgacagccaaaataattttaggatattaatgcacccctcatctttgcaaatgagaaaactgaaggccagagagactaatttacttgcccatttttgataaaaatgtcaccatttacagaatgtggactcctatgttggagtctgttgaaggacatggcacatttaacagcatcagagcattttttattaaaatttaatttgtgcatgacttctaatgctgaagaacgccaagctaggaagaagtcatgggctgagatggggacagagagaacacacaatattcagtgactgtccgtgcagctggctgcccttgaaaatatccgaactatccactgggaaaatgcctgtccccttggggtaattaccagagtttcaacatgcccaaagctgcctcatcttcagggggaacttgttctagcgattttagtatcaagaagctaatggtcccagggaaagggttatttttaatatttagctactgtgctaaaaatcacctaagtttctagagtcttgggaaatttcataagggaaagaacaaaggcaacttgttgactacccactggtcattctcctctggtcttattacatacatggatgccagtttagattgtgtttatataggaaaaattaaatgtgtgagcctccttaaggaacatcatcaatacagatatatcagatagttctgtccagcaaaaaacgtgcttatttgctacaagtaaatttttatttatttttctcacttccctcactccttcaaatttccaggtaaatagctgcccaggagttgcttcatctctgtcccaaaatacctagacaattgcgggataaggagaatggcagggagggagtagtggctaaaatcacacccttcaaaagaaagtgtgtaggacacacaattgtgagaagtctgaatgccatgcacatagggtatgactcactttgaaaattgtttataatcaaggaaatgaaaatgagttaatttcgtgcatgcatcatttaaagccaaatgagaagaaacttctaatttattttgttacttttcggctaacactggcagtatgtaacagatttattttgcagaaacatctagattgtccgtgatcttgatcctgcccttatgtgtcttgtctttgaaacccagtgtttcctggatatatggttcaggagacaagtttccagaatcaagttaggacccaggtcttctttttttccaaaccaaacattcttgctaatcctaaactacctgaggcagcctgtggtggcctcagctctaaaaccattgtttaaaggcttctacccatcaatggcccttcagcagagtggtacggttaacggggtagggtctggagtcaggggagacctgggttcaaatcctacatctttacacctctaatccccagtgtccttgtctataaattgggaatatagccatgtcatgggattcttgtgagggttaaatgaggtaaaacacatacaatgcttagcatgtatacaattaagcactaaataattgaaacacattaagtactaaatgaatgtcagcagcttatcactattatctgtataatgataccaagggtgtgccgactcatacccttaggggttggctggattcggccttttctctcgggaaaacatacctgatttattaatagtgctttcaagcatgtgataaatttctcaaactgcctgtcttgttccctagaaacaccaggaaggcctacctcaaatagcaacagagaaacctatcggagccttaccctacagctttccttggggcacgggtgagcaatctgccttagaggggagaggctctgtgctgaggctctttgaatgctttgaataaatagatccccagataatgaaaagacttcaaaacaaattctacaagaaactgagtagtgtttatagtgaggccctagtgtacatgcaaaaaacccccactgcccttgcttaaatgtatctgattaacttgaatacatttttaaatgagggcttttttccctctttcagtgtttcggccagtcatttgccacttctcattccatcttagttctctgtaaagaaggtgccagagacctaaggtgcccaaggcaattttgcattttacaattctaagctttagaatgaagtcatcaatttgctacatccggactacagtgcaattattcctttgccttgctggaaattggagtgaaatctttctagctgtcaatttcaactcagttgcagtagtgttttgaagaattaatggcgataaggttagaaaattttaagtcaaacgtagggaaaaagtaccagctagaccatcataagcatttgctttgaaagcatgcttctaaagtgtgtttaacctcaaataacagtcacaaatatggttattatgaatgtatgcacagatttttatgtttctaattttaagaagttctagggagctccctgtaacgatttagggaatctctagattctgatatactgcaagtcttttaatggtaggaatcacattgaattaattttgtaggcccagggcctaaatttagtaggtgttcagtacctattggcatcaattcatatgtaggtttaaaatactgtatgaagatacagaatcaccaccatcaaatcaaattgaaatatgtaacaggctagtataatattaacatctgactttaaacaacaacaaagaaaccaaatgagtaactcctcccttcaaactaatagtcagtttcttccaactcagtctctttctcctctcaggaagaatgcgtatctaaaaatttcccattgcagactgctggaaacaacattctaaactatttatgcttctgcaataacctttccaatttgctggaccagtgcaagattaaacacgagatatctcaagtctcaatgtaaaggaacaccacgacagcctggactgtgggtgaagttcattcttccccagcagactctgcctttcattctcggggttgggtgtgccccaaacagaggtaccgacggtaacgaagcccaagaatgttcaaccacaacctgtctgtgaaggtgttggatgacgtttgccattcaggtgaagattatttatgttccagtcccacctgagtagcaaagtgaacactgtgctgaatgctcagaaagatgttaatgaaccgtgctggacagagcagagctgaaaggcgccttgcgagtgtcgtagtgagaatgtggctgtcccagctgcaaagccctgttaggaggcatgaggaagcacttgctgccctaagaaacgatgccttcgacattttcaaaagatctatgtggctgtctgaaacaatgcggagagcagatagacgcaatatttgggaaccaaagagtgactgctgttggcgttgcatcataacataagcgctttcccccttctcgtcactatcatttgtatcaaccaaagaactgatctctggtatcctcgaaggaatgctgtggggatattcttcatctctgttcatggtacatcagcaatttgtggggaaaagatggactatataacacaatgatctgcctaaaagaaactgtctctacttatagggggctgagcaaaccttagagcatctgcggatgctcgtcattatcttcaaaagtccccaagagtttttctccatactttattattgctattttgtttaggctagaaaaaaaaaaactcataaaattgtcttcaaaccaaaccaaaggaaatgaaaagaaaaaaaa

SEQ ID NO: 1503 - DNA, 5996 bp, Homo sapiens
aaacacatccacacactctctctgcctagttcacacactgagccactcgcacatgcgagcacattccttccttccttctcactctctcggcccttgacttctacaagcccatggaacatttctggaaagacgttcttgatccagcagggtggcccgccggtttctgagccttctgccctgcggggacacggtctgcaccctgcccgcggccacggaccatgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggccaaattcagataatcgacgccagggtggcagagaaagattggccagtaccaatgacaagggaagtatggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgtaaatgctacgaagtgggaatgatgaaaggtgggatacgaaaagaccgaagaggagggagaatgttgaaacacaagcgccagagagatgatggggagggcaggggtgaagtggggtctgctggagacatgagagctgccaacctttggccaagcccgctcatgatcaaacgctctaagaagaacagcctggccttgtccctgacggccgaccagatggtcagtgccttgttggatgctgagcccccgatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagggaagctactgtttgctcctaacttgctcttggacagtaacaaaggcatggagcatctgtacagcatgaagtgcaagaacgtggtgcccctctatgacctgctgctggagatgctggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacggtctgagagctccctggctcccacacggttcagataatccctgctgcattttaccctcatcatgcaccactttagccaaattctgtctcctgcatacactccggcatgcatccaacaccaatggctttctagatgagtggccattcatttgcttgctcagttcttagtggcacatcttctgtcttctgttgggaacagccaaagggattccaaggctaaatctttgtaacagctctctttcccccttgctatgttactaagcgtgaggattcccgtagctcttcacagctgaactcagtctatgggttggggctcagataactctgtgcatttaagctacttgtagagacccaggcctggagagtagacattttgcctctgataagcactttttaaatggctctaagaataagccacagcaaagaatttaaagtggctcctttaattggtgacttggagaaagctaggtcaagggtttattatagcaccctcttgtattcctatggcaatgcatccttttatgaaagtggtacaccttaaagcttttatatgactgtagcagagtatctggtgattgtcaattcattccccctataggaatacaaggggcacacagggaaggcagatcccctagttggcaagactattttaacttgatacactgcagattcagatgtgctgaaagctctgcctctggctttccggtcatgggttccagttaattcatgcctcccatggacctatggagagcagcaagttgatcttagttaagtctccctatatgagggataagttcctgatttttgtttttatttttgtgttacaaaagaaagccctccctccctgaacttgcagtaaggtcagcttcaggacctgttccagtgggcactgtacttggatcttcccggcgtgtgtgtgccttacacaggggtgaactgttcactgtggtgatgcatgatgagggtaaatggtagttgaaaggagcaggggccctggtgttgcatttagccctggggcatggagctgaacagtacttgtgcaggattgttgtggctactagagaacaagagggaaagtagggcagaaactggatacagttctgaggcacagccagacttgctcagggtggccctgccacaggctgcagctacctaggaacattccttgcagaccccgcattgccctttgggggtgccctgggatccctggggtagtccagctcttcttcatttcccagcgtggccctggttggaagaagcagctgtcacagctgctgtagacagctgtgttcctacaattggcccagcaccctggggcacgggagaagggtggggaccgttgctgtcactactcaggctgactggggcctggtcagattacgtatgcccttggtggtttagagataatccaaaatcagggtttggtttggggaagaaaatcctcccccttcctcccccgccccgttccctaccgcctccactcctgccagctcatttccttcaatttcctttgacctataggctaaaaaagaaaggctcattccagccacagggcagccttccctgggcctttgcttctctagcacaattatgggttacttcctttttcttaacaaaaaagaatgtttgatttcctctgggtgaccttattgtctgtaattgaaaccctattgagaggtgatgtctgtgttagccaatgacccaggtgagctgctcgggcttctcttggtatgtcttgtttggaaaagtggatttcattcatttctgattgtccagttaagtgatcaccaaaggactgagaatctgggagggcaaaaaaaaaaaaaaagtttttatgtgcacttaaatttggggacaattttatgtatctgtgttaaggatatgtttaagaacataattcttttgttgctgtttgtttaagaagcaccttagtttgtttaagaagcaccttatatagtataatatatatttttttgaaattacattgcttgtttatcagacaattgaatgtagtaattctgttctggatttaatttgactgggttaacatgcaaaaaccaaggaaaaatatttagtttttttttttttttttgtatacttttcaagctaccttgtcatgtatacagtcatttatgcctaaagcctggtgattattcatttaaatgaagatcacatttcatatcaacttttgtatccacagtagacaaaatagcactaatccagatgcctattgttggatactgaatgacagacaatcttatgtagcaaagattatgcctgaaaaggaaaattattcagggcagctaattttgcttttaccaaaatatcagtagtaatatttttggacagtagctaatgggtcagtgggttctttttaatgtttatacttagattttcttttaaaaaaattaaaataaaacaaaaaaaaatttctaggactagacgatgtaataccagctaaagccaaacaattatacagtggaaggttttacattattcatccaatgtgtttctattcatgttaagatactactacatttgaagtgggcagagaacatcagatgattgaaatgttcgcccaggggtctccagcaactttggaaatctctttgtatttttacttgaagtgccactaatggacagcagatattttctggctgatgttggtattgggtgtaggaacatgatttaaaaaaaaactcttgcctctgctttcccccactctgaggcaagttaaaatgtaaaagatgtgatttatctggggggctcaggtatggtggggaagtggattcaggaatctggggaatggcaaatatattaagaagagtattgaaagtatttggaggaaaatggttaattctgggtgtgcaccagggttcagtagagtccacttctgccctggagaccacaaatcaactagctccatttacagccatttctaaaatggcagcttcagttctagagaagaaagaacaacatcagcagtaaagtccatggaatagctagtggtctgtgtttcttttcgccattgcctagcttgccgtaatgattctataatgccatcatgcagcaattatgagaggctaggtcatccaaagagaagaccctatcaatgtaggttgcaaaatctaacccctaaggaagtgcagtctttgatttgatttccctagtaaccttgcagatatgtttaaccaagccatagcccatgccttttgagggctgaacaaataagggacttactgataatttacttttgatcacattaaggtgttctcaccttgaaatcttatacactgaaatggccattgatttaggccactggcttagagtactccttcccctgcatgacactgattacaaatactttcctattcatactttccaattatgagatggactgtgggtactgggagtgatcactaacaccatagtaatgtctaatattcacaggcagatctgcttggggaagctagttatgtgaaaggcaaatagagtcatacagtagctcaaaaggcaaccataattctctttggtgcaggtcttgggagcgtgatctagattacactgcaccattcccaagttaatcccctgaaaacttactctcaactggagcaaatgaactttggtcccaaatatccatcttttcagtagcgttaattatgctctgtttccaactgcatttcctttccaattgaattaaagtgtggcctcgtttttagtcatttaaaattgttttctaagtaattgctgcctctattatggcacttcaattttgcactgtcttttgagattcaagaaaaatttctattcttttttttgcatccaattgtgcctgaacttttaaaatatgtaaatgctgccatgttccaaacccatcgtcagtgtgtgtgtttagagctgtgcaccctagaaacaacatattgtcccatgagcaggtgcctgagacacagacccctttgcattcacagagaggtcattggttatagagacttgaattaataagtgacattatgccagtttctgttctctcacaggtgataaacaatgctttttgtgcactacatactcttcagtgtagagctcttgttttatgggaaaaggctcaaatgccaaattgtgtttgatggattaatatgcccttttgccgatgcatactattactgatgtgactcggttttgtcgcagctttgctttgtttaatgaaacacacttgtaaacctcttttgcactttgaaaaagaatccagcgggatgctcgagcacctgtaaacaattttctcaacctatttgatgttcaaataaagaattaaactaaa

SEQ ID NO: 1504 - DNA, 5880 bp, Homo sapiens
atgaccatgaccctccacaccaaagcatctgggatggccctactgcatcagatccaagggaacgagctggagccccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggccaaattcagataatcgacgccagggtggcagagaaagattggccagtaccaatgacaagggaagtatggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgtaaatgctacgaagtgggaatgatgaaaggtgggatacgaaaagaccgaagaggagggagaatgttgaaacacaagcgccagagagatgatggggagggcaggggtgaagtggggtctgctggagacatgagagctgccaacctttggccaagcccgctcatgatcaaacgctctaagaagaacagcctggccttgtccctgacggccgaccagatggtcagtgccttgttggatgctgagcccccgatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagggaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggagatgctggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacggtctgagagctccctggctcccacacggttcagataatccctgctgcattttaccctcatcatgcaccactttagccaaattctgtctcctgcatacactccggcatgcatccaacaccaatggctttctagatgagtggccattcatttgcttgctcagttcttagtggcacatcttctgtcttctgttgggaacagccaaagggattccaaggctaaatctttgtaacagctctctttcccccttgctatgttactaagcgtgaggattcccgtagctcttcacagctgaactcagtctatgggttggggctcagataactctgtgcatttaagctacttgtagagacccaggcctggagagtagacattttgcctctgataagcactttttaaatggctctaagaataagccacagcaaagaatttaaagtggctcctttaattggtgacttggagaaagctaggtcaagggtttattatagcaccctcttgtattcctatggcaatgcatccttttatgaaagtggtacaccttaaagcttttatatgactgtagcagagtatctggtgattgtcaattcattccccctataggaatacaaggggcacacagggaaggcagatcccctagttggcaagactattttaacttgatacactgcagattcagatgtgctgaaagctctgcctctggctttccggtcatgggttccagttaattcatgcctcccatggacctatggagagcagcaagttgatcttagttaagtctccctatatgagggataagttcctgatttttgtttttatttttgtgttacaaaagaaagccctccctccctgaacttgcagtaaggtcagcttcaggacctgttccagtgggcactgtacttggatcttcccggcgtgtgtgtgccttacacaggggtgaactgttcactgtggtgatgcatgatgagggtaaatggtagttgaaaggagcaggggccctggtgttgcatttagccctggggcatggagctgaacagtacttgtgcaggattgttgtggctactagagaacaagagggaaagtagggcagaaactggatacagttctgaggcacagccagacttgctcagggtggccctgccacaggctgcagctacctaggaacattccttgcagaccccgcattgccctttgggggtgccctgggatccctggggtagtccagctcttcttcatttcccagcgtggccctggttggaagaagcagctgtcacagctgctgtagacagctgtgttcctacaattggcccagcaccctggggcacgggagaagggtggggaccgttgctgtcactactcaggctgactggggcctggtcagattacgtatgcccttggtggtttagagataatccaaaatcagggtttggtttggggaagaaaatcctcccccttcctcccccgccccgttccctaccgcctccactcctgccagctcatttccttcaatttcctttgacctataggctaaaaaagaaaggctcattccagccacagggcagccttccctgggcctttgcttctctagcacaattatgggttacttcctttttcttaacaaaaaagaatgtttgatttcctctgggtgaccttattgtctgtaattgaaaccctattgagaggtgatgtctgtgttagccaatgacccaggtgagctgctcgggcttctcttggtatgtcttgtttggaaaagtggatttcattcatttctgattgtccagttaagtgatcaccaaaggactgagaatctgggagggcaaaaaaaaaaaaaaagtttttatgtgcacttaaatttggggacaattttatgtatctgtgttaaggatatgtttaagaacataattcttttgttgctgtttgtttaagaagcaccttagtttgtttaagaagcaccttatatagtataatatatatttttttgaaattacattgcttgtttatcagacaattgaatgtagtaattctgttctggatttaatttgactgggttaacatgcaaaaaccaaggaaaaatatttagtttttttttttttttttgtatacttttcaagctaccttgtcatgtatacagtcatttatgcctaaagcctggtgattattcatttaaatgaagatcacatttcatatcaacttttgtatccacagtagacaaaatagcactaatccagatgcctattgttggatactgaatgacagacaatcttatgtagcaaagattatgcctgaaaaggaaaattattcagggcagctaattttgcttttaccaaaatatcagtagtaatatttttggacagtagctaatgggtcagtgggttctttttaatgtttatacttagattttcttttaaaaaaattaaaataaaacaaaaaaaaatttctaggactagacgatgtaataccagctaaagccaaacaattatacagtggaaggttttacattattcatccaatgtgtttctattcatgttaagatactactacatttgaagtgggcagagaacatcagatgattgaaatgttcgcccaggggtctccagcaactttggaaatctctttgtatttttacttgaagtgccactaatggacagcagatattttctggctgatgttggtattgggtgtaggaacatgatttaaaaaaaaactcttgcctctgctttcccccactctgaggcaagttaaaatgtaaaagatgtgatttatctggggggctcaggtatggtggggaagtggattcaggaatctggggaatggcaaatatattaagaagagtattgaaagtatttggaggaaaatggttaattctgggtgtgcaccagggttcagtagagtccacttctgccctggagaccacaaatcaactagctccatttacagccatttctaaaatggcagcttcagttctagagaagaaagaacaacatcagcagtaaagtccatggaatagctagtggtctgtgtttcttttcgccattgcctagcttgccgtaatgattctataatgccatcatgcagcaattatgagaggctaggtcatccaaagagaagaccctatcaatgtaggttgcaaaatctaacccctaaggaagtgcagtctttgatttgatttccctagtaaccttgcagatatgtttaaccaagccatagcccatgccttttgagggctgaacaaataagggacttactgataatttacttttgatcacattaaggtgttctcaccttgaaatcttatacactgaaatggccattgatttaggccactggcttagagtactccttcccctgcatgacactgattacaaatactttcctattcatactttccaattatgagatggactgtgggtactgggagtgatcactaacaccatagtaatgtctaatattcacaggcagatctgcttggggaagctagttatgtgaaaggcaaatagagtcatacagtagctcaaaaggcaaccataattctctttggtgcaggtcttgggagcgtgatctagattacactgcaccattcccaagttaatcccctgaaaacttactctcaactggagcaaatgaactttggtcccaaatatccatcttttcagtagcgttaattatgctctgtttccaactgcatttcctttccaattgaattaaagtgtggcctcgtttttagtcatttaaaattgttttctaagtaattgctgcctctattatggcacttcaattttgcactgtcttttgagattcaagaaaaatttctattcttttttttgcatccaattgtgcctgaacttttaaaatatgtaaatgctgccatgttccaaacccatcgtcagtgtgtgtgtttagagctgtgcaccctagaaacaacatattgtcccatgagcaggtgcctgagacacagacccctttgcattcacagagaggtcattggttatagagacttgaattaataagtgacattatgccagtttctgttctctcacaggtgataaacaatgctttttgtgcactacatactcttcagtgtagagctcttgttttatgggaaaaggctcaaatgccaaattgtgtttgatggattaatatgcccttttgccgatgcatactattactgatgtgactcggttttgtcgcagctttgctttgtttaatgaaacacacttgtaaacctcttttgcactttgaaaaagaatccagcgggatgctcgagcacctgtaaacaattttctcaacctatttgatgttcaaataaagaattaaactaaa

SEQ ID NO: 1505 - DNA, 6466 bp, Homo sapiens
atggtcataacagcctcctgtctaccgactcagaacggattttaccaaaactgaaaatgcaggctccatgctcagaagctctttaacaggctcgaaaggtccatgctcctttctcctgcccattctatagcataagaagacagtctctgagtgataatcttctcttcaagaagaagaaaactaggaaggagtaagcacaaagatctcttcacattctccgggactgcggtaccaaatatcagcacagcacttcttgaaaaaggatgtagattttaatctgaactttgaaccatcactgaggtggcccgccggtttctgagccttctgccctgcggggacacggtctgcaccctgcccgcggccacggaccatgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggccaaattcagataatcgacgccagggtggcagagaaagattggccagtaccaatgacaagggaagtatggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgtaaatgctacgaagtgggaatgatgaaaggtgggatacgaaaagaccgaagaggagggagaatgttgaaacacaagcgccagagagatgatggggagggcaggggtgaagtggggtctgctggagacatgagagctgccaacctttggccaagcccgctcatgatcaaacgctctaagaagaacagcctggccttgtccctgacggccgaccagatggtcagtgccttgttggatgctgagcccccgatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagggaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggagatgctggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacggtctgagagctccctggctcccacacggttcagataatccctgctgcattttaccctcatcatgcaccactttagccaaattctgtctcctgcatacactccggcatgcatccaacaccaatggctttctagatgagtggccattcatttgcttgctcagttcttagtggcacatcttctgtcttctgttgggaacagccaaagggattccaaggctaaatctttgtaacagctctctttcccccttgctatgttactaagcgtgaggattcccgtagctcttcacagctgaactcagtctatgggttggggctcagataactctgtgcatttaagctacttgtagagacccaggcctggagagtagacattttgcctctgataagcactttttaaatggctctaagaataagccacagcaaagaatttaaagtggctcctttaattggtgacttggagaaagctaggtcaagggtttattatagcaccctcttgtattcctatggcaatgcatccttttatgaaagtggtacaccttaaagcttttatatgactgtagcagagtatctggtgattgtcaattcattccccctataggaatacaaggggcacacagggaaggcagatcccctagttggcaagactattttaacttgatacactgcagattcagatgtgctgaaagctctgcctctggctttccggtcatgggttccagttaattcatgcctcccatggacctatggagagcagcaagttgatcttagttaagtctccctatatgagggataagttcctgatttttgtttttatttttgtgttacaaaagaaagccctccctccctgaacttgcagtaaggtcagcttcaggacctgttccagtgggcactgtacttggatcttcccggcgtgtgtgtgccttacacaggggtgaactgttcactgtggtgatgcatgatgagggtaaatggtagttgaaaggagcaggggccctggtgttgcatttagccctggggcatggagctgaacagtacttgtgcaggattgttgtggctactagagaacaagagggaaagtagggcagaaactggatacagttctgaggcacagccagacttgctcagggtggccctgccacaggctgcagctacctaggaacattccttgcagaccccgcattgccctttgggggtgccctgggatccctggggtagtccagctcttcttcatttcccagcgtggccctggttggaagaagcagctgtcacagctgctgtagacagctgtgttcctacaattggcccagcaccctggggcacgggagaagggtggggaccgttgctgtcactactcaggctgactggggcctggtcagattacgtatgcccttggtggtttagagataatccaaaatcagggtttggtttggggaagaaaatcctcccccttcctcccccgccccgttccctaccgcctccactcctgccagctcatttccttcaatttcctttgacctataggctaaaaaagaaaggctcattccagccacagggcagccttccctgggcctttgcttctctagcacaattatgggttacttcctttttcttaacaaaaaagaatgtttgatttcctctgggtgaccttattgtctgtaattgaaaccctattgagaggtgatgtctgtgttagccaatgacccaggtgagctgctcgggcttctcttggtatgtcttgtttggaaaagtggatttcattcatttctgattgtccagttaagtgatcaccaaaggactgagaatctgggagggcaaaaaaaaaaaaaaagtttttatgtgcacttaaatttggggacaattttatgtatctgtgttaaggatatgtttaagaacataattcttttgttgctgtttgtttaagaagcaccttagtttgtttaagaagcaccttatatagtataatatatatttttttgaaattacattgcttgtttatcagacaattgaatgtagtaattctgttctggatttaatttgactgggttaacatgcaaaaaccaaggaaaaatatttagtttttttttttttttttgtatacttttcaagctaccttgtcatgtatacagtcatttatgcctaaagcctggtgattattcatttaaatgaagatcacatttcatatcaacttttgtatccacagtagacaaaatagcactaatccagatgcctattgttggatactgaatgacagacaatcttatgtagcaaagattatgcctgaaaaggaaaattattcagggcagctaattttgcttttaccaaaatatcagtagtaatatttttggacagtagctaatgggtcagtgggttctttttaatgtttatacttagattttcttttaaaaaaattaaaataaaacaaaaaaaaatttctaggactagacgatgtaataccagctaaagccaaacaattatacagtggaaggttttacattattcatccaatgtgtttctattcatgttaagatactactacatttgaagtgggcagagaacatcagatgattgaaatgttcgcccaggggtctccagcaactttggaaatctctttgtatttttacttgaagtgccactaatggacagcagatattttctggctgatgttggtattgggtgtaggaacatgatttaaaaaaaaactcttgcctctgctttcccccactctgaggcaagttaaaatgtaaaagatgtgatttatctggggggctcaggtatggtggggaagtggattcaggaatctggggaatggcaaatatattaagaagagtattgaaagtatttggaggaaaatggttaattctgggtgtgcaccagggttcagtagagtccacttctgccctggagaccacaaatcaactagctccatttacagccatttctaaaatggcagcttcagttctagagaagaaagaacaacatcagcagtaaagtccatggaatagctagtggtctgtgtttcttttcgccattgcctagcttgccgtaatgattctataatgccatcatgcagcaattatgagaggctaggtcatccaaagagaagaccctatcaatgtaggttgcaaaatctaacccctaaggaagtgcagtctttgatttgatttccctagtaaccttgcagatatgtttaaccaagccatagcccatgccttttgagggctgaacaaataagggacttactgataatttacttttgatcacattaaggtgttctcaccttgaaatcttatacactgaaatggccattgatttaggccactggcttagagtactccttcccctgcatgacactgattacaaatactttcctattcatactttccaattatgagatggactgtgggtactgggagtgatcactaacaccatagtaatgtctaatattcacaggcagatctgcttggggaagctagttatgtgaaaggcaaatagagtcatacagtagctcaaaaggcaaccataattctctttggtgcaggtcttgggagcgtgatctagattacactgcaccattcccaagttaatcccctgaaaacttactctcaactggagcaaatgaactttggtcccaaatatccatcttttcagtagcgttaattatgctctgtttccaactgcatttcctttccaattgaattaaagtgtggcctcgtttttagtcatttaaaattgttttctaagtaattgctgcctctattatggcacttcaattttgcactgtcttttgagattcaagaaaaatttctattcttttttttgcatccaattgtgcctgaacttttaaaatatgtaaatgctgccatgttccaaacccatcgtcagtgtgtgtgtttagagctgtgcaccctagaaacaacatattgtcccatgagcaggtgcctgagacacagacccctttgcattcacagagaggtcattggttatagagacttgaattaataagtgacattatgccagtttctgttctctcacaggtgataaacaatgctttttgtgcactacatactcttcagtgtagagctcttgttttatgggaaaaggctcaaatgccaaattgtgtttgatggattaatatgcccttttgccgatgcatactattactgatgtgactcggttttgtcgcagctttgctttgtttaatgaaacacacttgtaaacctcttttgcactttgaaaaagaatccagcgggatgctcgagcacctgtaaacaattttctcaacctatttgatgttcaaataaagaattaaactaaa

SEQ ID NO: 1506 - DNA, 6357 bp, Homo sapiens
gacaaacagagatatatcggagtctggcacggggcacataaggcagcacattagagaaagccggcccctggatccgtctttcgcgtttattttaagcccagtcttccctgggccacctttagcagatcctcgtgcgcccccgccccctggccgtgaaactcagcctctatccagcagcgacgacaagtaaagtggcccgccggtttctgagccttctgccctgcggggacacggtctgcaccctgcccgcggccacggaccatgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggccaaattcagataatcgacgccagggtggcagagaaagattggccagtaccaatgacaagggaagtatggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgtaaatgctacgaagtgggaatgatgaaaggtgggatacgaaaagaccgaagaggagggagaatgttgaaacacaagcgccagagagatgatggggagggcaggggtgaagtggggtctgctggagacatgagagctgccaacctttggccaagcccgctcatgatcaaacgctctaagaagaacagcctggccttgtccctgacggccgaccagatggtcagtgccttgttggatgctgagcccccgatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagggaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggagatgctggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacggtctgagagctccctggctcccacacggttcagataatccctgctgcattttaccctcatcatgcaccactttagccaaattctgtctcctgcatacactccggcatgcatccaacaccaatggctttctagatgagtggccattcatttgcttgctcagttcttagtggcacatcttctgtcttctgttgggaacagccaaagggattccaaggctaaatctttgtaacagctctctttcccccttgctatgttactaagcgtgaggattcccgtagctcttcacagctgaactcagtctatgggttggggctcagataactctgtgcatttaagctacttgtagagacccaggcctggagagtagacattttgcctctgataagcactttttaaatggctctaagaataagccacagcaaagaatttaaagtggctcctttaattggtgacttggagaaagctaggtcaagggtttattatagcaccctcttgtattcctatggcaatgcatccttttatgaaagtggtacaccttaaagcttttatatgactgtagcagagtatctggtgattgtcaattcattccccctataggaatacaaggggcacacagggaaggcagatcccctagttggcaagactattttaacttgatacactgcagattcagatgtgctgaaagctctgcctctggctttccggtcatgggttccagttaattcatgcctcccatggacctatggagagcagcaagttgatcttagttaagtctccctatatgagggataagttcctgatttttgtttttatttttgtgttacaaaagaaagccctccctccctgaacttgcagtaaggtcagcttcaggacctgttccagtgggcactgtacttggatcttcccggcgtgtgtgtgccttacacaggggtgaactgttcactgtggtgatgcatgatgagggtaaatggtagttgaaaggagcaggggccctggtgttgcatttagccctggggcatggagctgaacagtacttgtgcaggattgttgtggctactagagaacaagagggaaagtagggcagaaactggatacagttctgaggcacagccagacttgctcagggtggccctgccacaggctgcagctacctaggaacattccttgcagaccccgcattgccctttgggggtgccctgggatccctggggtagtccagctcttcttcatttcccagcgtggccctggttggaagaagcagctgtcacagctgctgtagacagctgtgttcctacaattggcccagcaccctggggcacgggagaagggtggggaccgttgctgtcactactcaggctgactggggcctggtcagattacgtatgcccttggtggtttagagataatccaaaatcagggtttggtttggggaagaaaatcctcccccttcctcccccgccccgttccctaccgcctccactcctgccagctcatttccttcaatttcctttgacctataggctaaaaaagaaaggctcattccagccacagggcagccttccctgggcctttgcttctctagcacaattatgggttacttcctttttcttaacaaaaaagaatgtttgatttcctctgggtgaccttattgtctgtaattgaaaccctattgagaggtgatgtctgtgttagccaatgacccaggtgagctgctcgggcttctcttggtatgtcttgtttggaaaagtggatttcattcatttctgattgtccagttaagtgatcaccaaaggactgagaatctgggagggcaaaaaaaaaaaaaaagtttttatgtgcacttaaatttggggacaattttatgtatctgtgttaaggatatgtttaagaacataattcttttgttgctgtttgtttaagaagcaccttagtttgtttaagaagcaccttatatagtataatatatatttttttgaaattacattgcttgtttatcagacaattgaatgtagtaattctgttctggatttaatttgactgggttaacatgcaaaaaccaaggaaaaatatttagtttttttttttttttttgtatacttttcaagctaccttgtcatgtatacagtcatttatgcctaaagcctggtgattattcatttaaatgaagatcacatttcatatcaacttttgtatccacagtagacaaaatagcactaatccagatgcctattgttggatactgaatgacagacaatcttatgtagcaaagattatgcctgaaaaggaaaattattcagggcagctaattttgcttttaccaaaatatcagtagtaatatttttggacagtagctaatgggtcagtgggttctttttaatgtttatacttagattttcttttaaaaaaattaaaataaaacaaaaaaaaatttctaggactagacgatgtaataccagctaaagccaaacaattatacagtggaaggttttacattattcatccaatgtgtttctattcatgttaagatactactacatttgaagtgggcagagaacatcagatgattgaaatgttcgcccaggggtctccagcaactttggaaatctctttgtatttttacttgaagtgccactaatggacagcagatattttctggctgatgttggtattgggtgtaggaacatgatttaaaaaaaaactcttgcctctgctttcccccactctgaggcaagttaaaatgtaaaagatgtgatttatctggggggctcaggtatggtggggaagtggattcaggaatctggggaatggcaaatatattaagaagagtattgaaagtatttggaggaaaatggttaattctgggtgtgcaccagggttcagtagagtccacttctgccctggagaccacaaatcaactagctccatttacagccatttctaaaatggcagcttcagttctagagaagaaagaacaacatcagcagtaaagtccatggaatagctagtggtctgtgtttcttttcgccattgcctagcttgccgtaatgattctataatgccatcatgcagcaattatgagaggctaggtcatccaaagagaagaccctatcaatgtaggttgcaaaatctaacccctaaggaagtgcagtctttgatttgatttccctagtaaccttgcagatatgtttaaccaagccatagcccatgccttttgagggctgaacaaataagggacttactgataatttacttttgatcacattaaggtgttctcaccttgaaatcttatacactgaaatggccattgatttaggccactggcttagagtactccttcccctgcatgacactgattacaaatactttcctattcatactttccaattatgagatggactgtgggtactgggagtgatcactaacaccatagtaatgtctaatattcacaggcagatctgcttggggaagctagttatgtgaaaggcaaatagagtcatacagtagctcaaaaggcaaccataattctctttggtgcaggtcttgggagcgtgatctagattacactgcaccattcccaagttaatcccctgaaaacttactctcaactggagcaaatgaactttggtcccaaatatccatcttttcagtagcgttaattatgctctgtttccaactgcatttcctttccaattgaattaaagtgtggcctcgtttttagtcatttaaaattgttttctaagtaattgctgcctctattatggcacttcaattttgcactgtcttttgagattcaagaaaaatttctattcttttttttgcatccaattgtgcctgaacttttaaaatatgtaaatgctgccatgttccaaacccatcgtcagtgtgtgtgtttagagctgtgcaccctagaaacaacatattgtcccatgagcaggtgcctgagacacagacccctttgcattcacagagaggtcattggttatagagacttgaattaataagtgacattatgccagtttctgttctctcacaggtgataaacaatgctttttgtgcactacatactcttcagtgtagagctcttgttttatgggaaaaggctcaaatgccaaattgtgtttgatggattaatatgcccttttgccgatgcatactattactgatgtgactcggttttgtcgcagctttgctttgtttaatgaaacacacttgtaaacctcttttgcactttgaaaaagaatccagcgggatgctcgagcacctgtaaacaattttctcaacctatttgatgttcaaataaagaattaaactaaa

SEQ ID NO: 1507 - DNA, 731 bp, Homo sapiens
atgcaaccgcacaccccattctatctgccctatctcggttacagtgtagtcctccccagggtcatcctatgtacacactacgtatttctagccaacgaggagggggaatcaaacagaaagagagacaaacagagatatatcggagtctggcacggggcacataaggcagcacattagagaaagccggcccctggatccgtctttcgcgtttattttaagcccagtcttccctgggccacctttagcagatcctcgtgcgcccccgccccctggccgtgaaactcagcctctatccagcagcgacgacaagtaaagtggcccgccggtttctgagccttctgccctgcggggacacggtctgcaccctgcccgcggccacggaccatgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgca

SEQ ID NO: 1508 - DNA, 5978 bp, Homo sapiens
aaacacatccacacactctctctgcctagttcacacactgagccactcgcacatgcgagcacattccttccttccttctcactctctcggcccttgacttctacaagcccatggaacatttctggaaagacgttcttgatccagcagggtggcccgccggtttctgagccttctgccctgcggggacacggtctgcaccctgcccgcggccacggaccatgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggccaaattcagataatcgacgccagggtggcagagaaagattggccagtaccaatgacaagggaagtatggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgtaaatgctacgaagtgggaatgatgaaaggtggctttgtggatttgaccctccatgatcaggtccaccttctagaatgtgcctggctagagatcctgatgattggtctcgtctggcgctccatggagcacccagggaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggagatgctggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacggtctgagagctccctggctcccacacggttcagataatccctgctgcattttaccctcatcatgcaccactttagccaaattctgtctcctgcatacactccggcatgcatccaacaccaatggctttctagatgagtggccattcatttgcttgctcagttcttagtggcacatcttctgtcttctgttgggaacagccaaagggattccaaggctaaatctttgtaacagctctctttcccccttgctatgttactaagcgtgaggattcccgtagctcttcacagctgaactcagtctatgggttggggctcagataactctgtgcatttaagctacttgtagagacccaggcctggagagtagacattttgcctctgataagcactttttaaatggctctaagaataagccacagcaaagaatttaaagtggctcctttaattggtgacttggagaaagctaggtcaagggtttattatagcaccctcttgtattcctatggcaatgcatccttttatgaaagtggtacaccttaaagcttttatatgactgtagcagagtatctggtgattgtcaattcattccccctataggaatacaaggggcacacagggaaggcagatcccctagttggcaagactattttaacttgatacactgcagattcagatgtgctgaaagctctgcctctggctttccggtcatgggttccagttaattcatgcctcccatggacctatggagagcagcaagttgatcttagttaagtctccctatatgagggataagttcctgatttttgtttttatttttgtgttacaaaagaaagccctccctccctgaacttgcagtaaggtcagcttcaggacctgttccagtgggcactgtacttggatcttcccggcgtgtgtgtgccttacacaggggtgaactgttcactgtggtgatgcatgatgagggtaaatggtagttgaaaggagcaggggccctggtgttgcatttagccctggggcatggagctgaacagtacttgtgcaggattgttgtggctactagagaacaagagggaaagtagggcagaaactggatacagttctgaggcacagccagacttgctcagggtggccctgccacaggctgcagctacctaggaacattccttgcagaccccgcattgccctttgggggtgccctgggatccctggggtagtccagctcttcttcatttcccagcgtggccctggttggaagaagcagctgtcacagctgctgtagacagctgtgttcctacaattggcccagcaccctggggcacgggagaagggtggggaccgttgctgtcactactcaggctgactggggcctggtcagattacgtatgcccttggtggtttagagataatccaaaatcagggtttggtttggggaagaaaatcctcccccttcctcccccgccccgttccctaccgcctccactcctgccagctcatttccttcaatttcctttgacctataggctaaaaaagaaaggctcattccagccacagggcagccttccctgggcctttgcttctctagcacaattatgggttacttcctttttcttaacaaaaaagaatgtttgatttcctctgggtgaccttattgtctgtaattgaaaccctattgagaggtgatgtctgtgttagccaatgacccaggtgagctgctcgggcttctcttggtatgtcttgtttggaaaagtggatttcattcatttctgattgtccagttaagtgatcaccaaaggactgagaatctgggagggcaaaaaaaaaaaaaaagtttttatgtgcacttaaatttggggacaattttatgtatctgtgttaaggatatgtttaagaacataattcttttgttgctgtttgtttaagaagcaccttagtttgtttaagaagcaccttatatagtataatatatatttttttgaaattacattgcttgtttatcagacaattgaatgtagtaattctgttctggatttaatttgactgggttaacatgcaaaaaccaaggaaaaatatttagtttttttttttttttttgtatacttttcaagctaccttgtcatgtatacagtcatttatgcctaaagcctggtgattattcatttaaatgaagatcacatttcatatcaacttttgtatccacagtagacaaaatagcactaatccagatgcctattgttggatactgaatgacagacaatcttatgtagcaaagattatgcctgaaaaggaaaattattcagggcagctaattttgcttttaccaaaatatcagtagtaatatttttggacagtagctaatgggtcagtgggttctttttaatgtttatacttagattttcttttaaaaaaattaaaataaaacaaaaaaaaatttctaggactagacgatgtaataccagctaaagccaaacaattatacagtggaaggttttacattattcatccaatgtgtttctattcatgttaagatactactacatttgaagtgggcagagaacatcagatgattgaaatgttcgcccaggggtctccagcaactttggaaatctctttgtatttttacttgaagtgccactaatggacagcagatattttctggctgatgttggtattgggtgtaggaacatgatttaaaaaaaaactcttgcctctgctttcccccactctgaggcaagttaaaatgtaaaagatgtgatttatctggggggctcaggtatggtggggaagtggattcaggaatctggggaatggcaaatatattaagaagagtattgaaagtatttggaggaaaatggttaattctgggtgtgcaccagggttcagtagagtccacttctgccctggagaccacaaatcaactagctccatttacagccatttctaaaatggcagcttcagttctagagaagaaagaacaacatcagcagtaaagtccatggaatagctagtggtctgtgtttcttttcgccattgcctagcttgccgtaatgattctataatgccatcatgcagcaattatgagaggctaggtcatccaaagagaagaccctatcaatgtaggttgcaaaatctaacccctaaggaagtgcagtctttgatttgatttccctagtaaccttgcagatatgtttaaccaagccatagcccatgccttttgagggctgaacaaataagggacttactgataatttacttttgatcacattaaggtgttctcaccttgaaatcttatacactgaaatggccattgatttaggccactggcttagagtactccttcccctgcatgacactgattacaaatactttcctattcatactttccaattatgagatggactgtgggtactgggagtgatcactaacaccatagtaatgtctaatattcacaggcagatctgcttggggaagctagttatgtgaaaggcaaatagagtcatacagtagctcaaaaggcaaccataattctctttggtgcaggtcttgggagcgtgatctagattacactgcaccattcccaagttaatcccctgaaaacttactctcaactggagcaaatgaactttggtcccaaatatccatcttttcagtagcgttaattatgctctgtttccaactgcatttcctttccaattgaattaaagtgtggcctcgtttttagtcatttaaaattgttttctaagtaattgctgcctctattatggcacttcaattttgcactgtcttttgagattcaagaaaaatttctattcttttttttgcatccaattgtgcctgaacttttaaaatatgtaaatgctgccatgttccaaacccatcgtcagtgtgtgtgtttagagctgtgcaccctagaaacaacatattgtcccatgagcaggtgcctgagacacagacccctttgcattcacagagaggtcattggttatagagacttgaattaataagtgacattatgccagtttctgttctctcacaggtgataaacaatgctttttgtgcactacatactcttcagtgtagagctcttgttttatgggaaaaggctcaaatgccaaattgtgtttgatggattaatatgcccttttgccgatgcatactattactgatgtgactcggttttgtcgcagctttgctttgtttaatgaaacacacttgtaaacctcttttgcactttgaaaaagaatccagcgggatgctcgagcacctgtaaacaattttctcaacctatttgatgttcaaataaagaattaaactaaa

SEQ ID NO: 1509 - DNA, 5418 bp, Homo sapiens
gcttaaaaataatctcctgccagcccagtgacaagcctgtcccacccggggagaatgccccggagtggcgtgcgggtcagccagggtctgcgcctcgcagccactgtggaaggagcgcggccggtccaggacacaggagaccactttgtgacttcaatggcgaaggccaaattcagataatcgacgccagggtggcagagaaagattggccagtaccaatgacaagggaagtatggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgtaaatgctacgaagtgggaatgatgaaaggtgggatacgaaaagaccgaagaggagggagaatgttgaaacacaagcgccagagagatgatggggagggcaggggtgaagtggggtctgctggagacatgagagctgccaacctttggccaagcccgctcatgatcaaacgctctaagaagaacagcctggccttgtccctgacggccgaccagatggtcagtgccttgttggatgctgagcccccgatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagggaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggtatctcacatgtagaagcaaagaagagaatcctgaacttgcatcctaaaatatttggaaacaagtggtttcctcgtgtctaaagcctctggtcataaggcctcacagtatcctgcagatcatcaaatccgtgtgtggacgtggggacattttgttttgaggcagttacatgaccatgggcaagtaaattagtctctctggccttcagttttctcatttgcaatgattcaatggtttgccttaaagtgtcttaagaaggataggatagctacccacaaactttggatcaaattttcttcaaaacatccttcccctgactttaaaatatgccctggcaaccaacactcaacacctgtagctagatgagttataacagagtgactgaagagagctcccacaattcctagttattaaatacctgactaattttcattaggagacatttaagaactttagtgatgggaagatttacatatataattgatagtacaatctgacagagctgaatagctcctgtttgtcaactgttaaattctttgtgcaattaggtcaaagatcaagatcaaaacaagggctgcccattgacctgttcactcctgagaaaaatggcaaaccattgaatcataaatcatgacagccaaaataattttaggatattaatgcacccctcatctttgcaaatgagaaaactgaaggccagagagactaatttacttgcccatttttgataaaaatgtcaccatttacagaatgtggactcctatgttggagtctgttgaaggacatggcacatttaacagcatcagagcattttttattaaaatttaatttgtgcatgacttctaatgctgaagaacgccaagctaggaagaagtcatgggctgagatggggacagagagaacacacaatattcagtgactgtccgtgcagctggctgcccttgaaaatatccgaactatccactgggaaaatgcctgtccccttggggtaattaccagagtttcaacatgcccaaagctgcctcatcttcagggggaacttgttctagcgattttagtatcaagaagctaatggtcccagggaaagggttatttttaatatttagctactgtgctaaaaatcacctaagtttctagagtcttgggaaatttcataagggaaagaacaaaggcaacttgttgactacccactggtcattctcctctggtcttattacatacatggatgccagtttagattgtgtttatataggaaaaattaaatgtgtgagcctccttaaggaacatcatcaatacagatatatcagatagttctgtccagcaaaaaacgtgcttatttgctacaagtaaatttttatttatttttctcacttccctcactccttcaaatttccaggtaaatagctgcccaggagttgcttcatctctgtcccaaaatacctagacaattgcgggataaggagaatggcagggagggagtagtggctaaaatcacacccttcaaaagaaagtgtgtaggacacacaattgtgagaagtctgaatgccatgcacatagggtatgactcactttgaaaattgtttataatcaaggaaatgaaaatgagttaatttcgtgcatgcatcatttaaagccaaatgagaagaaacttctaatttattttgttacttttcggctaacactggcagtatgtaacagatttattttgcagaaacatctagattgtccgtgatcttgatcctgcccttatgtgtcttgtctttgaaacccagtgtttcctggatatatggttcaggagacaagtttccagaatcaagttaggacccaggtcttctttttttccaaaccaaacattcttgctaatcctaaactacctgaggcagcctgtggtggcctcagctctaaaaccattgtttaaaggcttctacccatcaatggcccttcagcagagtggtacggttaacggggtagggtctggagtcaggggagacctgggttcaaatcctacatctttacacctctaatccccagtgtccttgtctataaattgggaatatagccatgtcatgggattcttgtgagggttaaatgaggtaaaacacatacaatgcttagcatgtatacaattaagcactaaataattgaaacacattaagtactaaatgaatgtcagcagcttatcactattatctgtataatgataccaagggtgtgccgactcatacccttaggggttggctggattcggccttttctctcgggaaaacatacctgatttattaatagtgctttcaagcatgtgataaatttctcaaactgcctgtcttgttccctagaaacaccaggaaggcctacctcaaatagcaacagagaaacctatcggagccttaccctacagctttccttggggcacgggtgagcaatctgccttagaggggagaggctctgtgctgaggctctttgaatgctttgaataaatagatccccagataatgaaaagacttcaaaacaaattctacaagaaactgagtagtgtttatagtgaggccctagtgtacatgcaaaaaacccccactgcccttgcttaaatgtatctgattaacttgaatacatttttaaatgagggcttttttccctctttcagtgtttcggccagtcatttgccacttctcattccatcttagttctctgtaaagaaggtgccagagacctaaggtgcccaaggcaattttgcattttacaattctaagctttagaatgaagtcatcaatttgctacatccggactacagtgcaattattcctttgccttgctggaaattggagtgaaatctttctagctgtcaatttcaactcagttgcagtagtgttttgaagaattaatggcgataaggttagaaaattttaagtcaaacgtagggaaaaagtaccagctagaccatcataagcatttgctttgaaagcatgcttctaaagtgtgtttaacctcaaataacagtcacaaatatggttattatgaatgtatgcacagatttttatgtttctaattttaagaagttctagggagctccctgtaacgatttagggaatctctagattctgatatactgcaagtcttttaatggtaggaatcacattgaattaattttgtaggcccagggcctaaatttagtaggtgttcagtacctattggcatcaattcatatgtaggtttaaaatactgtatgaagatacagaatcaccaccatcaaatcaaattgaaatatgtaacaggctagtataatattaacatctgactttaaacaacaacaaagaaaccaaatgagtaactcctcccttcaaactaatagtcagtttcttccaactcagtctctttctcctctcaggaagaatgcgtatctaaaaatttcccattgcagactgctggaaacaacattctaaactatttatgcttctgcaataacctttccaatttgctggaccagtgcaagattaaacacgagatatctcaagtctcaatgtaaaggaacaccacgacagcctggactgtgggtgaagttcattcttccccagcagactctgcctttcattctcggggttgggtgtgccccaaacagaggtaccgacggtaacgaagcccaagaatgttcaaccacaacctgtctgtgaaggtgttggatgacgtttgccattcaggtgaagattatttatgttccagtcccacctgagtagcaaagtgaacactgtgctgaatgctcagaaagatgttaatgaaccgtgctggacagagcagagctgaaaggcgccttgcgagtgtcgtagtgagaatgtggctgtcccagctgcaaagccctgttaggaggcatgaggaagcacttgctgccctaagaaacgatgccttcgacattttcaaaagatctatgtggctgtctgaaacaatgcggagagcagatagacgcaatatttgggaaccaaagagtgactgctgttggcgttgcatcataacataagcgctttcccccttctcgtcactatcatttgtatcaaccaaagaactgatctctggtatcctcgaaggaatgctgtggggatattcttcatctctgttcatggtacatcagcaatttgtggggaaaagatggactatataacacaatgatctgcctaaaagaaactgtctctacttatagggggctgagcaaaccttagagcatctgcggatgctcgtcattatcttcaaaagtccccaagagtttttctccatactttattattgctattttgtttaggctagaaaaaaaaaaactcataaaattgtcttcaaaccaaaccaaagg

SEQ ID NO: 1510 - DNA, 1788 bp, Homo sapiens
ctcggtctttaaaaggaagaaggggcttatcgttaagtcgcttgtgatcttttcagtttctccagctgctggctttttggacacccactcccccgccaggaggcagttgcaagcgcggaggctgcgagaaataactgcctcttgaaacttgcagggcgaagagcaggcggcgagcgctgggccggggagggaccacccgagctgcgacgggctctggggctgcggggcagggctggcgcccggagcctgagctgcaggaggtgcgctcgctttcctcaacaggtggcggcggggcgcgcgccgggagaccccccctaatgcgggaaaagcacgtgtccgcattttagagaaggcaaggccggtgtgtttatctgcaagccattatacttgcccacgaatctttgagaacattataatgacctttgtgcctcttcttgcaaggtgttttctcagctgttatctcaagacatggatataaaaaactcaccatctagccttaattctccttcctcctacaactgcagtcaatccatcttacccctggagcacggctccatatacataccttcctcctatgtagacagccaccatgaatatccagccatgacattctatagccctgctgtgatgaattacagcattcccagcaatgtcactaacttggaaggtgggcctggtcggcagaccacaagcccaaatgtgttgtggccaacacctgggcacctttctcctttagtggtccatcgccagttatcacatctgtatgcggaacctcaaaagagtccctggtgtgaagcaagatcgctagaacacaccttacctgtaaacagagagacactgaaaaggaaggttagtgggaaccgttgcgccagccctgttactggtccaggttcaaagagggatgctcacttctgcgctgtctgcagcgattacgcatcgggatatcactatggagtctggtcgtgtgaaggatgtaaggccttttttaaaagaagcattcaaggacataatgattatatttgtccagctacaaatcagtgtacaatcgataaaaaccggcgcaagagctgccaggcctgccgacttcggaagtgttacgaagtgggaatggtgaagtgtggctcccggagagagagatgtgggtaccgccttgtgcggagacagagaagtgccgacgagcagctgcactgtgccggcaaggccaagagaagtggcggccacgcgccccgagtgcgggagctgctgctggacgccctgagccccgagcagctagtgctcaccctcctggaggctgagccgccccatgtgctgatcagccgccccagtgcgcccttcaccgaggcctccatgatgatgtccctgaccaagttggccgacaaggagttggtacacatgatcagctgggccaagaagattcccggtatgtaccctctggtcacagcgacccaggatgctgacagcagccggaagctggctcacttgctgaacgccgtgaccgatgctttggtttgggtgattgccaagagcggcatctcctcccagcagcaatccatgcgcctggctaacctcctgatgctcctgtcccacgtcaggcatgcgagtaacaagggcatggaacatctgctcaacatgaagtgcaaaaatgtggtcccagtgtatgacctgctgctggagatgctgaatgcccacgtgcttcgcgggtgcaagtcctccatcacggggtccgagtgcagcccggcagaggacagtaaaagcaaagagggctcccagaacccacagtctcagtga

SEQ ID NO: 1511 - DNA, 2060 bp, Homo sapiens
tttcagtttctccagctgctggctttttggacacccactcccccgccaggaggcagttgcaagcgcggaggctgcgagaaataactgcctcttgaaacttgcagggcgaagagcaggcggcgagcgctgggccggggagggaccacccgagctgcgacgggctctggggctgcggggcagggctggcgcccggagcctgagctgcaggaggtgcgctcgctttcctcaacaggtggcggcggggcgcgcgccgggagaccccccctaatgcgggaaaagcacgtgtccgcattttagagaaggcaaggccggtgtgtttatctgcaagccattatacttgcccacgaatctttgagaacattataatgacctttgtgcctcttcttgcaaggtgttttctcagctgttatctcaagacatggatataaaaaactcaccatctagccttaattctccttcctcctacaactgcagtcaatccatcttacccctggagcacggctccatatacataccttcctcctatgtagacagccaccatgaatatccagccatgacattctatagccctgctgtgatgaattacagcattcccagcaatgtcactaacttggaaggtgggcctggtcggcagaccacaagcccaaatgtgttgtggccaacacctgggcacctttctcctttagtggtccatcgccagttatcacatctgtatgcggaacctcaaaagagtccctggtgtgaagcaagatcgctagaacacaccttacctgtaaacagagagacactgaaaaggaaggttagtgggaaccgttgcgccagccctgttactggtccaggttcaaagagggatgctcacttctgcgctgtctgcagcgattacgcatcgggatatcactatggagtctggtcgtgtgaaggatgtaaggccttttttaaaagaagcattcaaggacataatgattatatttgtccagctacaaatcagtgtacaatcgataaaaaccggcgcaagagctgccaggcctgccgacttcggaagtgttacgaagtgggaatggtgaagtgtggctcccggagagagagatgtgggtaccgccttgtgcggagacagagaagtgccgacgagcagctgcactgtgccggcaaggccaagagaagtggcggccacgcgccccgagtgcgggagctgctgctggacgccctgagccccgagcagctagtgctcaccctcctggaggctgagccgccccatgtgctgatcagccgccccagtgcgcccttcaccgaggcctccatgatgatgtccctgaccaagttggccgacaaggagttggtacacatgatcagctgggccaagaagattcccggctttgtggagctcagcctgttcgaccaagtgcggctcttggagagctgttggatggaggtgttaatgatggggctgatgtggcgctcaattgaccaccccggcaagctcatctttgctccagatcttgttctggacagggatgaggggaaatgcgtagaaggaattctggaaatctttgacatgctcctggcaactacttcaaggtttcgagagttaaaactccaacacaaagaatatctctgtgtcaaggccatgatcctgctcaattccagtatgtaccctctggtcacagcgacccaggatgctgacagcagccggaagctggctcacttgctgaacgccgtgaccgatgctttggtttgggtgattgccaagagcggcatctcctcccagcagcaatccatgcgcctggctaacctcctgatgctcctgtcccacgtcaggcatgcgagtaacaagggcatggaacatctgctcaacatgaagtgcaaaaatgtggtcccagtgtatgacctgctgctggagatgctgaatgcccacgtgcttcgcgggtgcaagtcctccatcacggggtccgagtgcagcccggcagaggacagtaaaagcaaagagggctcccagaacccacagtctcagtgacgcctggccctgaggtgaactggcccacagaggtcacaggctgaagcgt

SEQ ID NO: 1512 - DNA, 2454 bp, Homo sapiens
ctcggtctttaaaaggaagaaggggcttatcgttaagtcgcttgtgatcttttcagtttctccagctgctggctttttggacacccactcccccgccaggaggcagttgcaagcgcggaggctgcgagaaataactgcctcttgaaacttgcagggcgaagagcaggcggcgagcgctgggccggggagggaccacccgagctgcgacgggctctggggctgcggggcagggctggcgcccggagcctgagctgcaggaggtgcgctcgctttcctcaacaggtggcggcggggcgcgcgccgggagaccccccctaatgcgggaaaagcacgtgtccgcattttagagaaggcaaggccggtgtgtttatctgcaagccattatacttgcccacgaatctttgagaacattataatgacctttgtgcctcttcttgcaaggtgttttctcagctgttatctcaagacatggatataaaaaactcaccatctagccttaattctccttcctcctacaactgcagtcaatccatcttacccctggagcacggctccatatacataccttcctcctatgtagacagccaccatgaatatccagccatgacattctatagccctgctgtgatgaattacagcattcccagcaatgtcactaacttggaaggtgggcctggtcggcagaccacaagcccaaatgtgttgtggccaacacctgggcacctttctcctttagtggtccatcgccagttatcacatctgtatgcggaacctcaaaagagtccctggtgtgaagcaagatcgctagaacacaccttacctgtaaacagagagacactgaaaaggaaggttagtgggaaccgttgcgccagccctgttactggtccaggttcaaagagggatgctcacttctgcgctgtctgcagcgattacgcatcgggatatcactatggagtctggtcgtgtgaaggatgtaaggccttttttaaaagaagcattcaaggacataatgattatatttgtccagctacaaatcagtgtacaatcgataaaaaccggcgcaagagctgccaggcctgccgacttcggaagtgttacgaagtgggaatggtgaagtgtggctcccggagagagagatgtgggtaccgccttgtgcggagacagagaagtgccgacgagcagctgcactgtgccggcaaggccaagagaagtggcggccacgcgccccgagtgcgggagctgctgctggacgccctgagccccgagcagctagtgctcaccctcctggaggctgagccgccccatgtgctgatcagccgccccagtgcgcccttcaccgaggcctccatgatgatgtccctgaccaagttggccgacaaggagttggtacacatgatcagctgggccaagaagattcccggctttgtggagctcagcctgttcgaccaagtgcggctcttggagagctgttggatggaggtgttaatgatggggctgatgtggcgctcaattgaccaccccggcaagctcatctttgctccagatcttgttctggacagggatgaggggaaatgcgtagaaggaattctggaaatctttgacatgctcctggcaactacttcaaggtttcgagagttaaaactccaacacaaagaatatctctgtgtcaaggccatgatcctgctcaattccagtatgtaccctctggtcacagcgacccaggatgctgacagcagccggaagctggctcacttgctgaacgccgtgaccgatgctttggtttgggtgattgccaagagcggcatctcctcccagcagcaatccatgcgcctggctaacctcctgatgctcctgtcccacgtcaggcatgcgagggcagaaaaggcctctcaaacactcacctcatttggaatgaagatggagactcttttgcctgaagcaacgatggagcagtgaccctctaatcaactcggtggcctaaagaaaaatcttgggtaacattttcacttcagtttccctctgggatcattgtaatccatgaaaaaaataattttaaagaaagagttaaaatactttgaagttagttatgtggttaaaaaccaccttcctttctattatcaatccaacaatttgataactgtaaacgctaaagtgaagacggattctcttcagatggtctccttaactgcccagggcttgcagatgtctcacccatgaggggcaccaatgtagaaagctgaggcttcatctactgatgagcttcactggtttcccctgaggtttgtgctttggcagagaaggggaggaggggactgggattgtgtggtcagctgtgcctgccaacagatgcaggttaggaactgtgttcagtatcttccaataagaaaggggaaatgccgatgcctatcctctttgtttaggtagaaagtaaaatgctactggacttaaatgggc

SEQ ID NO: 1513 - DNA, 1914 bp, Homo sapiens
ctcggtctttaaaaggaagaaggggcttatcgttaagtcgcttgtgatcttttcagtttctccagctgctggctttttggacacccactcccccgccaggaggcagttgcaagcgcggaggctgcgagaaataactgcctcttgaaacttgcagggcgaagagcaggcggcgagcgctgggccggggagggaccacccgagctgcgacgggctctggggctgcggggcagggctggcgcccggagcctgagctgcaggaggtgcgctcgctttcctcaacaggtggcggcggggcgcgcgccgggagaccccccctaatgcgggaaaagcacgtgtccgcattttagagaaggcaaggccggtgtgtttatctgcaagccattatacttgcccacgaatctttgagaacattataatgacctttgtgcctcttcttgcaaggtgttttctcagctgttatctcaagacatggatataaaaaactcaccatctagccttaattctccttcctcctacaactgcagtcaatccatcttacccctggagcacggctccatatacataccttcctcctatgtagacagccaccatgaatatccagccatgacattctatagccctgctgtgatgaattacagcattcccagcaatgtcactaacttggaaggtgggcctggtcggcagaccacaagcccaaatgtgttgtggccaacacctgggcacctttctcctttagtggtccatcgccagttatcacatctgtatgcggaacctcaaaagagtccctggtgtgaagcaagatcgctagaacacaccttacctgtaaacagagagacactgaaaaggaaggttagtgggaaccgttgcgccagccctgttactggtccaggttcaaagagggatgctcacttctgcgctgtctgcagcgattacgcatcgggatatcactatggagtctggtcgtgtgaaggatgtaaggccttttttaaaagaagcattcaaggacataatgattatatttgtccagctacaaatcagtgtacaatcgataaaaaccggcgcaagagctgccaggcctgccgacttcggaagtgttacgaagtgggaatggtgaagtgtggctcccggagagagagatgtgggtaccgccttgtgcggagacagagaagtgccgacgagcagctgcactgtgccggcaaggccaagagaagtggcggccacgcgccccgagtgcgggagctgctgctggacgccctgagccccgagcagctagtgctcaccctcctggaggctgagccgccccatgtgctgatcagccgccccagtgcgcccttcaccgaggcctccatgatgatgtccctgaccaagttggccgacaaggagttggtacacatgatcagctgggccaagaagattcccggctttgtggagctcagcctgttcgaccaagtgcggctcttggagagctgttggatggaggtgttaatgatggggctgatgtggcgctcaattgaccaccccggcaagctcatctttgctccagatcttgttctggacagggatgaggggaaatgcgtagaaggaattctggaaatctttgacatgctcctggcaactacttcaaggtttcgagagttaaaactccaacacaaagaatatctctgtgtcaaggccatgatcctgctcaattccagtatgtaccctctggtcacagcgacccaggatgctgacagcagccggaagctggctcacttgctgaacgccgtgaccgatgctttggtttgggtgattgccaagagcggcatctcctcccagcagcaatccatgcgcctggctaacctcctgatgctcctgtcccacgtcaggcatgcgagatggggagaaaagcaattcattcatttgaagttatcttag

SEQ ID NO: 1514 - DNA, 1899 bp, Homo sapiens
gatgccagttaactgtcgagaggggacgctccctcctcgtaggcgtccacactggagaaggaataagatgggcgattgcctgggaagcctgacagggcggcggcagctgggatgctggagaggactggccccttgagttactgagtccgatgaatgtgcttgctctgctggaggaaccgcgctcaggttacagtcatcccaatatggttctgaagccattatacttgcccacgaatctttgagaacattataatgacctttgtgcctcttcttgcaaggtgttttctcagctgttatctcaagacatggatataaaaaactcaccatctagccttaattctccttcctcctacaactgcagtcaatccatcttacccctggagcacggctccatatacataccttcctcctatgtagacagccaccatgaatatccagccatgacattctatagccctgctgtgatgaattacagcattcccagcaatgtcactaacttggaaggtgggcctggtcggcagaccacaagcccaaatgtgttgtggccaacacctgggcacctttctcctttagtggtccatcgccagttatcacatctgtatgcggaacctcaaaagagtccctggtgtgaagcaagatcgctagaacacaccttacctgtaaacagagagacactgaaaaggaaggttagtgggaaccgttgcgccagccctgttactggtccaggttcaaagagggatgctcacttctgcgctgtctgcagcgattacgcatcgggatatcactatggagtctggtcgtgtgaaggatgtaaggccttttttaaaagaagcattcaaggacataatgattatatttgtccagctacaaatcagtgtacaatcgataaaaaccggcgcaagagctgccaggcctgccgacttcggaagtgttacgaagtgggaatggtgaagtgtggctcccggagagagagatgtgggtaccgccttgtgcggagacagagaagtgccgacgagcagctgcactgtgccggcaaggccaagagaagtggcggccacgcgccccgagtgcgggagctgctgctggacgccctgagccccgagcagctagtgctcaccctcctggaggctgagccgccccatgtgctgatcagccgccccagtgcgcccttcaccgaggcctccatgatgatgtccctgaccaagttggccgacaaggagttggtacacatgatcagctgggccaagaagattcccggctttgtggagctcagcctgttcgaccaagtgcggctcttggagagctgttggatggaggtgttaatgatggggctgatgtggcgctcaattgaccaccccggcaagctcatctttgctccagatcttgttctggacagggatgaggggaaatgcgtagaaggaattctggaaatctttgacatgctcctggcaactacttcaaggtttcgagagttaaaactccaacacaaagaatatctctgtgtcaaggccatgatcctgctcaattccagtatgtaccctctggtcacagcgacccaggatgctgacagcagccggaagctggctcacttgctgaacgccgtgaccgatgctttggtttgggtgattgccaagagcggcatctcctcccagcagcaatccatgcgcctggctaacctcctgatgctcctgtcccacgtcaggcatgcgagggcagaaaaggcctctcaaacactcacctcatttggaatgaagatggagactcttttgcctgaagcaacgatggagcagtgaccctctaatcaactcggtggcctaaagaaaaatcttgggtaacattttcacttcagtttccctctgggatcattgtaatccatgaaaaaaataattttaaagaaag

SEQ ID NO: 1515 - DNA, 2695 bp, Homo sapiens
ctcggtctttaaaaggaagaaggggcttatcgttaagtcgcttgtgatcttttcagtttctccagctgctggctttttggacacccactcccccgccaggaggcagttgcaagcgcggaggctgcgagaaataactgcctcttgaaacttgcagggcgaagagcaggcggcgagcgctgggccggggagggaccacccgagctgcgacgggctctggggctgcggggcagggctggcgcccggagcctgagctgcaggaggtgcgctcgctttcctcaacaggtggcggcggggcgcgcgccgggagaccccccctaatgcgggaaaagcacgtgtccgcattttagagaaggcaaggccggtgtgtttatctgcaagccattatacttgcccacgaatctttgagaacattataatgacctttgtgcctcttcttgcaaggtgttttctcagctgttatctcaagacatggatataaaaaactcaccatctagccttaattctccttcctcctacaactgcagtcaatccatcttacccctggagcacggctccatatacataccttcctcctatgtagacagccaccatgaatatccagccatgacattctatagccctgctgtgatgaattacagcattcccagcaatgtcactaacttggaaggtgggcctggtcggcagaccacaagcccaaatgtgttgtggccaacacctgggcacctttctcctttagtggtccatcgccagttatcacatctgtatgcggaacctcaaaagagtccctggtgtgaagcaagatcgctagaacacaccttacctgtaaacagagagacactgaaaaggaaggttagtgggaaccgttgcgccagccctgttactggtccaggttcaaagagggatgctcacttctgcgctgtctgcagcgattacgcatcgggatatcactatggagtctggtcgtgtgaaggatgtaaggccttttttaaaagaagcattcaaggacataatgattatatttgtccagctacaaatcagtgtacaatcgataaaaaccggcgcaagagctgccaggcctgccgacttcggaagtgttacgaagtgggaatggtgaagtgtggctcccggagagagagatgtgggtaccgccttgtgcggagacagagaagtgccgacgagcagctgcactgtgccggcaaggccaagagaagtggcggccacgcgccccgagtgcgggagctgctgctggacgccctgagccccgagcagctagtgctcaccctcctggaggctgagccgccccatgtgctgatcagccgccccagtgcgcccttcaccgaggcctccatgatgatgtccctgaccaagttggccgacaaggagttggtacacatgatcagctgggccaagaagattcccggctttgtggagctcagcctgttcgaccaagtgcggctcttggagagctgttggatggaggtgttaatgatggggctgatgtggcgctcaattgaccaccccggcaagctcatctttgctccagatcttgttctggacagggatgaggggaaatgcgtagaaggaattctggaaatctttgacatgctcctggcaactacttcaaggtttcgagagttaaaactccaacacaaagaatatctctgtgtcaaggccatgatcctgctcaattccagtatgtaccctctggtcacagcgacccaggatgctgacagcagccggaagctggctcacttgctgaacgccgtgaccgatgctttggtttgggtgattgccaagagcggcatctcctcccagcagcaatccatgcgcctggctaacctcctgatgctcctgtcccacgtcaggcatgcgagctctctctcactctcttggagattgtttatgctgagggaagccagctgccatggtgtgaggcagactcctggaggagcccacgtgtctgtaagtagaagcagatcttttgaggcctgtcaacagccacgggaatgagcttggaagcagatcccacctcctccctcacacaagtcgagccttcagatgagcctgcagcctttgtcgacaccttgaccgcattctcatgagagaccttgagccagagatacttagctaagccatgcccatggactcctgacccacagaaactgtgataataagtttgttgtttcaagctgctaacttatggagtaatatgttacacaaaaatagctaatatatagctcaaaactggaagcaacccaaatatctattaactggtagataaacaaactactcatttccaaacttatttccaaaactggaacactacttggcaatcaaataattaactatgcattaagtgtaacaacctggatgaatctcaaaggcattatgttaagtgaaacaagtgagccacgtaagactacatactgtttgattccctctatatgatattctagaaaaggcaaaactatagtaataggaaacagtgagtgatcacctagggttgaagacaggtgaaaggggattgactgcaaagaggcaggaggaaacgtcttgggagatggagatgttccttatattgatggcggtggtggttacacaactgcacttttatcaaaacttacctaactgctacttaaaataggtgtattaatatttttactgtatgtaaattatacctcaataaatttgattt

SEQ ID NO: 1516 - DNA, 3588 bp, Homo sapiens
cgagaggggacgctccctcctcgtaggcgtccacactggagaaggaataagatgggcgattgcctgggaagcctgacagggcggcggcagctgggatgctggagaggactggccccttgagttactgagtccgatgaatgtgcttgctctgctggaggaaccgcgctcaggttacagtcatcccaatatggttctgaagacatccaagtggagatatggcatttaaattcatgagattggatgagatcccaccaaaggaacaggtttaggtggagacaaccaaataccgatgcctaggacactgcagtgtttagaattcaaggagatgagaaggaaacaggagggaagattgaaaagaagagtccagtgtgttatgaggaaaaccccaagagcatgctgccttacaagacaggtgaaaaatgtgttctgtgaaagaaagagtaattaactgttaaatgttacagactgatcaaataaaatgaagactgagaatggcctgtttgtaagagggagacatcaacctgttgtggaaaagaatgatcacttaaagtctttagaaattctgaaccaactctctagcaggtgatccttgttagaatttgagcccttaacgctatccaggactggaggttgaagggacgatagagggagcaggaggagaatgcacatggattaaggagcgagaacacagaaatcctgggctctcttctcccagccacaaggttaggttgaaaaacagagcagatggaggtagtttgtagcctacaggtgccctgaatgaagcttccacagtgctaaagtggaagaacgagggactccaagggaaggattcaaggctgggcccatgcacctgtgtaattcagaagagaccccagaggagatcagcgccctctaattagccctgtatctgggctctacaggacagacatgcctccatttatgcaacaaataagaacagcatctcatgacagtggagaaaacatgggatgtgcaggtagggttttgttttgcctcttggtagtttctttcctacggaaaattctccctctgatctttccaagtcaaaggcttcagcaaacatttgttgaacgcgtggattgtgctaggtgggtgttatggaccatggagaatgctagagatgtaagacatgcgctgtccaatcgcagcgcaggttgtgttgacagccattatacttgcccacgaatctttgagaacattataatgacctttgtgcctcttcttgcaaggtgttttctcagctgttatctcaagacatggatataaaaaactcaccatctagccttaattctccttcctcctacaactgcagtcaatccatcttacccctggagcacggctccatatacataccttcctcctatgtagacagccaccatgaatatccagccatgacattctatagccctgctgtgatgaattacagcattcccagcaatgtcactaacttggaaggtgggcctggtcggcagaccacaagcccaaatgtgttgtggccaacacctgggcacctttctcctttagtggtccatcgccagttatcacatctgtatgcggaacctcaaaagagtccctggtgtgaagcaagatcgctagaacacaccttacctgtaaacagagagacactgaaaaggaaggttagtgggaaccgttgcgccagccctgttactggtccaggttcaaagagggatgctcacttctgcgctgtctgcagcgattacgcatcgggatatcactatggagtctggtcgtgtgaaggatgtaaggccttttttaaaagaagcattcaaggacataatgattatatttgtccagctacaaatcagtgtacaatcgataaaaaccggcgcaagagctgccaggcctgccgacttcggaagtgttacgaagtgggaatggtgaagtgtggctcccggagagagagatgtgggtaccgccttgtgcggagacagagaagtgccgacgagcagctgcactgtgccggcaaggccaagagaagtggcggccacgcgccccgagtgcgggagctgctgctggacgccctgagccccgagcagctagtgctcaccctcctggaggctgagccgccccatgtgctgatcagccgccccagtgcgcccttcaccgaggcctccatgatgatgtccctgaccaagttggccgacaaggagttggtacacatgatcagctgggccaagaagattcccggctttgtggagctcagcctgttcgaccaagtgcggctcttggagagctgttggatggaggtgttaatgatggggctgatgtggcgctcaattgaccaccccggcaagctcatctttgctccagatcttgttctggacagggatgaggggaaatgcgtagaaggaattctggaaatctttgacatgctcctggcaactacttcaaggtttcgagagttaaaactccaacacaaagaatatctctgtgtcaaggccatgatcctgctcaattccagtatgtaccctctggtcacagcgacccaggatgctgacagcagccggaagctggctcacttgctgaacgccgtgaccgatgctttggtttgggtgattgccaagagcggcatctcctcccagcagcaatccatgcgcctggctaacctcctgatgctcctgtcccacgtcaggcatgcgagggcagaaaaggcctctcaaacactcacctcatttggaatgaagatggagactcttttgcctgaagcaacgatggagcagtgaccctctaatcaactcggtggcctaaagaaaaatcttgggtaacattttcacttcagtttccctctgggatcattgtaatccatgaaaaaaataattttaaagaaagagttaaaatactttgaagttagttatgtggttaaaaaccaccttcctttctattatcaatccaacaatttgataactgtaaacgctaaagtgaagacggattctcttcagatggtctccttaactgcccagggcttgcagatgtctcacccatgaggggcaccaatgtagaaagctgaggcttcatctactgatgagcttcactggtttcccctgaggtttgtgctttggcagagaaggggaggaggggactgggattgtgtggtcagctgtgcctgccaacagatgcaggttaggaactgtgttcagtatcttccaataagaaaggggaaatgccgatgcctatcctctttgtttaggtagaaagtaaaatgctactggacttaaatgggcaacaaggggctttgcctgttcatttgccatggagagggctgggaatccaggtgcggtggctcacacctgtaatcccaacactttgggaggccgaggtgggcagatcagttgaggtcaggagtttgaaaccagcctggccaacatggcgaaaccccgtctctattaaaaatataataattagccaggcatggtggtgtgtgcttgtaatcccagctactcaggaggctgaggcatgagaatggcttgaacctggaaggcaaaggttgcagtgagccgagattgggccaccgcactccagcctgggtgactgacagagtgagactctgtc

SEQ ID NO: 1517 - DNA, 5458 bp, Homo sapiens
atggatataaaaaactcaccatctagccttaattctccttcctcctacaactgcagtcaatccatcttacccctggagcacggctccatatacataccttcctcctatgtagacagccaccatgaatatccagccatgacattctatagccctgctgtgatgaattacagcattcccagcaatgtcactaacttggaaggtgggcctggtcggcagaccacaagcccaaatgtgttgtggccaacacctgggcacctttctcctttagtggtccatcgccagttatcacatctgtatgcggaacctcaaaagagtccctggtgtgaagcaagatcgctagaacacaccttacctgtaaacagagagacactgaaaaggaaggttagtgggaaccgttgcgccagccctgttactggtccaggttcaaagagggatgctcacttctgcgctgtctgcagcgattacgcatcgggatatcactatggagtctggtcgtgtgaaggatgtaaggccttttttaaaagaagcattcaaggacataatgattatatttgtccagctacaaatcagtgtacaatcgataaaaaccggcgcaagagctgccaggcctgccgacttcggaagtgttacgaagtgggaatggtgaagtgtggctcccggagagagagatgtgggtaccgccttgtgcggagacagagaagtgccgacgagcagctgcactgtgccggcaaggccaagagaagtggcggccacgcgccccgagtgcgggagctgctgctggacgccctgagccccgagcagctagtgctcaccctcctggaggctgagccgccccatgtgctgatcagccgccccagtgcgcccttcaccgaggcctccatgatgatgtccctgaccaagttggccgacaaggagttggtacacatgatcagctgggccaagaagattcccggctttgtggagctcagcctgttcgaccaagtgcggctcttggagagctgttggatggaggtgttaatgatggggctgatgtggcgctcaattgaccaccccggcaagctcatctttgctccagatcttgttctggacagggatgaggggaaatgcgtagaaggaattctggaaatctttgacatgctcctggcaactacttcaaggtttcgagagttaaaactccaacacaaagaatatctctgtgtcaaggccatgatcctgctcaattccagtatgtaccctctggtcacagcgacccaggatgctgacagcagccggaagctggctcacttgctgaacgccgtgaccgatgctttggtttgggtgattgccaagagcggcatctcctcccagcagcaatccatgcgcctggctaacctcctgatgctcctgtcccacgtcaggcatgcgaggtacgcgccctaaggagctgctctgcttgggcttgggatgggattatgtgctccacggagggtgaagtgatttgggaaaagtgtctgcaagttaaggaaaatgaatgcctgaaagggaatggggaatttgtcagttcacacacctgtaagcaaagatgggcacagagtgggcatggaaggaatgtcatgtggtatcttacaggctctgcatggcagccagtggtggctcatgggtttttcaattgctggggtttatagcctgtttatggagtcctaaaaggggcagttcctcccctaacacgaactgccacccctgtttacaccacccagggctgaggccctgaggccactttttgtggagaggctaagacccgctcccctagatggcccctcgagctggtgatgcgaagaagtgcacaaatgcttccctaagagttgttctttcggtggcatcaggaaattaaggataagacttaagagaagtggtggacccagcagatttaggaaggcagggctgtaggtagggcatgtttctgatcaggaaacgtaattgtgtgtgctgatgaagagggtgtgcagtggtggctactgttggtacaatgatgctcagtgcttggtgtcacccacgatgagggtagccttgccctggagctggaggaggggaggggagggtggaaggtaattaactggtcactgaggaggcaagtctagaggctgtggagaaggacaatatacacctcgagaatcttaagtgagatgaagacctctgcctttcccctttaatgattgctcagcacatagccatttgcagaacagatcctgtgtttgtagattccttcattgtgaatttatctgcttgctaaaatttatttgtaaccccaaaatcaatatttgtggtgtttttgaggtcatgaacagagtggcagaaattttgagttgccctttatgtacagtcccagctgagatggaacaagcagctgctctcatactgtcaacaagtgtcctttacttggtctacttagtgccatggttttacatttttgtgcttttggtgacttcactgtttaaaatgcccccctggtgtggtgctgaagacctgtctagtgttcctcggtgtgaaaaagctgtgatgtgccttatggagaaagtatgtgttaagctttgctcgggtgtgagttatagtgctgctggccatgagttcaatgttaatgagtcaatggtatttatcacataaggcatctttagaaagaaacacacataaaacaaggttttgtattgatcagctgatgaagatgtggccagaggcttgcaggaacctaaccctgtatttcccctatgagtgaggattcagtgttcacagtgactttacggaacataattaccgcaaacaatgaggattgattgtcctatgtgtcaggccattgtaggtgtgtggtgggacacagaggctgacaagacatcgtccttgcccttgagcctaaattatcagggggagctggatgcacgagccatggataaatgggctgggggaagagtgggtttaggggtggggtagactggctctgagcaaagagagccggggaaggcttcggggttcctgtggctgcctcggaggagggaatctcagcacctttttgtccccatagtaacaagggcatggaacatctgctcaacatgaagtgcaaaaatgtggtcccagtgtatgacctgctgctggagatgctgaatgcccacgtgcttcgcgggtgcaagtcctccatcacggggtccgagtgcagcccggcagaggacagtaaaagcaaagagggctcccagaacccacagtctcagtgacgcctggccctgaggtgaactggcccacagaggtcacaggctgaagcgtgaactccagtgtgtcaggagcctgggcttcatctttctgctgtgtggtccctcatttggtgatggcaggcttggtcatgtaccatccttccctccaccttcccaactctcaggagtcggtgtgaggaagccatagtttcccttgttagcagagggcacatttgaatgcagcgtttccacactcaatggcctcataggatctcagtgtggtctttcttactttccttcttccttcctcccctttgtgaaacatcttaaaggttttggaatgaatggtggaaatctgacttggaagggctgcgaatcagaaaggggagaggaagtgacacgcttacagaagtgggctaacccttcttgtgtggcacacactacccttccctctgagagttgacctttgctgttttccggaccactccattgtaagattgaaaacccctgtggcaattgcgtacttacctcccaggcctgtggggactgatcatatcatatgatgcttattctgtcaaaggccagagggactgtggttaagctgggatgtgagtcatgttctctccctgaccttgctgccagctgcacacagatttgtccctctcgatttgtattcacagagcctgccaataatttggggtatgtgtgtatgagcgtgtgatcattttcatgcaggactgtgggagatacaaatctcgctgcttctggagctgctcttccttaaacctgttgtcccatggggccagcgtgggtgctggagaaaggccgtgtttgcaggaatggggttctctcctgtgggtgtgggtgacagccacagtgtttccctggggcaatgtggatgcagtttccatcttgtacaacctcataagtagcagccacaattgccccatcagtcaccacaagtagtcagggatactttgggctgtggatgtgtgcagtgtgctgttttatggatggatgagtagctatgcaccccagtgtgtcagctctggggccacactgtatagccttgatgagtacgccccttgaacaagacccagtttgtgaactctccttaaagagaaatatttagggataattatttatagcaagaaagaattcttttacacttgagagctcttttaaaaatattttcttattggaaaatttatatggtgggcagggtgaaaaagaaacagtaaaaatattagttcttattccaagtggaacataaataggacatgaagaagggcacctctgaaatgacaactttaactcaccttttaaaagatgtgaaatttccagttttggatacacggtgaatatgtaaaatgagtaacagcatactatggaagccagcaattaaataatcatgtttcattattgcagtaacgttttaaacaattaccttgtgatatgatattaaatatattttctttttgaaaatatgttcactttgggtagcacatcctgtatttactaagtcattaggaagactgcattcagtgttaccaagactggtttttgctagtaagacctcgaataatccataattttgatattggtgcaattttactataagttgagcttagctgtttcagaaatgcttggacaagtacctagagaacacactgatgtctgtgttctgaggcagtctgaagttattcttagagactcagttacagctttagtaagatttagtacaggcaggataagcttggtttcataggaaccagggaaccagtgttagtgtcagcttctttcctcctggtcagcctagaatcccccactcccaatagaggggtttggaagctggagagtaggaagtaagaggcaaagaaggcagccttcagcaactcattatctgccagtgaaattctattaaatgtatttttaaaagagattaccaggtaacaaaaacataaaaaaccaaaacaaggccagatgtggtggctcacgcctgtaatcccagcactttgggaggccgaggtgggcgaaccacttgagcccatgagtttgactccaggctgggcaacatggaaaccctgtcctacaaaagatacaaaaattagccaggcgtggtggtgcaggcctgtagttccagctacctgggaggctgaggtgggaggatcacctgagcctggggagatcaaggctgcagtccattgcactccagcctgggtgacagagggagaccctgtctc

SEQ ID NO: 1518 - DNA, 1883 bp, Homo sapiens
atggatataaaaaactcaccatctagccttaattctccttcctcctacaactgcagtcaatccatcttacccctggagcacggctccatatacataccttcctcctatgtagacagccaccatgaatatccagccatgacattctatagccctgctgtgatgaattacagcattcccagcaatgtcactaacttggaaggtgggcctggtcggcagaccacaagcccaaatgtgttgtggccaacacctgggcacctttctcctttagtggtccatcgccagttatcacatctgtatgcggaacctcaaaagagtccctggtgtgaagcaagatcgctagaacacaccttacctgtaaacagagagacactgaaaaggaaggttagtgggaaccgttgcgccagccctgttactggtccaggttcaaagagggatgctcacttctgcgctgtctgcagcgattacgcatcgggatatcactatggagtctggtcgtgtgaaggatgtaaggccttttttaaaagaagcattcaaggacataatgattatatttgtccagctacaaatcagtgtacaatcgataaaaaccggcgcaagagctgccaggcctgccgacttcggaagtgttacgaagtgggaatggtgaagtgtggctcccggagagagagatgtgggtaccgccttgtgcggagacagagaagtgccgacgagcagctgcactgtgccggcaaggccaagagaagtggcggccacgcgccccgagtgcgggagctgctgctggacgccctgagccccgagcagctagtgctcaccctcctggaggctgagccgccccatgtgctgatcagccgccccagtgcgcccttcaccgaggcctccatgatgatgtccctgaccaagttggccgacaaggagttggtacacatgatcagctgggccaagaagattcccggctttgtggagctcagcctgttcgaccaagtgcggctcttggagagctgttggatggaggtgttaatgatggggctgatgtggcgctcaattgaccaccccggcaagctcatctttgctccagatcttgttctggacagggatgaggggaaatgcgtagaaggaattctggaaatctttgacatgctcctggcaactacttcaaggtttcgagagttaaaactccaacacaaagaatatctctgtgtcaaggccatgatcctgctcaattccagtatgtaccctctggtcacagcgacccaggatgctgacagcagccggaagctggctcacttgctgaacgccgtgaccgatgctttggtttgggtgattgccaagagcggcatctcctcccagcagcaatccatgcgcctggctaacctcctgatgctcctgtcccacgtcaggcatgcgagatggggagaaaagcaattcattcatttgaagttatcttagtgccaagagtcatgtgaaaatgtcccttgcatgtgggcaatgaaagatttgcagacgatataaaacccagactacctcataaaagagttttgggaatacactgagctttgagtgaaagaagctgcagtggcctccctggagatggggagcaaaccagcttaaaggcccttatcctgaggaagagacaaaaattgacatgcacaatattaagctttgaaatgcagaccacacttcctttcactgcaactttgacttgtcccgcatctctacttaagggcagaaaaggcctctcaaacactcacctcatttggaatgaagatggagactcttttgcctgaagcaacgatggagcagtgaccctctaatcaactcggtggcctaaagaaaaatcttgggtaacattttcacttcagtttccctctgggatcattgtaatc

SEQ ID NO: 1519 - DNA, 6348 bp, Homo sapiens
cgttattggctgcgggaagaacctcgccgggacctaacccgaagctccgccccctcgcggttaccctggatacccgtcaggctcgggctgcagagaaggaggatcagggcaagtggcttcagagatgcagccctcactgcttaacgtcctagttattgtccttgaaacccgagccatctcaccgctcgcccccaaccctgggctctggctgtttaaaagctggagaggaagtgaaagcgtcaagtacagttgatagaagtccagatcctgaggaaatctccagctaaatgctcaaaatataaaatactgagctgagatttgcgaagagcagcagcatggatggattttatgaccagcaagtgccttacatggtcaccaatagtcagcgtgggagaaattgtaacgagaaaccaacaaatgtcaggaaaagaaaattcattaacagagatctggctcatgattcagaagaactctttcaagatctaagtcaattacaggaaacatggcttgcagaagtggcttttcatggcctgccactgaaaatcaagaaagaaccccacagtccatgttcagaaatcagctctgcctgcagtcaagaacagccctttaaattcagctatggagaaaagtgcctgtacaatgtcagtgcctatgatcagaagccacaagtgggaatgaggccctccaacccccccacaccatccagcacgccagtgtccccactgcatcatgcatctccaaactcaactcatacaccgaaacctgaccgggccttcccagctcacctccctccatcgcagtccataccagatagcagctaccccatggaccacagatttcgccgccagctttctgaaccctgtaactcctttcctcctttgccgacgatgccaagggaaggacgtcctatgtaccaacgccagatgtctgagccaaacatccccttcccaccacaaggctttaagcaggagtaccacgacccagtgtatgaacacaacaccatggttggcagtgcggccagccaaagctttccccctcctctgatgattaaacaggaacccagagattttgcatatgactcagaagtgcctagctgccactccatttatatgaggcaagaaggcttcctggctcatcccagcagaacagaaggctgtatgtttgaaaagggccccaggcagttttatgatgacacctgtgttgtcccagaaaaattcgatggagacatcaaacaagagccaggaatgtatcgggaaggacccacataccaacggcgaggatcacttcagctctggcagtttttggtagctcttctggatgacccttcaaattctcattttattgcctggactggtcgaggcatggaatttaaactgattgagcctgaagaggtggcccgacgttggggcattcagaaaaacaggccagctatgaactatgataaacttagccgttcactccgctattactatgagaaaggaattatgcaaaaggtggctggagagagatatgtctacaagtttgtgtgtgatccagaagcccttttctccatggcctttccagataatcagcgtccactgctgaagacagacatggaacgtcacatcaacgaggaggacacagtgcctctttctcactttgatgagagcatggcctacatgccggaagggggctgctgcaacccccacccctacaacgaaggctacgtgtattaacacaagtgacagtcaagcagggcgtttttgcgcttttccttttttctgcaagatacagagaattgctgaatctttgttttatttctgttgtttgtattttatttttaaataataatacacaaaaaggggcttttcctgttgcattattctatggtctgccatggactgtgcactttatttgagggtgggtgggagtaatctaaacatttattctgtgtaacaggaagctaatgggtgaatgggcagagggatttggggattactttttacttaggcttgggatggggtcctacaagttttgagtatgatgaaactatatcatgtctgtttgatttcataacaacataagataatgtttattttatcggggtatctatggtacagttaatttcacgttgtgtaaatatccacttggagactatttgccttgggcattttcccctgtcatttatgagtctctgcaggtgtacaaaaaaaccccaatctactgtaaatggcagtttaattgttagaaatgactgtttttgcaccacttgtaaaaaggtatttagcgattgcatttgctgtttgttgttttattttgctttatatatgacttgcagaggataaccataaaatgggtaattctctctgaagttgaataatcaccatgactgtaaatgaggggcacaattttggactctggcgccaaactgagtcataggccagtagcattacgtgtatctggtgccaccttgctgtttagatacaaatcataccgtcttttaaatattttgaagcccatttcagttaaataatgacatgtcatggtcctttggaatcttcatttaaatgttaaatctggaatcaaaatgaagcaaaaaatatctgtctccttttcactttcttcagtacataaatacattatttaatcaataagaattaactgtactaaatcatgtattatgctgttctagttacagcaaacactctttaagaaaaatatccaatacactaaataggtactatagtaatttttagacatggtacccattgatatgcatttaaaccttttactgctgtgttatgttgataacatatataaatattagataatgctaatgcttctgctgctgtcttttctgtaatattctctttcatgctgaatttactatgaccatttataagcagtgcagttaactacagatagcatttcaggacaaaatagatgactcaaaccatttattgcttaaaaaatagcttacgccatgctatgctataagcagcttttatgcacattgacaaatgaagagtaagcttcagcttgctaaaggaaactgtggaaccttttgtaacttttggtgatatggaaaattatttacaaaccgtcaaagaatatgaggaagttgctgtatgacatagtgctggcactgatattatccatcatctctttttggacacttctgtaaatgtgattggattgtttgaaagaagatttaaagtttcaaagttttttgttctgtttttgctttgcatttggagaaaatattgaaagcagggtatgttgtttcattcaccttgaaaaaaccatgagtaaatggggatatagaatctctgaatagctcgctaaaagattcaagcaagggacatgaattttgttccatctatcaataatatccagaagaacaacttttttaaagagtctatagcaaaaagcaaaaaaaaaaaaaaattctaaacacaaagtcaaaataaacctattgtaaaagcatttcgtgatgagcatgaaaaagattgtttaaagatgatccccccagctacccattttccaaaactacacagatcacagctcatttctctaagtggagcagttatcaagaaacccaaacaccaaaattgctactcttcacatttaatcctacaaaaagtactccaatttcaaaatatgtatgtaacctgcgatttcaatgattgttgttcatatacatcatgtattattttggcccattttgggcctaaaaaagaaaactatgccttaaaaatcagaaccttttctccccactatgcttatgtggccatctacagcacttagaataaaaacagatgttaaaatattcagtgaaagttttattggaaaaaggaattgagatatataattgagatttggtgaaattgaaggagaaaatttaagtgagtctttaaaatatattctgaatgaaaactgtattgaggattcatttttgttccttttttttctttttctcttttctcctttttcttctttttaatagtctagttttagtcagtcagtgaggaagaattgggccatgctaacgttatcacaagagaacaatggcagaaatggtattagttatataatatttaaggacaaactatatgttttgctgttttaacgtagtgactcactgaactaaatacataattgaccaacattaagtgtatttccaatacagaagggttgaaaatattacattataaactcttttgaaaaatgtatctaaaattttttaagttctgttttgattccactttttggttgagtttttatgtttttgttttcaggtagattaataaatctggcagctgatttctgcaagattcttgtgttttgaatttctcattgaattggctactcaaacatagaaatcatttgttaatgatgtaatgtcttctctcagcttttatcttcactgctgtttgctgtctcttgatgatgacatgttaatacccaatagattaattgcaacaaacacttatactcaaataactaagtaaaaataatttttcttgttatgtccatgaaaagtgcttcagaataaaaatccacaagactgacagtgcagaacatttttctcaaatcatgggcggatcttggaggtctagtttcccgtagatgctgtaaccaattaccacaacttcagtaatttacacaaatttatcttatagttctggaggcagaagttcaaaagaagccttaagagactaaaaccaagatgtccttaggtctggttccttctggaggctccaggggagattcttccagctttcacttctagagtctgctgacattccttggctcctggctacatcacttcaatctctgcttccatggtcacatactcttctactatagtcaaatttccttcctgcctcttataaggatgcttgtgattacatttaggggatgctcagataatccaggacaatctctccatctcaagatccttaacttaatgacgtgtgccaagtccctttggctagataattattcataggtcccagggattaggacatggatgtaaggggtgagggcagggctgttattcagaacaccgcacggaggaggaagactgtgtagcaaagactctaattgatttactcaggaacagtggagttctgctgagggatctaggatttgaaagtactagagtttgcttttatttaccactgagatattttccccttattctgcataaataattttgaaaactttctatattaaatttcaactattccactaaaatgtctggtaatcacatcaagcctttagattattcaaatccttccccagcccccaggaaaacactaagtcatgaaacagaaaaacagaaggtatgataataatagtaataacagttaaatcagtggtctaatccagattttattttttaatacatttcttttggtgttaatatgggttactatgtgatcttatcatttgctagtgattattacttattaggtaagaacaatgtgtaaaatatgtctattactcaaaagaacaattgcaaaatgagtcaacttatctttatataaccaggaaagaaatatattgccagaagctacagaattttgccagatgatagggatttctaaaatgagccactttgtctatcatgcagccttttcagagcttgtaatgagaaaacattacagaggagaaggtcatttggatgtttgttacttggaatcctagaaaacaaaaactaaaatttaaaaataagaagtgagtaagctattttccatttgcgatttggtatggagaagagaggaaatagaattattaaaaaaatacaaattgggtaaaagtgatggtggaaaaaatataaagaaggcaaatgtacatattaagcaattctactaagaattggaaaaatcaagtttcaaaaagatggtaatagttgggcatgatactagaaaatttcacccagtttattcagagctcaactagtacttttaggacttctttttttatatacatgagactcactttgacatacttaaaaaaaaaacagtttatggaaagtacagtttaagaggagaatttgattagactaagtggatatctttatagaaatattaatgatttcagaattttcagttacaagtgtatataccgtggctattgtttatggattcatatgtaaggtagggtcttttttgcatatagactccagtattagttactttcattctaaaattatatttatgcttctatggggaagaaaatttttaattcacttggttgtattaaaattatacttacggtttgagaaaacatgctatgaaaatcatgattatagcaaattaaatatgctcaaaatttaaatctaaaataaaagcccagaaactg

SEQ ID NO: 1520 - DNA, 6752 bp, Homo sapiens
aaggaaaccagcccaatagtggacctaacaccccaataatgggaactggcgactcgaaacacacggtttcagtatccccaggcgccttaacaataagcagcgggttacagaggaaatcgagtctctccgtggcgcttccaggctgaggacccagcgcctaccggccgagcaccccctagggcagaggggcgagggagacccgcgggaaggggcagcaagccgcctgattgacagcccgaaatctgatcttgtgaaagagacgcggagccaatgggaggcagcgatccatcagtttggattggaggcccctggaggagaagtagaggaaaaaccaccgaattgagctctgtcagaggcgctttcggcttccaagggggaagtgctgggctataattaatgtttttattaaatttggagggaagtttttgcagcctttcgcctagcgtggccttcagtcccgttaggtgcaaagcaagtctcgttgatcgccattgctagttttgcacacgtttgcgaatcagagctgcccggggtacaccgaccgcgcagggaaacatcgagagtgtaaataaatacatcgcctcttgttcggatttttgctactaccgaaaatatgtaaattgtgaactctgttggctctctttggatccaggttgatagaagtccagatcctgaggaaatctccagctaaatgctcaaaatataaaatactgagctgagatttgcgaagagcagcagcatggatggattttatgaccagcaagtgccttacatggtcaccaatagtcagcgtgggagaaattgtaacgagaaaccaacaaatgtcaggaaaagaaaattcattaacagagatctggctcatgattcagaagaactctttcaagatctaagtcaattacaggaaacatggcttgcagaagtggcttttcatggcctgccactgaaaatcaagaaagaaccccacagtccatgttcagaaatcagctctgcctgcagtcaagaacagccctttaaattcagctatggagaaaagtgcctgtacaatgtcagtgcctatgatcagaagccacaagtgggaatgaggccctccaacccccccacaccatccagcacgccagtgtccccactgcatcatgcatctccaaactcaactcatacaccgaaacctgaccgggccttcccagctcacctccctccatcgcagtccataccagatagcagctaccccatggaccacagatttcgccgccagctttctgaaccctgtaactcctttcctcctttgccgacgatgccaagggaaggacgtcctatgtaccaacgccagatgtctgagccaaacatccccttcccaccacaaggctttaagcaggagtaccacgacccagtgtatgaacacaacaccatggttggcagtgcggccagccaaagctttccccctcctctgatgattaaacaggaacccagagattttgcatatgactcagaagtgcctagctgccactccatttatatgaggcaagaaggcttcctggctcatcccagcagaacagaaggctgtatgtttgaaaagggccccaggcagttttatgatgacacctgtgttgtcccagaaaaattcgatggagacatcaaacaagagccaggaatgtatcgggaaggacccacataccaacggcgaggatcacttcagctctggcagtttttggtagctcttctggatgacccttcaaattctcattttattgcctggactggtcgaggcatggaatttaaactgattgagcctgaagaggtggcccgacgttggggcattcagaaaaacaggccagctatgaactatgataaacttagccgttcactccgctattactatgagaaaggaattatgcaaaaggtggctggagagagatatgtctacaagtttgtgtgtgatccagaagcccttttctccatggcctttccagataatcagcgtccactgctgaagacagacatggaacgtcacatcaacgaggaggacacagtgcctctttctcactttgatgagagcatggcctacatgccggaagggggctgctgcaacccccacccctacaacgaaggctacgtgtattaacacaagtgacagtcaagcagggcgtttttgcgcttttccttttttctgcaagatacagagaattgctgaatctttgttttatttctgttgtttgtattttatttttaaataataatacacaaaaaggggcttttcctgttgcattattctatggtctgccatggactgtgcactttatttgagggtgggtgggagtaatctaaacatttattctgtgtaacaggaagctaatgggtgaatgggcagagggatttggggattactttttacttaggcttgggatggggtcctacaagttttgagtatgatgaaactatatcatgtctgtttgatttcataacaacataagataatgtttattttatcggggtatctatggtacagttaatttcacgttgtgtaaatatccacttggagactatttgccttgggcattttcccctgtcatttatgagtctctgcaggtgtacaaaaaaaccccaatctactgtaaatggcagtttaattgttagaaatgactgtttttgcaccacttgtaaaaaggtatttagcgattgcatttgctgtttgttgttttattttgctttatatatgacttgcagaggataaccataaaatgggtaattctctctgaagttgaataatcaccatgactgtaaatgaggggcacaattttggactctggcgccaaactgagtcataggccagtagcattacgtgtatctggtgccaccttgctgtttagatacaaatcataccgtcttttaaatattttgaagcccatttcagttaaataatgacatgtcatggtcctttggaatcttcatttaaatgttaaatctggaatcaaaatgaagcaaaaaatatctgtctccttttcactttcttcagtacataaatacattatttaatcaataagaattaactgtactaaatcatgtattatgctgttctagttacagcaaacactctttaagaaaaatatccaatacactaaataggtactatagtaatttttagacatggtacccattgatatgcatttaaaccttttactgctgtgttatgttgataacatatataaatattagataatgctaatgcttctgctgctgtcttttctgtaatattctctttcatgctgaatttactatgaccatttataagcagtgcagttaactacagatagcatttcaggacaaaatagatgactcaaaccatttattgcttaaaaaatagcttacgccatgctatgctataagcagcttttatgcacattgacaaatgaagagtaagcttcagcttgctaaaggaaactgtggaaccttttgtaacttttggtgatatggaaaattatttacaaaccgtcaaagaatatgaggaagttgctgtatgacatagtgctggcactgatattatccatcatctctttttggacacttctgtaaatgtgattggattgtttgaaagaagatttaaagtttcaaagttttttgttctgtttttgctttgcatttggagaaaatattgaaagcagggtatgttgtttcattcaccttgaaaaaaccatgagtaaatggggatatagaatctctgaatagctcgctaaaagattcaagcaagggacatgaattttgttccatctatcaataatatccagaagaacaacttttttaaagagtctatagcaaaaagcaaaaaaaaaaaaaaattctaaacacaaagtcaaaataaacctattgtaaaagcatttcgtgatgagcatgaaaaagattgtttaaagatgatccccccagctacccattttccaaaactacacagatcacagctcatttctctaagtggagcagttatcaagaaacccaaacaccaaaattgctactcttcacatttaatcctacaaaaagtactccaatttcaaaatatgtatgtaacctgcgatttcaatgattgttgttcatatacatcatgtattattttggcccattttgggcctaaaaaagaaaactatgccttaaaaatcagaaccttttctccccactatgcttatgtggccatctacagcacttagaataaaaacagatgttaaaatattcagtgaaagttttattggaaaaaggaattgagatatataattgagatttggtgaaattgaaggagaaaatttaagtgagtctttaaaatatattctgaatgaaaactgtattgaggattcatttttgttccttttttttctttttctcttttctcctttttcttctttttaatagtctagttttagtcagtcagtgaggaagaattgggccatgctaacgttatcacaagagaacaatggcagaaatggtattagttatataatatttaaggacaaactatatgttttgctgttttaacgtagtgactcactgaactaaatacataattgaccaacattaagtgtatttccaatacagaagggttgaaaatattacattataaactcttttgaaaaatgtatctaaaattttttaagttctgttttgattccactttttggttgagtttttatgtttttgttttcaggtagattaataaatctggcagctgatttctgcaagattcttgtgttttgaatttctcattgaattggctactcaaacatagaaatcatttgttaatgatgtaatgtcttctctcagcttttatcttcactgctgtttgctgtctcttgatgatgacatgttaatacccaatagattaattgcaacaaacacttatactcaaataactaagtaaaaataatttttcttgttatgtccatgaaaagtgcttcagaataaaaatccacaagactgacagtgcagaacatttttctcaaatcatgggcggatcttggaggtctagtttcccgtagatgctgtaaccaattaccacaacttcagtaatttacacaaatttatcttatagttctggaggcagaagttcaaaagaagccttaagagactaaaaccaagatgtccttaggtctggttccttctggaggctccaggggagattcttccagctttcacttctagagtctgctgacattccttggctcctggctacatcacttcaatctctgcttccatggtcacatactcttctactatagtcaaatttccttcctgcctcttataaggatgcttgtgattacatttaggggatgctcagataatccaggacaatctctccatctcaagatccttaacttaatgacgtgtgccaagtccctttggctagataattattcataggtcccagggattaggacatggatgtaaggggtgagggcagggctgttattcagaacaccgcacggaggaggaagactgtgtagcaaagactctaattgatttactcaggaacagtggagttctgctgagggatctaggatttgaaagtactagagtttgcttttatttaccactgagatattttccccttattctgcataaataattttgaaaactttctatattaaatttcaactattccactaaaatgtctggtaatcacatcaagcctttagattattcaaatccttccccagcccccaggaaaacactaagtcatgaaacagaaaaacagaaggtatgataataatagtaataacagttaaatcagtggtctaatccagattttattttttaatacatttcttttggtgttaatatgggttactatgtgatcttatcatttgctagtgattattacttattaggtaagaacaatgtgtaaaatatgtctattactcaaaagaacaattgcaaaatgagtcaacttatctttatataaccaggaaagaaatatattgccagaagctacagaattttgccagatgatagggatttctaaaatgagccactttgtctatcatgcagccttttcagagcttgtaatgagaaaacattacagaggagaaggtcatttggatgtttgttacttggaatcctagaaaacaaaaactaaaatttaaaaataagaagtgagtaagctattttccatttgcgatttggtatggagaagagaggaaatagaattattaaaaaaatacaaattgggtaaaagtgatggtggaaaaaatataaagaaggcaaatgtacatattaagcaattctactaagaattggaaaaatcaagtttcaaaaagatggtaatagttgggcatgatactagaaaatttcacccagtttattcagagctcaactagtacttttaggacttctttttttatatacatgagactcactttgacatacttaaaaaaaaaacagtttatggaaagtacagtttaagaggagaatttgattagactaagtggatatctttatagaaatattaatgatttcagaattttcagttacaagtgtatataccgtggctattgtttatggattcatatgtaaggtagggtcttttttgcatatagactccagtattagttactttcattctaaaattatatttatgcttctatggggaagaaaatttttaattcacttggttgtattaaaattatacttacggtttgagaaaacatgctatgaaaatcatgattatagcaaattaaatatgctcaaaatttaaatctaaaataaaagcccagaaactg

SEQ ID NO: 1521 - DNA, 6096 bp, Homo sapiens
gtcatgcatacattagagcctctgatgagtttgtctttggggactctggggctgtactacccagtgtcatcacaaattaccaggagaaattgcttccagctcacaatcacatctgcttttggcaagaactaatgcaccaagacttcaagttctaagcctctgttcagattttaattgcaattgatcaggtttatattattgtacctccagagacctcctagagccagaacccggctggcttgctgtttcctttagagcagcgcatatcattatttggtgttctggtggaggacttttctgatggcagaaattagtttctctgggttcatcaggacgggatgcttcaagatttaagtgcaagtgtcttctttccaccttgttcacaacacagaacgttagctcaggtacctgacaatgatgagcagtttgtaccagactatcaggctgaaagtttggcttttcatggcctgccactgaaaatcaagaaagaaccccacagtccatgttcagaaatcagctctgcctgcagtcaagaacagccctttaaattcagctatggagaaaagtgcctgtacaatgtcagatttcgccgccagctttctgaaccctgtaactcctttcctcctttgccgacgatgccaagggaaggacgtcctatgtaccaacgccagatgtctgagccaaacatccccttcccaccacaaggctttaagcaggagtaccacgacccagtgtatgaacacaacaccatggttggcagtgcggccagccaaagctttccccctcctctgatgattaaacaggaacccagagattttgcatatgactcagaagtgcctagctgccactccatttatatgaggcaagaaggcttcctggctcatcccagcagaacagaaggctgtatgtttgaaaagggccccaggcagttttatgatgacacctgtgttgtcccagaaaaattcgatggagacatcaaacaagagccaggaatgtatcgggaaggacccacataccaacggcgaggatcacttcagctctggcagtttttggtagctcttctggatgacccttcaaattctcattttattgcctggactggtcgaggcatggaatttaaactgattgagcctgaagaggtggcccgacgttggggcattcagaaaaacaggccagctatgaactatgataaacttagccgttcactccgctattactatgagaaaggaattatgcaaaaggtggctggagagagatatgtctacaagtttgtgtgtgatccagaagcccttttctccatggcctttccagataatcagcgtccactgctgaagacagacatggaacgtcacatcaacgaggaggacacagtgcctctttctcactttgatgagagcatggcctacatgccggaagggggctgctgcaacccccacccctacaacgaaggctacgtgtattaacacaagtgacagtcaagcagggcgtttttgcgcttttccttttttctgcaagatacagagaattgctgaatctttgttttatttctgttgtttgtattttatttttaaataataatacacaaaaaggggcttttcctgttgcattattctatggtctgccatggactgtgcactttatttgagggtgggtgggagtaatctaaacatttattctgtgtaacaggaagctaatgggtgaatgggcagagggatttggggattactttttacttaggcttgggatggggtcctacaagttttgagtatgatgaaactatatcatgtctgtttgatttcataacaacataagataatgtttattttatcggggtatctatggtacagttaatttcacgttgtgtaaatatccacttggagactatttgccttgggcattttcccctgtcatttatgagtctctgcaggtgtacaaaaaaaccccaatctactgtaaatggcagtttaattgttagaaatgactgtttttgcaccacttgtaaaaaggtatttagcgattgcatttgctgtttgttgttttattttgctttatatatgacttgcagaggataaccataaaatgggtaattctctctgaagttgaataatcaccatgactgtaaatgaggggcacaattttggactctggcgccaaactgagtcataggccagtagcattacgtgtatctggtgccaccttgctgtttagatacaaatcataccgtcttttaaatattttgaagcccatttcagttaaataatgacatgtcatggtcctttggaatcttcatttaaatgttaaatctggaatcaaaatgaagcaaaaaatatctgtctccttttcactttcttcagtacataaatacattatttaatcaataagaattaactgtactaaatcatgtattatgctgttctagttacagcaaacactctttaagaaaaatatccaatacactaaataggtactatagtaatttttagacatggtacccattgatatgcatttaaaccttttactgctgtgttatgttgataacatatataaatattagataatgctaatgcttctgctgctgtcttttctgtaatattctctttcatgctgaatttactatgaccatttataagcagtgcagttaactacagatagcatttcaggacaaaatagatgactcaaaccatttattgcttaaaaaatagcttacgccatgctatgctataagcagcttttatgcacattgacaaatgaagagtaagcttcagcttgctaaaggaaactgtggaaccttttgtaacttttggtgatatggaaaattatttacaaaccgtcaaagaatatgaggaagttgctgtatgacatagtgctggcactgatattatccatcatctctttttggacacttctgtaaatgtgattggattgtttgaaagaagatttaaagtttcaaagttttttgttctgtttttgctttgcatttggagaaaatattgaaagcagggtatgttgtttcattcaccttgaaaaaaccatgagtaaatggggatatagaatctctgaatagctcgctaaaagattcaagcaagggacatgaattttgttccatctatcaataatatccagaagaacaacttttttaaagagtctatagcaaaaagcaaaaaaaaaaaaaaattctaaacacaaagtcaaaataaacctattgtaaaagcatttcgtgatgagcatgaaaaagattgtttaaagatgatccccccagctacccattttccaaaactacacagatcacagctcatttctctaagtggagcagttatcaagaaacccaaacaccaaaattgctactcttcacatttaatcctacaaaaagtactccaatttcaaaatatgtatgtaacctgcgatttcaatgattgttgttcatatacatcatgtattattttggcccattttgggcctaaaaaagaaaactatgccttaaaaatcagaaccttttctccccactatgcttatgtggccatctacagcacttagaataaaaacagatgttaaaatattcagtgaaagttttattggaaaaaggaattgagatatataattgagatttggtgaaattgaaggagaaaatttaagtgagtctttaaaatatattctgaatgaaaactgtattgaggattcatttttgttccttttttttctttttctcttttctcctttttcttctttttaatagtctagttttagtcagtcagtgaggaagaattgggccatgctaacgttatcacaagagaacaatggcagaaatggtattagttatataatatttaaggacaaactatatgttttgctgttttaacgtagtgactcactgaactaaatacataattgaccaacattaagtgtatttccaatacagaagggttgaaaatattacattataaactcttttgaaaaatgtatctaaaattttttaagttctgttttgattccactttttggttgagtttttatgtttttgttttcaggtagattaataaatctggcagctgatttctgcaagattcttgtgttttgaatttctcattgaattggctactcaaacatagaaatcatttgttaatgatgtaatgtcttctctcagcttttatcttcactgctgtttgctgtctcttgatgatgacatgttaatacccaatagattaattgcaacaaacacttatactcaaataactaagtaaaaataatttttcttgttatgtccatgaaaagtgcttcagaataaaaatccacaagactgacagtgcagaacatttttctcaaatcatgggcggatcttggaggtctagtttcccgtagatgctgtaaccaattaccacaacttcagtaatttacacaaatttatcttatagttctggaggcagaagttcaaaagaagccttaagagactaaaaccaagatgtccttaggtctggttccttctggaggctccaggggagattcttccagctttcacttctagagtctgctgacattccttggctcctggctacatcacttcaatctctgcttccatggtcacatactcttctactatagtcaaatttccttcctgcctcttataaggatgcttgtgattacatttaggggatgctcagataatccaggacaatctctccatctcaagatccttaacttaatgacgtgtgccaagtccctttggctagataattattcataggtcccagggattaggacatggatgtaaggggtgagggcagggctgttattcagaacaccgcacggaggaggaagactgtgtagcaaagactctaattgatttactcaggaacagtggagttctgctgagggatctaggatttgaaagtactagagtttgcttttatttaccactgagatattttccccttattctgcataaataattttgaaaactttctatattaaatttcaactattccactaaaatgtctggtaatcacatcaagcctttagattattcaaatccttccccagcccccaggaaaacactaagtcatgaaacagaaaaacagaaggtatgataataatagtaataacagttaaatcagtggtctaatccagattttattttttaatacatttcttttggtgttaatatgggttactatgtgatcttatcatttgctagtgattattacttattaggtaagaacaatgtgtaaaatatgtctattactcaaaagaacaattgcaaaatgagtcaacttatctttatataaccaggaaagaaatatattgccagaagctacagaattttgccagatgatagggatttctaaaatgagccactttgtctatcatgcagccttttcagagcttgtaatgagaaaacattacagaggagaaggtcatttggatgtttgttacttggaatcctagaaaacaaaaactaaaatttaaaaataagaagtgagtaagctattttccatttgcgatttggtatggagaagagaggaaatagaattattaaaaaaatacaaattgggtaaaagtgatggtggaaaaaatataaagaaggcaaatgtacatattaagcaattctactaagaattggaaaaatcaagtttcaaaaagatggtaatagttgggcatgatactagaaaatttcacccagtttattcagagctcaactagtacttttaggacttctttttttatatacatgagactcactttgacatacttaaaaaaaaaacagtttatggaaagtacagtttaagaggagaatttgattagactaagtggatatctttatagaaatattaatgatttcagaattttcagttacaagtgtatataccgtggctattgtttatggattcatatgtaaggtagggtcttttttgcatatagactccagtattagttactttcattctaaaattatatttatgcttctatggggaagaaaatttttaattcacttggttgtattaaaattatacttacggtttgagaaaacatgctatgaaaatcatgattatagcaaattaaatatgctcaaaatttaaatctaaaataaaagcccagaaactg

SEQ ID NO: 1522 - DNA, 1603 bp, Homo sapiens
accccctgcttggttgcaccctcagatagtacccatgagcttcactgttcagcctcggggcccaggcgcttcctggaatctctccttggccggggttaaaatgcagttcccgctcaaaatgcttataggttgatagaagtccagatcctgaggaaatctccagctaaatgctcaaaatataaaatactgagctgagatttgcgaagagcagcagcatggatggattttatgaccagcaagtgccttacatggtcaccaatagtcagcgtgggagaaattgtaacgagaaaccaacaaatgtcaggaaaagaaaattcattaacagagatctggctcatgattcagaagaactctttcaagatctaagtcaattacaggaaacatggcttgcagaagtggcttttcatggcctgccactgaaaatcaagaaagaaccccacagtccatgttcagaaatcagctctgcctgcagtcaagaacagccctttaaattcagctatggagaaaagtgcctgtacaatgtcagtgcctatgatcagaagccacaagtgggaatgaggccctccaacccccccacaccatccagcacgccagtgtccccactgcatcatgcatctccaaactcaactcatacaccgaaacctgaccgggccttcccagctcacctccctccatcgcagtccataccagatagcagctaccccatggaccacagatttcgccgccagctttctgaaccctgtaactcctttcctcctttgccgacgatgccaagggaaggacgtcctatgtaccaacgccagatgtctgagccaaacatccccttcccaccacaaggctttaagcaggagtaccacgacccagtgtatgaacacaacaccatggttggcagtgcggccagccaaagctttccccctcctctgatgattaaacaggaacccagagattttgcatatgactcagaagtgcctagctgccactccatttatatgaggcaagaaggcttcctggctcatcccagcagaacagaaggctgtatgtttgaaaagggccccaggcagttttatgatgacacctgtgttgtcccagaaaaattcgatggagacatcaaacaagagccaggaatgtatcgggaaggacccacataccaacggcgaggatcacttcagctctggcagtttttggtagctcttctggatgacccttcaaattctcattttattgcctggactggtcgaggcatggaatttaaactgattgagcctgaagaggtggcccgacgttggggcattcagaaaaacaggccagctatgaactatgataaacttagccgttcactccgctattactatgagaaaggaattatgcaaaaggtggctggagagagatatgtctacaagtttgtgtgtgatccagaagcccttttctccatggcctttccagataatcagcgtccactgctgaagacagacatggaacgtcacatcaacgaggaggacacagtgcctctttctcactttgatgagagcatggcctacatgccggaagggggctgctgcaacccccacccctacaacgaaggctacgtgtattaacacaagtg

SEQ ID NO: 1523 - DNA, 3391 bp, Homo sapiens
agtatccccaggcgccttaacaataagcagcgggttacagaggaaatcgagtctctccgtggcgcttccaggctgaggacccagcgcctaccggccgagcaccccctagggcagaggggcgagggagacccgcgggaaggggcagcaagccgcctgattgacagcccgaaatctgatcttgtgaaagagacgcggagccaatgggaggcagcgatccatcagtttggattggaggcccctggaggagaagtagaggaaaaaccaccgaattgagctctgtcagaggcgctttcggcttccaagggggaagtgctgggctataattaatgtttttattaaatttggagggaagtttttgcagcctttcgcctagcgtggccttcaggttgatagaagtccagatcctgaggaaatctccagctaaatgctcaaaatataaaatactgagctgagatttgcgaagagcagcagcatggatggattttatgaccagcaagtgccttacatggtcaccaatagtcagcgtgggagaaattgtaacgagaaaccaacaaatgtcaggaaaagaaaattcattaacagagatctggctcatgattcagaagaactctttcaagatctaagtcaattacaggaaacatggcttgcagaagctcaggtacctgacaatgatgagcagtttgtaccagactatcaggctgaaagtttggcttttcatggcctgccactgaaaatcaagaaagaaccccacagtccatgttcagaaatcagctctgcctgcagtcaagaacagccctttaaattcagctatggagaaaagtgcctgtacaatgtcagtgcctatgatcagaagccacaagtgggaatgaggccctccaacccccccacaccatccagcacgccagtgtccccactgcatcatgcatctccaaactcaactcatacaccgaaacctgaccgggccttcccagctcacctccctccatcgcagtccataccagatagcagctaccccatggaccacagatttcgccgccagctttctgaaccctgtaactcctttcctcctttgccgacgatgccaagggaaggacgtcctatgtaccaacgccagatgtctgagccaaacatccccttcccaccacaaggctttaagcaggagtaccacgacccagtgtatgaacacaacaccatggttggcagtgcggccagccaaagctttccccctcctctgatgattaaacaggaacccagagattttgcatatgactcagaagtgcctagctgccactccatttatatgaggcaagaaggcttcctggctcatcccagcagaacagaaggctgtatgtttgaaaagggccccaggcagttttatgatgacacctgtgttgtcccagaaaaattcgatggagacatcaaacaagagccaggaatgtatcgggaaggacccacataccaacggcgaggatcacttcagctctggcagtttttggtagctcttctggatgacccttcaaattctcattttattgcctggactggtcgaggcatggaatttaaactgattgagcctgaagaggtggcccgacgttggggcattcagaaaaacaggccagctatgaactatgataaacttagccgttcactccgctattactatgagaaaggaattatgcaaaaggtggctggagagagatatgtctacaagtttgtgtgtgatccagaagcccttttctccatggcctttccagataatcagcgtccactgctgaagacagacatggaacgtcacatcaacgaggaggacacagtgcctctttctcactttgatgagagcatggcctacatgccggaagggggctgctgcaacccccacccctacaacgaaggctacgtgtattaacacaagtgacagtcaagcagggcgtttttgcgcttttccttttttctgcaagatacagagaattgctgaatctttgttttatttctgttgtttgtattttatttttaaataataatacacaaaaaggggcttttcctgttgcattattctatggtctgccatggactgtgcactttatttgagggtgggtgggagtaatctaaacatttattctgtgtaacaggaagctaatgggtgaatgggcagagggatttggggattactttttacttaggcttgggatggggtcctacaagttttgagtatgatgaaactatatcatgtctgtttgatttcataacaacataagataatgtttattttatcggggtatctatggtacagttaatttcacgttgtgtaaatatccacttggagactatttgccttgggcattttcccctgtcatttatgagtctctgcaggtgtacaaaaaaaccccaatctactgtaaatggcagtttaattgttagaaatgactgtttttgcaccacttgtaaaaaggtatttagcgattgcatttgctgtttgttgttttattttgctttatatatgacttgcagaggataaccataaaatgggtaattctctctgaagttgaataatcaccatgactgtaaatgaggggcacaattttggactctggcgccaaactgagtcataggccagtagcattacgtgtatctggtgccaccttgctgtttagatacaaatcataccgtcttttaaatattttgaagcccatttcagttaaataatgacatgtcatggtcctttggaatcttcatttaaatgttaaatctggaatcaaaatgaagcaaaaaatatctgtctccttttcactttcttcagtacataaatacattatttaatcaataagaattaactgtactaaatcatgtattatgctgttctagttacagcaaacactctttaagaaaaatatccaatacactaaataggtactatagtaatttttagacatggtacccattgatatgcatttaaaccttttactgctgtgttatgttgataacatatataaatattagataatgctaatgcttctgctgctgtcttttctgtaatattctctttcatgctgaatttactatgaccatttataagcagtgcagttaactacagatagcatttcaggacaaaatagatgactcaaaccatttattgcttaaaaaatagcttacgccatgctatgctataagcagcttttatgcacattgacaaatgaagagtaagcttcagcttgctaaaggaaactgtggaaccttttgtaacttttggtgatatggaaaattatttacaaaccgtcaaagaatatgaggaagttgctgtatgacatagtgctggcactgatattatccatcatctctttttggacacttctgtaaatgtgattggattgtttgaaagaagatttaaagtttc

SEQ ID NO: 1524 - DNA, 6231 bp, Homo sapiens
gtcatgcatacattagagcctctgatgagtttgtctttggggactctggggctgtactacccagtgtcatcacaaattaccaggagaaattgcttccagctcacaatcacatctgcttttggcaagaactaatgcaccaagacttcaagttctaagcctctgttcagattttaattgcaattgatcaggtttatattattgtacctccagagacctcctagagccagaacccggctggcttgctgtttcctttagagcagcgcatatcattatttggtgttctggtggaggacttttctgatggcagaaattagtttctctgggttcatcaggacgggatgcttcaagatttaagtgcaagtgtcttctttccaccttgttcacaacacagaacgttagtggcttttcatggcctgccactgaaaatcaagaaagaaccccacagtccatgttcagaaatcagctctgcctgcagtcaagaacagccctttaaattcagctatggagaaaagtgcctgtacaatgtcagtgcctatgatcagaagccacaagtgggaatgaggccctccaacccccccacaccatccagcacgccagtgtccccactgcatcatgcatctccaaactcaactcatacaccgaaacctgaccgggccttcccagctcacctccctccatcgcagtccataccagatagcagctaccccatggaccacagatttcgccgccagctttctgaaccctgtaactcctttcctcctttgccgacgatgccaagggaaggacgtcctatgtaccaacgccagatgtctgagccaaacatccccttcccaccacaaggctttaagcaggagtaccacgacccagtgtatgaacacaacaccatggttggcagtgcggccagccaaagctttccccctcctctgatgattaaacaggaacccagagattttgcatatgactcagaagtgcctagctgccactccatttatatgaggcaagaaggcttcctggctcatcccagcagaacagaaggctgtatgtttgaaaagggccccaggcagttttatgatgacacctgtgttgtcccagaaaaattcgatggagacatcaaacaagagccaggaatgtatcgggaaggacccacataccaacggcgaggatcacttcagctctggcagtttttggtagctcttctggatgacccttcaaattctcattttattgcctggactggtcgaggcatggaatttaaactgattgagcctgaagaggtggcccgacgttggggcattcagaaaaacaggccagctatgaactatgataaacttagccgttcactccgctattactatgagaaaggaattatgcaaaaggtggctggagagagatatgtctacaagtttgtgtgtgatccagaagcccttttctccatggcctttccagataatcagcgtccactgctgaagacagacatggaacgtcacatcaacgaggaggacacagtgcctctttctcactttgatgagagcatggcctacatgccggaagggggctgctgcaacccccacccctacaacgaaggctacgtgtattaacacaagtgacagtcaagcagggcgtttttgcgcttttccttttttctgcaagatacagagaattgctgaatctttgttttatttctgttgtttgtattttatttttaaataataatacacaaaaaggggcttttcctgttgcattattctatggtctgccatggactgtgcactttatttgagggtgggtgggagtaatctaaacatttattctgtgtaacaggaagctaatgggtgaatgggcagagggatttggggattactttttacttaggcttgggatggggtcctacaagttttgagtatgatgaaactatatcatgtctgtttgatttcataacaacataagataatgtttattttatcggggtatctatggtacagttaatttcacgttgtgtaaatatccacttggagactatttgccttgggcattttcccctgtcatttatgagtctctgcaggtgtacaaaaaaaccccaatctactgtaaatggcagtttaattgttagaaatgactgtttttgcaccacttgtaaaaaggtatttagcgattgcatttgctgtttgttgttttattttgctttatatatgacttgcagaggataaccataaaatgggtaattctctctgaagttgaataatcaccatgactgtaaatgaggggcacaattttggactctggcgccaaactgagtcataggccagtagcattacgtgtatctggtgccaccttgctgtttagatacaaatcataccgtcttttaaatattttgaagcccatttcagttaaataatgacatgtcatggtcctttggaatcttcatttaaatgttaaatctggaatcaaaatgaagcaaaaaatatctgtctccttttcactttcttcagtacataaatacattatttaatcaataagaattaactgtactaaatcatgtattatgctgttctagttacagcaaacactctttaagaaaaatatccaatacactaaataggtactatagtaatttttagacatggtacccattgatatgcatttaaaccttttactgctgtgttatgttgataacatatataaatattagataatgctaatgcttctgctgctgtcttttctgtaatattctctttcatgctgaatttactatgaccatttataagcagtgcagttaactacagatagcatttcaggacaaaatagatgactcaaaccatttattgcttaaaaaatagcttacgccatgctatgctataagcagcttttatgcacattgacaaatgaagagtaagcttcagcttgctaaaggaaactgtggaaccttttgtaacttttggtgatatggaaaattatttacaaaccgtcaaagaatatgaggaagttgctgtatgacatagtgctggcactgatattatccatcatctctttttggacacttctgtaaatgtgattggattgtttgaaagaagatttaaagtttcaaagttttttgttctgtttttgctttgcatttggagaaaatattgaaagcagggtatgttgtttcattcaccttgaaaaaaccatgagtaaatggggatatagaatctctgaatagctcgctaaaagattcaagcaagggacatgaattttgttccatctatcaataatatccagaagaacaacttttttaaagagtctatagcaaaaagcaaaaaaaaaaaaaaattctaaacacaaagtcaaaataaacctattgtaaaagcatttcgtgatgagcatgaaaaagattgtttaaagatgatccccccagctacccattttccaaaactacacagatcacagctcatttctctaagtggagcagttatcaagaaacccaaacaccaaaattgctactcttcacatttaatcctacaaaaagtactccaatttcaaaatatgtatgtaacctgcgatttcaatgattgttgttcatatacatcatgtattattttggcccattttgggcctaaaaaagaaaactatgccttaaaaatcagaaccttttctccccactatgcttatgtggccatctacagcacttagaataaaaacagatgttaaaatattcagtgaaagttttattggaaaaaggaattgagatatataattgagatttggtgaaattgaaggagaaaatttaagtgagtctttaaaatatattctgaatgaaaactgtattgaggattcatttttgttccttttttttctttttctcttttctcctttttcttctttttaatagtctagttttagtcagtcagtgaggaagaattgggccatgctaacgttatcacaagagaacaatggcagaaatggtattagttatataatatttaaggacaaactatatgttttgctgttttaacgtagtgactcactgaactaaatacataattgaccaacattaagtgtatttccaatacagaagggttgaaaatattacattataaactcttttgaaaaatgtatctaaaattttttaagttctgttttgattccactttttggttgagtttttatgtttttgttttcaggtagattaataaatctggcagctgatttctgcaagattcttgtgttttgaatttctcattgaattggctactcaaacatagaaatcatttgttaatgatgtaatgtcttctctcagcttttatcttcactgctgtttgctgtctcttgatgatgacatgttaatacccaatagattaattgcaacaaacacttatactcaaataactaagtaaaaataatttttcttgttatgtccatgaaaagtgcttcagaataaaaatccacaagactgacagtgcagaacatttttctcaaatcatgggcggatcttggaggtctagtttcccgtagatgctgtaaccaattaccacaacttcagtaatttacacaaatttatcttatagttctggaggcagaagttcaaaagaagccttaagagactaaaaccaagatgtccttaggtctggttccttctggaggctccaggggagattcttccagctttcacttctagagtctgctgacattccttggctcctggctacatcacttcaatctctgcttccatggtcacatactcttctactatagtcaaatttccttcctgcctcttataaggatgcttgtgattacatttaggggatgctcagataatccaggacaatctctccatctcaagatccttaacttaatgacgtgtgccaagtccctttggctagataattattcataggtcccagggattaggacatggatgtaaggggtgagggcagggctgttattcagaacaccgcacggaggaggaagactgtgtagcaaagactctaattgatttactcaggaacagtggagttctgctgagggatctaggatttgaaagtactagagtttgcttttatttaccactgagatattttccccttattctgcataaataattttgaaaactttctatattaaatttcaactattccactaaaatgtctggtaatcacatcaagcctttagattattcaaatccttccccagcccccaggaaaacactaagtcatgaaacagaaaaacagaaggtatgataataatagtaataacagttaaatcagtggtctaatccagattttattttttaatacatttcttttggtgttaatatgggttactatgtgatcttatcatttgctagtgattattacttattaggtaagaacaatgtgtaaaatatgtctattactcaaaagaacaattgcaaaatgagtcaacttatctttatataaccaggaaagaaatatattgccagaagctacagaattttgccagatgatagggatttctaaaatgagccactttgtctatcatgcagccttttcagagcttgtaatgagaaaacattacagaggagaaggtcatttggatgtttgttacttggaatcctagaaaacaaaaactaaaatttaaaaataagaagtgagtaagctattttccatttgcgatttggtatggagaagagaggaaatagaattattaaaaaaatacaaattgggtaaaagtgatggtggaaaaaatataaagaaggcaaatgtacatattaagcaattctactaagaattggaaaaatcaagtttcaaaaagatggtaatagttgggcatgatactagaaaatttcacccagtttattcagagctcaactagtacttttaggacttctttttttatatacatgagactcactttgacatacttaaaaaaaaaacagtttatggaaagtacagtttaagaggagaatttgattagactaagtggatatctttatagaaatattaatgatttcagaattttcagttacaagtgtatataccgtggctattgtttatggattcatatgtaaggtagggtcttttttgcatatagactccagtattagttactttcattctaaaattatatttatgcttctatggggaagaaaatttttaattcacttggttgtattaaaattatacttacggtttgagaaaacatgctatgaaaatcatgattatagcaaattaaatatgctcaaaatttaaatctaaaataaaagcccagaaactg

SEQ ID NO: 1525 - DNA, 554 bp, Homo sapiens
cgttattggctgcgggaagaacctcgccgggacctaacccgaagctccgccccctcgcggttaccctggatacccgtcaggctcgggctgcagagaaggttgatagaagtccagatcctgaggaaatctccagctaaatgctcaaaatataaaatactgagctgagatttgcgaagagcagcagcatggatggattttatgaccagcaagtgccttacatggtcaccaatagtcagcgtgggagaaattgtaacgagaaaccaacaaatgtcaggaaaagaaaattcattaacagagatctggctcatgattcagaagaactctttcaagatctaagtcaattacaggaaacatggcttgcagaagctcaggtacctgacaatgatgagcagtttgtaccagactatcaggctgaaagtttggcttttcatggcctgccactgaaaatcaagaaagaaccccacagtccatgttcagaaatcagctctgcctgcagtcaagaacagccctttaaattcagctatggagaaaagtgcctgtacaatgtcagtgcc

SEQ ID NO: 1526 - DNA, 6740 bp, Homo sapiens
gtatccccaggcgccttaacaataagcagcgggttacagaggaaatcgagtctctccgtggcgcttccaggctgaggacccagcgcctaccggccgagcaccccctagggcagaggggcgagggagacccgcgggaaggggcagcaagccgcctgattgacagcccgaaatctgatcttgtgaaagagacgcggagccaatgggaggcagcgatccatcagtttggattggaggcccctggaggagaagtagaggaaaaaccaccgaattgagctctgtcagaggcgctttcggcttccaagggggaagtgctgggctataattaatgtttttattaaatttggagggaagtttttgcagcctttcgcctagcgtggccttcagtcccgttaggtgcaaagcaagtctcgttgatcgccattgctagttttgcacacgtttgcgaatcagagctgcccggggtacaccgaccgcgcagggaaacatcgagagtgtaaataaatacatcgcctcttgttcggatttttgctactaccgaaaatatgtaaattgtgaactctgttggctctctttggatccaggttgatagaagtccagatcctgaggaaatctccagctaaatgctcaaaatataaaatactgagctgagatttgcgaagagcagcagcatggatggattttatgaccagcaagtgccttacatggtcaccaatagtcagcgtgggagaaattgtaacgagaaaccaacaaatgtcaggaaaagaaaattcattaacagagatctggctcatgattcagaagaactctttcaagatctaagtcaattacaggaaacatggcttgcagaagctcaggtacctgacaatgatgagcagtttgtaccagactatcaggctgaaagtttggcttttcatggcctgccactgaaaatcaagaaagaaccccacagtccatgttcagaaatcagctctgcctgcagtcaagaacagccctttaaattcagctatggagaaaagtgcctgtacaatgtcagtgcctatgatcagaagccacaagtgggaatgaggccctccaacccccccacaccatccagcacgccagtgtccccactgcatcatgcatctccaaactcaactcatacaccgaaacctgaccgggccttcccagctcacctccctccatcgcagtccataccagatagcagctaccccatggaccacagatttcgccgccagctttctgaaccctgtaactcctttcctcctttgccgacgatgccaagggaaggacgtcctatgtaccaacgccagatgtctgagccaaacatccccttcccaccacaaggctttaagcaggagtaccacgacccagtgtatgaacacaacaccatggttggcagtgcggccagccaaagctttccccctcctctgatgattaaacaggaacccagagattttgcatatgactcagaagtgcctagctgccactccatttatatgaggcaagaaggcttcctggctcatcccagcagaacagaaggctgtatgtttgaaaagggccccaggcagttttatgatgacacctgtgttgtcccagaaaaattcgatggagacatcaaacaagagccaggaatgtatcgggaaggacccacataccaacggcgaggatcacttcagctctggcagtttttggtagctcttctggatgacccttcaaattctcattttattgcctggactggtcgaggcatggaatttaaactgattgagcctgaagaggtggcccgacgttggggcattcagaaaaacaggccagctatgaactatgataaacttagccgttcactccgctattactatgagaaaggaattatgcaaaaggtggctggagagagatatgtctacaagtttgtgtgtgatccagaagcccttttctccatggcctttccagataatcagcgtccactgctgaagacagacatggaacgtcacatcaacgaggaggacacagtgcctctttctcactttgatgagagcatggcctacatgccggaagggggctgctgcaacccccacccctacaacgaaggctacgtgtattaacacaagtgacagtcaagcagggcgtttttgcgcttttccttttttctgcaagatacagagaattgctgaatctttgttttatttctgttgtttgtattttatttttaaataataatacacaaaaaggggcttttcctgttgcattattctatggtctgccatggactgtgcactttatttgagggtgggtgggagtaatctaaacatttattctgtgtaacaggaagctaatgggtgaatgggcagagggatttggggattactttttacttaggcttgggatggggtcctacaagttttgagtatgatgaaactatatcatgtctgtttgatttcataacaacataagataatgtttattttatcggggtatctatggtacagttaatttcacgttgtgtaaatatccacttggagactatttgccttgggcattttcccctgtcatttatgagtctctgcaggtgtacaaaaaaaccccaatctactgtaaatggcagtttaattgttagaaatgactgtttttgcaccacttgtaaaaaggtatttagcgattgcatttgctgtttgttgttttattttgctttatatatgacttgcagaggataaccataaaatgggtaattctctctgaagttgaataatcaccatgactgtaaatgaggggcacaattttggactctggcgccaaactgagtcataggccagtagcattacgtgtatctggtgccaccttgctgtttagatacaaatcataccgtcttttaaatattttgaagcccatttcagttaaataatgacatgtcatggtcctttggaatcttcatttaaatgttaaatctggaatcaaaatgaagcaaaaaatatctgtctccttttcactttcttcagtacataaatacattatttaatcaataagaattaactgtactaaatcatgtattatgctgttctagttacagcaaacactctttaagaaaaatatccaatacactaaataggtactatagtaatttttagacatggtacccattgatatgcatttaaaccttttactgctgtgttatgttgataacatatataaatattagataatgctaatgcttctgctgctgtcttttctgtaatattctctttcatgctgaatttactatgaccatttataagcagtgcagttaactacagatagcatttcaggacaaaatagatgactcaaaccatttattgcttaaaaaatagcttacgccatgctatgctataagcagcttttatgcacattgacaaatgaagagtaagcttcagcttgctaaaggaaactgtggaaccttttgtaacttttggtgatatggaaaattatttacaaaccgtcaaagaatatgaggaagttgctgtatgacatagtgctggcactgatattatccatcatctctttttggacacttctgtaaatgtgattggattgtttgaaagaagatttaaagtttcaaagttttttgttctgtttttgctttgcatttggagaaaatattgaaagcagggtatgttgtttcattcaccttgaaaaaaccatgagtaaatggggatatagaatctctgaatagctcgctaaaagattcaagcaagggacatgaattttgttccatctatcaataatatccagaagaacaacttttttaaagagtctatagcaaaaagcaaaaaaaaaaaaaaattctaaacacaaagtcaaaataaacctattgtaaaagcatttcgtgatgagcatgaaaaagattgtttaaagatgatccccccagctacccattttccaaaactacacagatcacagctcatttctctaagtggagcagttatcaagaaacccaaacaccaaaattgctactcttcacatttaatcctacaaaaagtactccaatttcaaaatatgtatgtaacctgcgatttcaatgattgttgttcatatacatcatgtattattttggcccattttgggcctaaaaaagaaaactatgccttaaaaatcagaaccttttctccccactatgcttatgtggccatctacagcacttagaataaaaacagatgttaaaatattcagtgaaagttttattggaaaaaggaattgagatatataattgagatttggtgaaattgaaggagaaaatttaagtgagtctttaaaatatattctgaatgaaaactgtattgaggattcatttttgttccttttttttctttttctcttttctcctttttcttctttttaatagtctagttttagtcagtcagtgaggaagaattgggccatgctaacgttatcacaagagaacaatggcagaaatggtattagttatataatatttaaggacaaactatatgttttgctgttttaacgtagtgactcactgaactaaatacataattgaccaacattaagtgtatttccaatacagaagggttgaaaatattacattataaactcttttgaaaaatgtatctaaaattttttaagttctgttttgattccactttttggttgagtttttatgtttttgttttcaggtagattaataaatctggcagctgatttctgcaagattcttgtgttttgaatttctcattgaattggctactcaaacatagaaatcatttgttaatgatgtaatgtcttctctcagcttttatcttcactgctgtttgctgtctcttgatgatgacatgttaatacccaatagattaattgcaacaaacacttatactcaaataactaagtaaaaataatttttcttgttatgtccatgaaaagtgcttcagaataaaaatccacaagactgacagtgcagaacatttttctcaaatcatgggcggatcttggaggtctagtttcccgtagatgctgtaaccaattaccacaacttcagtaatttacacaaatttatcttatagttctggaggcagaagttcaaaagaagccttaagagactaaaaccaagatgtccttaggtctggttccttctggaggctccaggggagattcttccagctttcacttctagagtctgctgacattccttggctcctggctacatcacttcaatctctgcttccatggtcacatactcttctactatagtcaaatttccttcctgcctcttataaggatgcttgtgattacatttaggggatgctcagataatccaggacaatctctccatctcaagatccttaacttaatgacgtgtgccaagtccctttggctagataattattcataggtcccagggattaggacatggatgtaaggggtgagggcagggctgttattcagaacaccgcacggaggaggaagactgtgtagcaaagactctaattgatttactcaggaacagtggagttctgctgagggatctaggatttgaaagtactagagtttgcttttatttaccactgagatattttccccttattctgcataaataattttgaaaactttctatattaaatttcaactattccactaaaatgtctggtaatcacatcaagcctttagattattcaaatccttccccagcccccaggaaaacactaagtcatgaaacagaaaaacagaaggtatgataataatagtaataacagttaaatcagtggtctaatccagattttattttttaatacatttcttttggtgttaatatgggttactatgtgatcttatcatttgctagtgattattacttattaggtaagaacaatgtgtaaaatatgtctattactcaaaagaacaattgcaaaatgagtcaacttatctttatataaccaggaaagaaatatattgccagaagctacagaattttgccagatgatagggatttctaaaatgagccactttgtctatcatgcagccttttcagagcttgtaatgagaaaacattacagaggagaaggtcatttggatgtttgttacttggaatcctagaaaacaaaaactaaaatttaaaaataagaagtgagtaagctattttccatttgcgatttggtatggagaagagaggaaatagaattattaaaaaaatacaaattgggtaaaagtgatggtggaaaaaatataaagaaggcaaatgtacatattaagcaattctactaagaattggaaaaatcaagtttcaaaaagatggtaatagttgggcatgatactagaaaatttcacccagtttattcagagctcaactagtacttttaggacttctttttttatatacatgagactcactttgacatacttaaaaaaaaaacagtttatggaaagtacagtttaagaggagaatttgattagactaagtggatatctttatagaaatattaatgatttcagaattttcagttacaagtgtatataccgtggctattgtttatggattcatatgtaaggtagggtcttttttgcatatagactccagtattagttactttcattctaaaattatatttatgcttctatggggaagaaaatttttaattcacttggttgtattaaaattatacttacggtttgagaaaacatgctatgaaaatcatgattatagcaaattaaatatgctcaaaatttaaatctaaaataaaagcccagaaactgaaaat

SEQ ID NO: 1527 - DNA, 580 bp, Homo sapiens
aagctccgccccctcgcggttaccctggatacccgtcaggctcgggctgcagagaaggaggatcagggcaagtggcttcagagatgcagccctcactgcttaacgtcctagttattgtccttgaaacccgagccatctcaccgctcgcccccaaccctgggctctggctgtttaaaagctggagaggaagtgaaagcgtcaagtacagttgatagaagtccagatcctgaggaaatctccagctaaatgctcaaaatataaaatactgagctgagatttgcgaagagcagcagcatggatggattttatgaccagcaagtgccttacatggtcaccaatagtcagcgtgggagaaattgtaacgagaaaccaacaaatgtcaggaaaagaaaattcattaacagagatctggctcatgattcagaagaactctttcaagatctaagtcaattacaggaaacatggcttgcagaagctcaggtacctgacaatgatgagcagtttgtaccagactatcaggctgaaagtttggcttttcatggcctgccactgaaaatcaagaaagaaccccacagtccat

SEQ ID NO: 1528 - DNA, 546 bp, Homo sapiens
agaggcgctttcggcttccaagggggaagtgctgggctataattaatgtttttattaaatttggagggaagtttttgcagcctttcgcctagcgtggccttcaggtgggtctttccaacaactttttatgtctctccagataattgcatggttgtgggtcgcaaaaactatcctgatgaaagaggtgtctccgtctctttagtcccgttaggtgcaaagcaagtctcgttgatcgccattgctagttttgcacacgtttgcgaatcagagctgcccggggtacaccgaccgcgcagggaaacatcgagagtgtaaataaatacatcgcctcttgttcggatttttgctactaccgaaaatatgtaaattgtgaactctgttggctctctttggatccaggttgatagaagtccagatcctgaggaaatctccagctaaatgctcaaaatataaaatactgagctgagatttgcgaagagcagcagcatggatggattttatgaccagcaagtgccttacatggtcaccaatagtcagcgtgggaga

SEQ ID NO: 1529 - DNA, 3363 bp, Homo sapiens
gtcatgcatacattagagcctctgatgagtttgtctttggggactctggggctgtactacccagtgtcatcacaaattaccaggagaaattgcttccagctcacaatcacatctgcttttggcaagaactaatgcaccaagacttcaagttctaagcctctgttcagattttaattgcaattgatcaggtttatattattgtacctccagagacctcctagagccagaacccggctggcttgctgtttcctttagagcagcgcatatcattatttggtgttctggtggaggacttttctgatggcagaaattagtttctctgggttcatcaggacgggatgcttcaagatttaagtgcaagtgtcttctttccaccttgttcacaacacagaacgttagctcaggtacctgacaatgatgagcagtttgtaccagactatcaggctgaaagtttggcttttcatggcctgccactgaaaatcaagaaagaaccccacagtccatgttcagaaatcagctctgcctgcagtcaagaacagccctttaaattcagctatggagaaaagtgcctgtacaatgtcagtgcctatgatcagaagccacaagtgggaatgaggccctccaacccccccacaccatccagcacgccagtgtccccactgcatcatgcatctccaaactcaactcatacaccgaaacctgaccgggccttcccagctcacctccctccatcgcagtccataccagatagcagctaccccatggaccacagatttcgccgccagctttctgaaccctgtaactcctttcctcctttgccgacgatgccaagggaaggacgtcctatgtaccaacgccagatgtctgagccaaacatccccttcccaccacaaggctttaagcaggagtaccacgacccagtgtatgaacacaacaccatggttggcagtgcggccagccaaagctttccccctcctctgatgattaaacaggaacccagagattttgcatatgactcagaagtgcctagctgccactccatttatatgaggcaagaaggcttcctggctcatcccagcagaacagaaggctgtatgtttgaaaagggccccaggcagttttatgatgacacctgtgttgtcccagaaaaattcgatggagacatcaaacaagagccaggaatgtatcgggaaggacccacataccaacggcgaggatcacttcagctctggcagtttttggtagctcttctggatgacccttcaaattctcattttattgcctggactggtcgaggcatggaatttaaactgattgagcctgaagaggtggcccgacgttggggcattcagaaaaacaggccagctatgaactatgataaacttagccgttcactccgctattactatgagaaaggaattatgcaaaaggtggctggagagagatatgtctacaagtttgtgtgtgatccagaagcccttttctccatggcctttccagataatcagcgtccactgctgaagacagacatggaacgtcacatcaacgaggaggacacagtgcctctttctcactttgatgagagcatggcctacatgccggaagggggctgctgcaacccccacccctacaacgaaggctacgtgtattaacacaagtgacagtcaagcagggcgtttttgcgcttttccttttttctgcaagatacagagaattgctgaatctttgttttatttctgttgtttgtattttatttttaaataataatacacaaaaaggggcttttcctgttgcattattctatggtctgccatggactgtgcactttatttgagggtgggtgggagtaatctaaacatttattctgtgtaacaggaagctaatgggtgaatgggcagagggatttggggattactttttacttaggcttgggatggggtcctacaagttttgagtatgatgaaactatatcatgtctgtttgatttcataacaacataagataatgtttattttatcggggtatctatggtacagttaatttcacgttgtgtaaatatccacttggagactatttgccttgggcattttcccctgtcatttatgagtctctgcaggtgtacaaaaaaaccccaatctactgtaaatggcagtttaattgttagaaatgactgtttttgcaccacttgtaaaaaggtatttagcgattgcatttgctgtttgttgttttattttgctttatatatgacttgcagaggataaccataaaatgggtaattctctctgaagttgaataatcaccatgactgtaaatgaggggcacaattttggactctggcgccaaactgagtcataggccagtagcattacgtgtatctggtgccaccttgctgtttagatacaaatcataccgtcttttaaatattttgaagcccatttcagttaaataatgacatgtcatggtcctttggaatcttcatttaaatgttaaatctggaatcaaaatgaagcaaaaaatatctgtctccttttcactttcttcagtacataaatacattatttaatcaataagaattaactgtactaaatcatgtattatgctgttctagttacagcaaacactctttaagaaaaatatccaatacactaaataggtactatagtaatttttagacatggtacccattgatatgcatttaaaccttttactgctgtgttatgttgataacatatataaatattagataatgctaatgcttctgctgctgtcttttctgtaatattctctttcatgctgaatttactatgaccatttataagcagtgcagttaactacagatagcatttcaggacaaaatagatgactcaaaccatttattgcttaaaaaatagcttacgccatgctatgctataagcagcttttatgcacattgacaaatgaagagtaagcttcagcttgctaaaggaaactgtggaaccttttgtaacttttggtgatatggaaaattatttacaaaccgtcaaagaatatgaggaagttgctgtatgacatagtgctggcactgatattatccatcatctctttttggacacttctgtaaatgtgattggattgtttgaaagaagatttaaagtttcaaagttttttgttctgtttttgctttgcatttggagaaaatattgaaagcagggtatgttgtttcattcaccttgaaaaaaccatgagtaaatggggatatagaatctctgaatagctcgctaaaagattcaagcaagggacatgaattttgttccatctatcaataatatccagaagaacaacttttttaaagagtctatagcaaaaagcaaaaaaaaaaaaaaa

SEQ ID NO: 1530 - DNA, 4402 bp, Homo sapiens
gagctctgtcagaggcgctttcggcttccaagggggaagtgctgggctataattaatgtttttattaaatttggagggaagtttttgcagcctttcgcctagcgtggccttcaggttgatagaagtccagatcctgaggaaatctccagctaaatgctcaaaatataaaatactgagctgagatttgcgaagagcagcagcatggatggattttatgaccagcaagtgccttacatggtcaccaatagtcagcgtgggagaaattgtaacgagaaaccaacaaatgtcaggaaaagaaaattcattaacagagatctggctcatgattcagaagaactctttcaagatctaagtcaattacaggaaacatggcttgcagaagctcaggtacctgacaatgatgagcagtttgtaccagactatcaggctgaaagtttggcttttcatggcctgccactgaaaatcaagaaagaaccccacagtccatgttcagaaatcagctctgcctgcagtcaagaacagccctttaaattcagctatggagaaaagtgcctgtacaatgtcagtgcctatgatcagaagccacaagtgggaatgaggccctccaacccccccacaccatccagcacgccagtgtccccactgcatcatgcatctccaaactcaactcatacaccgaaacctgaccgggccttcccagctcacctccctccatcgcagtccataccagatagcagctaccccatggaccacagatttcgccgccagctttctgaaccctgtaactcctttcctcctttgccgacgatgccaagggaaggacgtcctatgtaccaacgccagatgtctgagccaaacatccccttcccaccacaaggctttaagcaggagtaccacgacccagtgtatgaacacaacaccatggttggcagtgcggccagccaaagctttccccctcctctgatgattaaacaggaacccagagattttgcatatgactcaggctgtatgtttgaaaagggccccaggcagttttatgatgacacctgtgttgtcccagaaaaattcgatggagacatcaaacaagagccaggaatgtatcgggaaggacccacataccaacggcgaggatcacttcagctctggcagtttttggtagctcttctggatgacccttcaaattctcattttattgcctggactggtcgaggcatggaatttaaactgattgagcctgaagaggtggcccgacgttggggcattcagaaaaacaggccagctatgaactatgataaacttagccgttcactccgctattactatgagaaaggaattatgcaaaaggtggctggagagagatatgtctacaagtttgtgtgtgatccagaagcccttttctccatggcctttccagataatcagcgtccactgctgaagacagacatggaacgtcacatcaacgaggaggacacagtgcctctttctcactttgatgagagcatggcctacatgccggaagggggctgctgcaacccccacccctacaacgaaggctacgtgtattaacacaagtgacagtcaagcagggcgtttttgcgcttttccttttttctgcaagatacagagaattgctgaatctttgttttatttctgttgtttgtattttatttttaaataataatacacaaaaaggggcttttcctgttgcattattctatggtctgccatggactgtgcactttatttgagggtgggtgggagtaatctaaacatttattctgtgtaacaggaagctaatgggtgaatgggcagagggatttggggattactttttacttaggcttgggatggggtcctacaagttttgagtatgatgaaactatatcatgtctgtttgatttcataacaacataagataatgtttattttatcggggtatctatggtacagttaatttcacgttgtgtaaatatccacttggagactatttgccttgggcattttcccctgtcatttatgagtctctgcaggtgtacaaaaaaaccccaatctactgtaaatggcagtttaattgttagaaatgactgtttttgcaccacttgtaaaaaggtatttagcgattgcatttgctgtttgttgttttattttgctttatatatgacttgcagaggataaccataaaatgggtaattctctctgaagttgaataatcaccatgactgtaaatgaggggcacaattttggactctggcgccaaactgagtcataggccagtagcattacgtgtatctggtgccaccttgctgtttagatacaaatcataccgtcttttaaatattttgaagcccatttcagttaaataatgacatgtcatggtcctttggaatcttcatttaaatgttaaatctggaatcaaaatgaagcaaaaaatatctgtctccttttcactttcttcagtacataaatacattatttaatcaataagaattaactgtactaaatcatgtattatgctgttctagttacagcaaacactctttaagaaaaatatccaatacactaaataggtactatagtaatttttagacatggtacccattgatatgcatttaaaccttttactgctgtgttatgttgataacatatataaatattagataatgctaatgcttctgctgctgtcttttctgtaatattctctttcatgctgaatttactatgaccatttataagcagtgcagttaactacagatagcatttcaggacaaaatagatgactcaaaccatttattgcttaaaaaatagcttacgccatgctatgctataagcagcttttatgcacattgacaaatgaagagtaagcttcagcttgctaaaggaaactgtggaaccttttgtaacttttggtgatatggaaaattatttacaaaccgtcaaagaatatgaggaagttgctgtatgacatagtgctggcactgatattatccatcatctctttttggacacttctgtaaatgtgattggattgtttgaaagaagatttaaagtttcaaagttttttgttctgtttttgctttgcatttggagaaaatattgaaagcagggtatgttgtttcattcaccttgaaaaaaccatgagtaaatggggatatagaatctctgaatagctcgctaaaagattcaagcaagggacatgaattttgttccatctatcaataatatccagaagaacaacttttttaaagagtctatagcaaaaagcaaaaaaaaaaaaaaattctaaacacaaagtcaaaataaacctattgtaaaagcatttcgtgatgagcatgaaaaagattgtttaaagatgatccccccagctacccattttccaaaactacacagatcacagctcatttctctaagtggagcagttatcaagaaacccaaacaccaaaattgctactcttcacatttaatcctacaaaaagtactccaatttcaaaatatgtatgtaacctgcgatttcaatgattgttgttcatatacatcatgtattattttggcccattttgggcctaaaaaagaaaactatgccttaaaaatcagaaccttttctccccactatgcttatgtggccatctacagcacttagaataaaaacagatgttaaaatattcagtgaaagttttattggaaaaaggaattgagatatataattgagatttggtgaaattgaaggagaaaatttaagtgagtctttaaaatatattctgaatgaaaactgtattgaggattcatttttgttccttttttttctttttctcttttctcctttttcttctttttaatagtctagttttagtcagtcagtgaggaagaattgggccatgctaacgttatcacaagagaacaatggcagaaatggtattagttatataatatttaaggacaaactatatgttttgctgttttaacgtagtgactcactgaactaaatacataattgaccaacattaagtgtatttccaatacagaagggttgaaaatattacattataaactcttttgaaaaatgtatctaaaattttttaagttctgttttgattccactttttggttgagtttttatgtttttgttttcaggtagattaataaatctggcagctgatttctgcaagattcttgtgttttgaatttctcattgaattggctactcaaacatagaaatcatttgttaatgatgtaatgtcttctctcagcttttatcttcactgctgtttgctgtctcttgatgatgacatgttaatacccaatagattaattgcaacaaacacttatactcaaataactaagtaaaaataatttttcttgttatgtccatgaaaagtgcttcagaataaaaatccacaagactgac

SEQ ID NO: 1531 - DNA, 2391 bp, Homo sapiens
gggtggagagctgaggccgagcgaaggaaatgcaccaatcagctgctcccccgggctcacaactgtctgctgcgcccgaaaaacaagtcggtgcgctggggacccggggccggggccgccttactccggcctagccccgcggccctcggtgcgggctccagggcatgctcgggaccccccgcggctccagcccagacgccccggcctcaggtctcggcccccgcttggggccccggccgtgcggccggagggagcggccggatggagcggaggatgaaagccggatacttggaccagcaagtgccctacaccttcagcagcaaatcgcccggaaatgggagcttgcgcgaagcgctgatcggcccgctggggaagctcatggacccgggctccctgccgcccctcgactctgaagatctcttccaggatctaagtcacttccaggagacgtggctcgctgaagctcaggtaccagacagtgatgagcagtttgttcctgatttccattcagaaaacctagctttccacagccccaccaccaggatcaagaaggagccccagagtccccgcacagacccggccctgtcctgcagcaggaagccgccactcccctaccaccatggcgagcagtgcctttactccagtgcctatgacccccccagacaaatcgccatcaagtcccctgcccctggtgcccttggacagtcgcccctacagccctttccccgggcagagcaacggaatttcctgagatcctctggcacctcccagccccaccctggccatgggtacctcggggaacatagctccgtcttccagcagcccctggacatttgccactccttcacatctcagggagggggccgggaacccctcccagccccctaccaacaccagctgtcggagccctgcccaccctatccccagcagagctttaagcaagaataccatgatcccctgtatgaacaggcgggccagccagccgtggaccagggtggggtcaatgggcacaggtacccaggggcgggggtggtgatcaaacaggaacagacggacttcgcctacgactcagatgtcaccgggtgcgcatcaatgtacctccacacagagggcttctctgggccctctccaggtgacggggccatgggctatggctatgagaaacctctgcgaccattcccagatgatgtctgcgttgtccctgagaaatttgaaggagacatcaagcaggaaggggtcggtgcatttcgagaggggccgccctaccagcgccggggtgccctgcagctgtggcaatttctggtggccttgctggatgacccaacaaatgcccatttcattgcctggacgggccggggaatggagttcaagctcattgagcctgaggaggtcgccaggctctggggcatccagaagaaccggccagccatgaattacgacaagctgagccgctcgctccgatactattatgagaaaggcatcatgcagaaggtggctggtgagcgttacgtgtacaagtttgtgtgtgagcccgaggccctcttctctttggccttcccggacaatcagcgtccagctctcaaggctgagtttgaccggcctgtcagtgaggaggacacagtccctttgtcccacttggatgagagccccgcctacctcccagagctggctggccccgcccagccatttggccccaagggtggctactcttactagcccccagcggctgttccccctgccgcaggtgggtgctgccctgtgtacatataaatgaatctggtgttggggaaaccttcatctgaaacccacagatgtctctggggcagatccccactgtcctaccagttgccctagcccagactctgagctgctcaccggagtcattgggaaggaaaagtggagaaatggcaagtctagagtctcagaaactcccctgggggtttcacctgggccctggaggaattcagctcagcttcttcctaggtccaagccccccacaccttttccccaaccacagagaacaagagtttgttctgttctgggggacagagaaggcgcttcccaacttcatactggcaggagggtgaggaggttcactgagctccccagatctcccactgcggggagacagaagcctggactctgccccacgctgtggccctggagggtcccggtttgtcagttcttggtgctctgtgttcccagaggcaggcggaggttgaagaaaggaacctgggatgaggggtgctgggtataagcagagagggatgggttcctgctccaagggaccctttgcctttcttctgccctttcctaggcccaggcctgggtttgtacttccacctccaccacatctgccagaccttaataaaggcccccacttctcccatt

SEQ ID NO: 1532 - DNA, 2258 bp, Homo sapiens
cacgttcttatgtaaccgagcccgggtaaagcagggctgcagaaagcagaaacggcgagcccggctcctgggagcaggtctcggcccccgcttggggccccggccgtgcggccggagggagcggccggatggagcggaggatgaaagccggatacttggaccagcaagtgccctacaccttcagcagcaaatcgcccggaaatgggagcttgcgcgaagcgctgatcggcccgctggggaagctcatggacccgggctccctgccgcccctcgactctgaagatctcttccaggatctaagtcacttccaggagacgtggctcgctgaagctcaggtaccagacagtgatgagcagtttgttcctgatttccattcagaaaacctagctttccacagccccaccaccaggatcaagaaggagccccagagtccccgcacagacccggccctgtcctgcagcaggaagccgccactcccctaccaccatggcgagcagtgcctttactccagtgcctatgacccccccagacaaatcgccatcaagtcccctgcccctggtgcccttggacagtcgcccctacagccctttccccgggcagagcaacggaatttcctgagatcctctggcacctcccagccccaccctggccatgggtacctcggggaacatagctccgtcttccagcagcccctggacatttgccactccttcacatctcagggagggggccgggaacccctcccagccccctaccaacaccagctgtcggagccctgcccaccctatccccagcagagctttaagcaagaataccatgatcccctgtatgaacaggcgggccagccagccgtggaccagggtggggtcaatgggcacaggtacccaggggcgggggtggtgatcaaacaggaacagacggacttcgcctacgactcagatgtcaccgggtgcgcatcaatgtacctccacacagagggcttctctgggccctctccaggtgacggggccatgggctatggctatgagaaacctctgcgaccattcccagatgatgtctgcgttgtccctgagaaatttgaaggagacatcaagcaggaaggggtcggtgcatttcgagaggggccgccctaccagcgccggggtgccctgcagctgtggcaatttctggtggccttgctggatgacccaacaaatgcccatttcattgcctggacgggccggggaatggagttcaagctcattgagcctgaggaggtcgccaggctctggggcatccagaagaaccggccagccatgaattacgacaagctgagccgctcgctccgatactattatgagaaaggcatcatgcagaaggtggctggtgagcgttacgtgtacaagtttgtgtgtgagcccgaggccctcttctctttggccttcccggacaatcagcgtccagctctcaaggctgagtttgaccggcctgtcagtgaggaggacacagtccctttgtcccacttggatgagagccccgcctacctcccagagctggctggccccgcccagccatttggccccaagggtggctactcttactagcccccagcggctgttccccctgccgcaggtgggtgctgccctgtgtacatataaatgaatctggtgttggggaaaccttcatctgaaacccacagatgtctctggggcagatccccactgtcctaccagttgccctagcccagactctgagctgctcaccggagtcattgggaaggaaaagtggagaaatggcaagtctagagtctcagaaactcccctgggggtttcacctgggccctggaggaattcagctcagcttcttcctaggtccaagccccccacaccttttccccaaccacagagaacaagagtttgttctgttctgggggacagagaaggcgcttcccaacttcatactggcaggagggtgaggaggttcactgagctccccagatctcccactgcggggagacagaagcctggactctgccccacgctgtggccctggagggtcccggtttgtcagttcttggtgctctgtgttcccagaggcaggcggaggttgaagaaaggaacctgggatgaggggtgctgggtataagcagagagggatgggttcctgctccaagggaccctttgcctttcttctgccctttcctaggcccaggcctgggtttgtacttccacctccaccacatctgccagaccttaataaaggcccccacttctcccatt

SEQ ID NO: 1533 - DNA, 2024 bp, Homo sapiens
gcagaaagcagaaacggcgagcccggctcctgggagcagaaatcgcccggaaatgggagcttgcgcgaagcgctgatcggcccgctggggaagctcatggacccgggctccctgccgcccctcgactctgaagatctcttccaggatctaagtcacttccaggagacgtggctcgctgaagctcaggtaccagacagtgatgagcagtttgttcctgatttccattcagaaaacctagctttccacagccccaccaccaggatcaagaaggagccccagagtccccgcacagacccggccctgtcctgcagcaggaagccgccactcccctaccaccatggcgagcagtgcctttactccagtgcctatgacccccccagacaaatcgccatcaagtcccctgcccctggtgcccttggacagtcgcccctacagccctttccccgggcagagcaacggaatttcctgagatcctctggcacctcccagccccaccctggccatgggtacctcggggaacatagctccgtcttccagcagcccctggacatttgccactccttcacatctcagggagggggccgggaacccctcccagccccctaccaacaccagctgtcggagccctgcccaccctatccccagcagagctttaagcaagaataccatgatcccctgtatgaacaggcgggccagccagccgtggaccagggtggggtcaatgggcacaggtacccaggggcgggggtggtgatcaaacaggaacagacggacttcgcctacgactcagatgtcaccgggtgcgcatcaatgtacctccacacagagggcttctctgggccctctccaggtgacggggccatgggctatggctatgagaaacctctgcgaccattcccagatgatgtctgcgttgtccctgagaaatttgaaggagacatcaagcaggaaggggtcggtgcatttcgagaggggccgccctaccagcgccggggtgccctgcagctgtggcaatttctggtggccttgctggatgacccaacaaatgcccatttcattgcctggacgggccggggaatggagttcaagctcattgagcctgaggaggtcgccaggctctggggcatccagaagaaccggccagccatgaattacgacaagctgagccgctcgctccgatactattatgagaaaggcatcatgcagaaggtggctggtgagcgttacgtgtacaagtttgtgtgtgagcccgaggccctcttctctttggccttcccggacaatcagcgtccagctctcaaggctgagtttgaccggcctgtcagtgaggaggacacagtccctttgtcccacttggatgagagccccgcctacctcccagagctggctggccccgcccagccatttggccccaagggtggctactcttactagcccccagcggctgttccccctgccgcaggtgggtgctgccctgtgtacatataaatgaatctggtgttggggaaaccttcatctgaaacccacagatgtctctggggcagatccccactgtcctaccagttgccctagcccagactctgagctgctcaccggagtcattgggaaggaaaagtggagaaatggcaagtctagagtctcagaaactcccctgggggtttcacctgggccctggaggaattcagctcagcttcttcctaggtccaagccccccacaccttttccccaaccacagagaacaagagtttgttctgttctgggggacagagaaggcgcttcccaacttcatactggcaggagggtgaggaggttcactgagctccccagatctcccactgcggggagacagaagcctggactctgccccacgctgtggccctggagggtcccggtttgtcagttcttggtgctctgtgttcccagaggcaggcggaggttgaagaaaggaacctgggatgaggggtgctgggtataagcagagagggatgggttcctgctccaagggaccctttgcctttcttctg

SEQ ID NO: 1534 - DNA, 1628 bp, Homo sapiens
agccctccctggacggtgtgcgaacgcagccccctcccccaccaggtctcggcccccgcttggggccccggccgtgcggccggagggagcggccggatggagcggaggatgaaagccggatacttggaccagcaagtgccctacaccttcagcagcaaatcgcccggaaatgggagcttgcgcgaagcgctgatcggcccgctggggaagctcatggacccgggctccctgccgcccctcgactctgaagatctcttccaggatctaagtcacttccaggagacgtggctcgctgaagctcaggtaccagacagtgatgagcagtttgttcctgatttccattcagaaaacctagctttccacagccccaccaccaggatcaagaaggagccccagagtccccgcacagacccggccctgtcctgcagcaggaagccgccactcccctaccaccatggcgagcagtgcctttactccagctccgtcttccagcagcccctggacatttgccactccttcacatctcagggagggggccgggaacccctcccagccccctaccaacaccagctgtcggagccctgcccaccctatccccagcagagctttaagcaagaataccatgatcccctgtatgaacaggcgggccagccagccgtggaccagggtggggtcaatgggcacaggtacccaggggcgggggtggtgatcaaacaggaacagacggacttcgcctacgactcagatgtcaccgggtgcgcatcaatgtacctccacacagagggcttctctgggccctctccaggtgacggggccatgggctatggctatgagaaacctctgcgaccattcccagatgatgtctgcgttgtccctgagaaatttgaaggagacatcaagcaggaaggggtcggtgcatttcgagaggggccgccctaccagcgccggggtgccctgcagctgtggcaatttctggtggccttgctggatgacccaacaaatgcccatttcattgcctggacgggccggggaatggagttcaagctcattgagcctgaggaggtcgccaggctctggggcatccagaagaaccggccagccatgaattacgacaagctgagccgctcgctccgatactattatgagaaaggcatcatgcagaaggtggctggtgagcgttacgtgtacaagtttgtgtgtgagcccgaggccctcttctctttggccttcccggacaatcagcgtccagctctcaaggctgagtttgaccggcctgtcagtgaggaggacacagtccctttgtcccacttggatgagagccccgcctacctcccagagctggctggccccgcccagccatttggccccaagggtggctactcttactagcccccagcggctgttccccctgccgcaggtgggtgctgccctgtgtacatataaatgaatctggtgttggggaaaccttcatctgaaacccacagatgtctctggggcagatccccactgtcctaccagttgccctagcccagactctgagctgctcaccggagtcattgggaaggaaaagtggagaaatggcaagtctagagtctcagaaactcccctgggggtttcacctgggccct

SEQ ID NO: 1535 - DNA, 1775 bp, Homo sapiens
gcgcccgaaaaacaagtcggtgcgctggggacccggggccggggccgccttactccggcctagccccgcggccctcggtgcgggctccagggcatgctcgggaccccccgcggctccagcccagacgccccggcctcagaaatcgcccggaaatgggagcttgcgcgaagcgctgatcggcccgctggggaagctcatggacccgggctccctgccgcccctcgactctgaagatctcttccaggatctaagtcacttccaggagacgtggctcgctgaagctcaggtaccagacagtgatgagcagtttgttcctgatttccattcagaaaacctagctttccacagccccaccaccaggatcaagaaggagccccagagtccccgcacagacccggccctgtcctgcagcaggaagccgccactcccctaccaccatggcgagcagtgcctttactccagtgcctatgacccccccagacaaatcgccatcaagtcccctgcccctggtgcccttggacagtcgcccctacagccctttccccgggcagagcaacggaatttcctgagatcctctggcacctcccagccccaccctggccatgggtacctcggggaacatagctccgtcttccagcagcccctggacatttgccactccttcacatctcagggagggggccgggaacccctcccagccccctaccaacaccagctgtcggagccctgcccaccctatccccagcagagctttaagcaagaataccatgatcccctgtatgaacaggcgggccagccagccgtggaccagggtggggtcaatgggcacaggtacccaggggcgggggtggtgatcaaacaggaacagacggacttcgcctacgactcagatgtcaccgggtgcgcatcaatgtacctccacacagagggcttctctgggccctctccaggtgacggggccatgggctatggctatgagaaacctctgcgaccattcccagatgatgtctgcgttgtccctgagaaatttgaaggagacatcaagcaggaaggggtcggtgcatttcgagaggggccgccctaccagcgccggggtgccctgcagctgtggcaatttctggtggccttgctggatgacccaacaaatgcccatttcattgcctggacgggccggggaatggagttcaagctcattgagcctgaggaggtcgccaggctctggggcatccagaagaaccggccagccatgaattacgacaagctgagccgctcgctccgatactattatgagaaaggcatcatgcagaaggtggctggtgagcgttacgtgtacaagtttgtgtgtgagcccgaggccctcttctctttggccttcccggacaatcagcgtccagctctcaaggctgagtttgaccggcctgtcagtgaggaggacacagtccctttgtcccacttggatgagagccccgcctacctcccagagctggctggccccgcccagccatttggccccaagggtggctactcttactagcccccagcggctgttccccctgccgcaggtgggtgctgccctgtgtacatataaatgaatctggtgttggggaaaccttcatctgaaacccacagatgtctctggggcagatccccactgtcctaccagttgccctagcccagactctgagctgctcaccggagtcattgggaaggaaaagtggagaaatggcaagtctagagtctcagaaactcccctgggggtttcacctgggccctgg

SEQ ID NO: 1536 - DNA, 2228 bp, Homo sapiens
taccgagggaggtgaggggcgggccgggcgggtgtccgaggcggcggcggcggcatggcagggcggcgggtgaacgtgaacgtgggcgtgctgggccacatcgacagcggcaagacggcgctggcgcgggcgctaagcaccacagcctccaccgccgcctttgacaagcagccgcagagccgcgagcgcggcatcacgctcgatctgggcttctcgtgcttctcggtgccgctgcccgcgcgcctgcggtcgtctttgcccgagttccaggcagcgcccgaggccgagcccgagcccggcgagccactgcttcaggtcacgctggtcgactgccccgggcacgcctccctcatccggaccatcatcggcggggcccagatcattgatctgatgatgctggtcatcgatgtgaccaaggggatgcagacccagtcagcggaatgccttgtgatcggccagattgcctgccagaagctggtcgtggtgctgaacaaaatagacctcttacctgaaggaaagagacaggcagcaattgataaaatgaccaagaaaatgcagaagaccctagagaacaccaagttccgaggtgcaccgattatacccgtggcggccaagccggggggaccagaggcccccgaaactgaagctccacagggcattccagagctcattgagctcctgacgtcccagatttccatcccaacgagagatccctcgggaccgttcctcatgtctgtggaccactgtttctccatcaaaggccaaggcactgtgatgacagggaccatcctttcaggctccatcagcctcggtgacagtgtggagatccctgccctcaaggtggtgaagaaggtgaagtccatgcagatgttccacatgcccatcacttcagccatgcaaggagaccggctgggcatctgcgtcacccagtttgaccctaagctgctggagcgcgggttggtgtgtgcccccgagtccctgcacactgtccatgcggccctcatctctgtggaaaagataccgtatttccgggggcccctgcaaaccaaggccaagttccacattacagtgggccatgaaacagtcatgggccggttgatgttcttcagtcctgctccagataactttgaccaggagcctatactggactctttcaacttctctcaagaataccttttccaggagcagtacctgtccaaggatttgacaccagcagtgacagacaatgatgaggccgacaagaaggccggccaggccacagagggccattgtcctcggcagcagtgggccctggtggagtttgagaagcccgtcacctgccctcggctgtgcctggtgattggctccaggctagatgcggacattcacaccaacacgtgccggctagccttccatggcatcctgctccacgggctagaggacaggaactacgccgacagcttcctgcccaggctgaaggtgtacaagctgaagcacaagcatggccttgtggagcgggcgatggatgactacagtgtgatcggccgctccctgttcaaaaaggaaaccaacatccagctcttcgtggggctcaaggtgcacttgtccactggggaactgggcatcatcgacagtgccttcggccagagcggcaagttcaagatccacatcccaggtggcctcagccccgagtccaagaagatcctgacacccgccctcaagaagcgggcccgggctggccgtggggaggccaccaggcaggaggagagcgccgagcggagcgagccctcacagcatgtggtgctcagcctgactttcaagcgttatgtcttcgacacccacaagcgcatggttcagtctccctgagtgtccggtgacctcccccagggcctccttgcccagcccagtccaggctgctgtgccaaatcccaaccagccacgcctcagcctctcccagtctctccctgcagtcctgcagcagcagcccccacccccaagcttggtgctgagccctggtgaggagctgagggggatgggttgctggggccaggagggtctctcctccagcccctgcacactcccacccaggacagcccccagcccaactaggaaagggccatgggcagagggctggtagccagtatcttccactgccccatctgttggccacctgcaggccagtctcaaccctcccccaggtgggcaggcacttgatggctacaaataaatgtcccgtggccccagcccac

SEQ ID NO: 1537 - DNA, 10042 bp, Homo sapiens
agcagacgagggcttgtgcgagagggggccgggcggctgcagggaaggcggagtccaaggggaaaacgaaactgagaaccagctctcccgaagccgcgggtctccggccggcggcggcggcggcggcggcggcggcgcagtttctggagcaaattcagtttgccttcctggatttgtaaattgtaatgacctcaaaactttagcagttcttccatctgactcaggtttgcttctctggcggtcttcagaatcaacatccacacttccgtgattatctgcgtgcattttggacaaagcttccaaccaggatacgggaagaagaaatggctggtgatctttcagcaggtttcttcatggaggaacttaatacataccgtcagaagcagggagtagtacttaaatatcaagaactgcctaattcaggacctccacatgataggaggtttacatttcaagttataatagatggaagagaatttccagaaggtgaaggtagatcaaagaaggaagcaaaaaatgccgcagccaaattagctgttgagatacttaataaggaaaagaaggcagttagtcctttattattgacaacaacgaattcttcagaaggattatccatggggaattacataggccttatcaatagaattgcccagaagaaaagactaactgtaaattatgaacagtgtgcatcgggggtgcatgggccagaaggatttcattataaatgcaaaatgggacagaaagaatatagtattggtacaggttctactaaacaggaagcaaaacaattggccgctaaacttgcatatcttcagatattatcagaagaaacctcagtgaaatctgactacctgtcctctggttcttttgctactacgtgtgagtcccaaagcaactctttagtgaccagcacactcgcttctgaatcatcatctgaaggtgacttctcagcagatacatcagagataaattctaacagtgacagtttaaacagttcttcgttgcttatgaatggtctcagaaataatcaaaggaaggcaaaaagatctttggcacccagatttgaccttcctgacatgaaagaaacaaagtatactgtggacaagaggtttggcatggattttaaagaaatagaattaattggctcaggtggatttggccaagttttcaaagcaaaacacagaattgacggaaagacttacgttattaaacgtgttaaatataataacgagaaggcggagcgtgaagtaaaagcattggcaaaacttgatcatgtaaatattgttcactacaatggctgttgggatggatttgattatgatcctgagaccagtgatgattctcttgagagcagtgattatgatcctgagaacagcaaaaatagttcaaggtcaaagactaagtgccttttcatccaaatggaattctgtgataaagggaccttggaacaatggattgaaaaaagaagaggcgagaaactagacaaagttttggctttggaactctttgaacaaataacaaaaggggtggattatatacattcaaaaaaattaattcatagagatcttaagccaagtaatatattcttagtagatacaaaacaagtaaagattggagactttggacttgtaacatctctgaaaaatgatggaaagcgaacaaggagtaagggaactttgcgatacatgagcccagaacagatttcttcgcaagactatggaaaggaagtggacctctacgctttggggctaattcttgctgaacttcttcatgtatgtgacactgcttttgaaacatcaaagtttttcacagacctacgggatggcatcatctcagatatatttgataaaaaagaaaaaactcttctacagaaattactctcaaagaaacctgaggatcgacctaacacatctgaaatactaaggaccttgactgtgtggaagaaaagcccagagaaaaatgaacgacacacatgttagagcccttctgaaaaagtatcctgcttctgatatgcagttttccttaaattatctaaaatctgctagggaatatcaatagatatttaccttttattttaatgtttcctttaattttttactatttttactaatctttctgcagaaacagaaaggttttcttctttttgcttcaaaaacattcttacattttactttttcctggctcatctctttattctttttttttttttaaagacagagtctcgctctgttgcccaggctggagtgcaatgacacagtcttggctcactgcaacttctgcctcttgggttcaagtgattctcctgcctcagcctcctgagtagctggattacaggcatgtgccacccacccaactaatttttgtgtttttaataaagacagggtttcaccatgttggccaggctggtctcaaactcctgacctcaagtaatccacctgcctcggcctcccaaagtgctgggattacagggatgagccaccgcgcccagcctcatctctttgttctaaagatggaaaaaccacccccaaattttctttttatactattaatgaatcaatcaattcatatctatttattaaatttctaccgcttttaggccaaaaaaatgtaagatcgttctctgcctcacatagcttacaagccagctggagaaatatggtactcattaaaaaaaaaaaaaaaagtgatgtacaaccacttcggaaaacaatttggcattatctagtaaagttgaatccatgtatacccacatagctatcaattctattcctacatacgtgcttacaagaatgtccataaaaccctgtttataatagccaaaagaacagggaacaaccataatgcacatcaaaagaagaatggattaaaaaaattatattcacacacaggagtactatatagtattgaaaacaattgaagtacagctaaatgtaataacgtaacacaatacaactctcagaaacataatgttaagcgaacaaagcaggttttcagaaaatatatgcagaataattccatttatataaagttccagagcatgcaaaactaaatcattttgtataaaaaacccaacaaatgtgatgagacaataatgggaaggaagggaatgagaaatattaaattctggatggtggttatctttgagggaggggaatgatgtgattggggaaatggactttcaaaggtaatggtaacttccttaagctggatggtaggtccactagtgtttgctgcatagttataccttttatcttaaatacattttgtatctattgtaacaaccactttaaagacaaccgtgctgtaaggcagtagctaaaaacagaaaatagtccatcgggaagggtaagatggctttctgctgagcacagggctagaagtgacagcccagtgggccttccaactatatgccagggtgttagatgagtagagaggagaccacccaggaagtctggacaaggggtctggcatgagctctggagaagatatatttgaggaacatggggtatgctagtttgttgtcctgaattgctgtagagaagataatttaaattgcatcttagaagacgaccctgagggtgaatttcaacttagggcaattgttttagtttgtttcttattggtttaaatggatacttgaagctggataatttataaggaaaagagatttatatgacttacagttctgcaggctgtacaagaaacatggcaccagcatctgcttcttccccggctgcttccactcatggtggaaggtgaaggggagccggatgtgcagagatcatatggcaagagaggaagcaagagagcgagggagaaggtgccaggctctttttaaataaccggctcttgagggaactaatagattgagaactccttgcttctcctccccagcacaccccacccccagggacggcattaatgtattcatgaggggtcttcccccatgacccaaacacctcccatcaggccccacctccaacactgggatcaaatttcaacatgagattttgggggacaaacatgcaaactatagcagcaaccagctaccattctaaaactgccatatgattttaggatttttaaaaagggccaaatttaggttaagcaaaaagtgaaaatacagtaagagaaaatagttttataaaggctttaaaaagtgttcataaagagcagttcatagatttttcacgtaacgttcatcaatagatgctaaaactattggatgaaaagctattgtggaataggatcttctacaaggatttaaatataatcctacagaagaggtatcaattatacaggggaaaatgtacctttacaatggtcaccacaataaccaagtgattcaatttagcatcacccaaggtggaacaccctaacattatgcccctcctgatgtgacttaagaattttacctatttagttttcttgcacaaagtgttaaactggaatttaatcatgaggaaattattagacaaatcctgaatgtagtcattctataagatgattgacttgggcttctcaaaaagtcagtgtcatgaaaaaaaaaaaaaggggagagacttgtaagatacaatgaccaaatgcaatgtttgaatctttattgtattctggatatttaaaaagacaaaagctggacgcagtagctaatgcctgttatcccagcatttttgggaggtcaaaaggggaggatggcttgagcataggattttgagactagcctgggcaacacagtgagttctcatctctacaaaaaatcagaaaattagctgggcatggtagtgtgcatctgtggtcccagctacttgggggggtgaggtgggaggatcacttgagcctaggaggtcaaggccgcagtgagccatgatcatgttactgcattccagcctgggtgacagagtgagatcatatctaaataataataataataaaagaaagcaacaacccagcaaacagctataaagatatcttcgggacaattgagaacatttgaatatagactgcatattagataacaatgccaaataactgttttctcaggtgtgataatagtatatgtagaaaatgtctttttgttttgttttattttgtttttgtttgtttgtttgttttgagacagagtctcactgtgtcgcccaggctggagtgcagtggcacgatctcggctcactgcaacctctgcctcccaggttcaagtgattctcctgcctctgcttcctgagtagctgggattacaggtatctgccaccactccaggttaattttttctatttttagtagagacggaatttcaccatgttgacccagctggttttgaactcctgacctcaggtgattcacttgccttggcctcccaaagtgttgagattacaggcatgagtcactgcacccagccaaaaatgtttttttaggcaatgcatgcacaaacatttagaggccaagtgtgtcatgatgtctgcaactttcaatgttcagcaaaaatcaacatggagagagaaagagggcacacatgtggcaaaatattagccattgtacaattggtaaatctagatgacagtacacaggtgtttgttgtattattctttgaacttttctgtagatttggaaatgttctgcgtagagagaaatctttttttaaaaaaacaatatctggttttgattaatgaggctatattcaaaagaaacactaaatgatgtggccagttagtgagaatgtagccttatctttactgacctcattttaatattcctactctggctgggcatggtggctcacgcctataatcccagcactctgggaggccgagacgggtggatcacctgaggtcaggggttcgagaccagcctggccaacatggtgaaaccccatctctactaaaaatacaaaaattagctgggtgtggtggtaggcgcctgtaatcccagctactcgggagtccgtggcaggagaatcgcttgaacccaggaggtggaggttgcagtgagctgagatcacgccattgcactccagcctgggtgacaagagcaaaactcagtctcaaaaaaaaaaaagaaaaaaaaagatatatatattcctactcttattaaatgaatatagcatttcttagcaacttcttttgatttgtgagtatatattttcttggcctcaaaattaaagtaaaaagtatcctcttactcagaggaggacaggggcaagagcctgggaccttatttgctaattaaaatgcacacacacacacacacacacagaaattttgagagccattttaatataattgcctccctagaaacataccttttagggaatttttatcactaaaccacatgttatttaaatacgtacatgtttaacataaatacatacataaaattcacatgcatacttaacacttatgttaaatatattcaatgtatatacatatgtacacaatatatgcatatatacatgtgggtatgtggtatgtgtgcatgtgtgtgtatggccagctacataatttgtgggactaagggcaaaatgaaactgtacggccctcgttcaaaaattaggtgtggggtgcttctaagcacagtcttgtgcaactgcacaggttgcatgtccatgaagccatcctgtgtgtgtgcacatatgtgtatgaatatgtattttatataatacatatatatgcatgtatgtatctgagaagaaatgtttaaaaggctacatacaagcttttccaggtctctactatctgttaactaactagagacataactcacaatatgcagtccccactgagtgttcaccataatttgagattcttggcatgttaacttttcattatggaatattgaataatttcaatattattcatacatttctttatgttcaaacatacacaaaaatagaataatgaaactctacccatcacccagctgcaacaaatatcaatactttaccgttcttaatacatctaaccccttactttttgtttgtttcttttggtgaagtatttaattgtaattttttttttaagagacaggatctcactctgtcacccaggccagagtacagtggtacgatcacagctccttgtaacctcgaactcctaggctcaagtgatcctcctgcctcagccgcttgaatagctgggactacatgcatacaccaacacacccaactaatttttaaattttttgtagaaatatggtcttgctgtgtttcccaggctggtctcaaactcctggccttgagagattctcctgccttggtcttccaaactgctgggattacaatatccggccctactggaatattttaaagtaaatctcaggtgttacatcattgcacttgtaagtactttaaaatgtatctctagcagataaatctttttaacaaaaccacagcatcattgtcacactcaaaaaattgacaagatttccttaattatcatataatagtctgtattgtttctatctcaaaaatacagttttcttggttgttgaaatctagatccaacattgcatttggttgatgtgtctcctttactctgtaaaatttacccctgcgttttagttcttttcggcttttatttgtcctgtggaatttcctccactcaggatttgactgagagtatccccagagtgtccagttagacctagaagctggatttgatcctggttcatttattttcccccaagaatactccataggtgatgctatacactttctcttacatcatttcaggaggaacatgatgtctgattgttccactttcagtgattttaatattgatcaatgagttctggtggtaccaactactacaaagtttctcatcaatctttcacctgatggttttagcagctattgataattgttgcctggatccattatttcatttcaggggttgtaaaatagtgattttctggttctatcaaacctcttgcatttatcatctatgattcttctttaaggaactttctctaaatctgaatgggaaagatgcgataaatatttatcaaattttagagtgagttagtgccctagcaacctccacagttgacaaatgagtatttctttaaagcaaggtatggcccaaccaatactttgaaactagcatgtttagaatagagcaggaggaaactatatttgaaaggtcagaagtggaaagactaagagggcctgaacaataagaggacagaaccaagaggagttggcaactaattggatgtggggattaaggaaaggtaagcatcaaagattacctccaagtttgttagaaggttagtagcaggattctgatgccattcaagtaaatacaagtctcagtcagatgaaccccaagagccacatgtatttgaggggtactttgtctcacacttttacctgttacatggttttcagtaatttagaatttaagccagtagtggggcgactgtacatctatcgacatggtgaggtagagcatgtttgggaggaaagacgttgaatcccatttggtgacagtgagcttgaggtgctgccagaacactgcactgaagataggaggagactgtaggaaatacaagataggaaaggtctccactgaaatgttaactctttctctctaaacggccatccaggcctcaatgtctgcagtttctgatctgtgattatgacttatccaaatcttacatttcttaaaaatagtcatagatgaagggaatcacagttgatagttatatggtgacattattggcttaaattctaaataactagaaactgtataataggcaaaactgtgaggcaaataaaatgcttctcaaatctgtgtggctcttatggggttaatttgatttggacctgtattaatttcttatggctgctataactaacaaattaccacaaacttggtggtttaaaacaacacacatttattctctttctgttctggaggccagaagtctaaaatgagattcactgggctgcagttcactgggcaaggccatgctcctctggaggcttccatgatgcatcccatattcagtgtttcccgagtaagccccacccatgcaggtctgcagttttacctcaacaggcttttgcactcagtggctctctcctgtggtttctatctgaaattctcttcattttttttttaataactgctttattgagatataattcacatgccatacaattcacctatacagtatacaattcagtagtgtttactatattcagagttgtgcaactatcatttttctcacccccaaaagaaaccctatgcccgttagtattcactctgttttctcacaactctaggtaaccactaatctactctccatctctatagatttgcccatgctagacatttcatataaatggaatcatacatgtggtctttttcactgagtatattttcaaggtgcatcccagctgtggcatgaatcagcatctcattcctttttattgccaaataatattctatcatatggatatgtcgcattttatgtatccattcatcagctgatggacatttgggttgtttgtactttttggctaccatgaataatgctactatgaacttttgtgtacaaatcttatgtggacttgttttcatttctcttggatgtatattcctaggagaatggctggattatacagtaactctttcctcataactttgcatatcaaaattatatccatctttcagaacccaaattcagtgttatttccaaagtgttccaacatctcccactcaaaatgaatcttctccctagtactcccattgtttagtacctaattgttcttaccagtttgtcttagagctcagtcattcctacacagcacttttcttcattatactgctaatttcattacactgtaagagtggggacaagctgttcttcttgtataccagaaagtagtgagtgcactgctgtgaagaaagcaggaactcaaaagttaagaattttgaatgagcctataaaatgtgtctaataaataataatgttcattttcaaatctcaacaattaaatgtttaacaaataacacttgaaataaatgtttattagaaaaaccaa

SEQ ID NO: 1538 - DNA, 1412 bp, Homo sapiens
agcagacgagggcttgtgcgagagggggccgggcggctgcagggaaggcggagtccaaggggaaaacgaaactgagaaccagctctcccgaagccgcgggtctccggccggcggcggcggcggcggcggcggcggcgcagtttctggagcaaattcagtttgccttcctggatttgtaaattgtaatgacctcaaaactttagcagttcttccatctgactcaggtttgcttctctggcggtcttcagaatcaacatccacacttccgtgattatctgcgtgcattttggacaaagcttccaaccaggatacgggaagaagaaatggctggtgatctttcagcaggtttcttcatggaggaacttaatacataccgtcagaagcagggagtagtacttaaatatcaagaactgcctaattcaggacctccacatgataggaggtttacatttcaagttataatagatggaagagaatttccagaaggtgaaggtagatcaaagaaggaagcaaaaaatgccgcagccaaattagctgttgagatacttaataaggaaaagaaggcagttagtcctttattattgacaacaacgaattcttcagaaggattatccatggggaattacataggccttatcaatagaattgcccagaagaaaagactaactgtaaattatgaacagtgtgcatcgggggtgcatgggccagaaggatttcattataaatgcaaaatgggacagaaagaatatagtattggtacaggttctactaaacaggaagcaaaacaattggccgctaaacttgcatatcttcagatattatcagaagaaacctcagtgaaatctgactacctgtcctctggttcttttgctactacgtgtgagtcccaaagcaactctttagtgaccagcacactcgcttctgaatcatcatctgaaggtgacttctcagcagatacatcagagataaattctaacagtgacagtttaaacagttcttcgttgcttatgaatggtctcagaaataatcaaaggaaggcaaaaagatctttggcacccagatttgaccttcctgacatgaaagaaacaaagtatactgtggacaagaggtttggcatggattttaaagaaatagaattaattggctcaggtggatttggccaagttttcaaagcaaaacacagaattgacggaaagacttacgttattaaacgtgttaaatataataacgagtcaaagactaagtgccttttcatccaaatggaattctgtgataaagggaccttggaacaatggattgaaaaaagaagaggcgagaaactagacaaagttttggctttggaactctttgaacaaataacaaaaggggtggattatatacattcaaaaaaaaaaaaaaaaaaaaaaaaaaaa

SEQ ID NO: 1539 - DNA, 564 bp, Homo sapiens
aatttaccccaatcccgtagcagacgagggcttgtgcgagagggggccgggcggctgcagggaaggcggagtccaaggggaaaacgaaactgagaaccagctctcccgaagccgcgggtctccggccggcggcggcggcggcggcggcggcggcgcaggtttgcttctctggcggtcttcagaatcaacatccacacttccgtgattatctgcgtgcattttggacaaagcttccaaccaggatacgggaagaagaaatggctggtgatctttcagcaggtttcttcatggaggaacttaatacataccgtcagaagcagggagtagtacttaaatatcaagaactgcctaattcaggacctccacatgataggaggtttacatttcaagttataatagatggaagagaatttccagaaggtgaaggtagatcaaagaaggaagcaaaaaatgccgcagccaaattagctgttgagatacttaataaggaaaagaaggcagttagtcctttattattgacaacaacgaattcttcagaaggattatccatggggaattacatag

SEQ ID NO: 1540 - DNA, 2930 bp, Homo sapiens
agcagacgagggcttgtgcgagagggggccgggcggctgcagggaaggcggagtccaaggggaaaacgaaactgagaaccagctctcccgaagccgcgggtctccggccggcggcggcggcggcggcggcggcggcgcagtttgctcatactttgtgacttgcggtcacagtggcattcagctccacacttggtagaaccacaggcacgacaagcatagaaacatcctaaacaatcttcatcgaggcatcgaggtccatcccaataaaaatcaggagaccctggctatcatagaccttagtcttcgctggtatcactcgtctgtctgaaccagcggttgcatttttttaagccttcttttttctcttttaccagtttctggagcaaattcagtttgccttcctggatttgtaaattgtaatgacctcaaaactttagcagttcttccatctgactcaggtttgcttctctggcggtcttcagaatcaacatccacacttccgtgattatctgcgtgcattttggacaaagcttccaaccaggatacgggaagaagaaatggctggtgatctttcagcaggtttcttcatggaggaacttaatacataccgtcagaagcagggagtagtacttaaatatcaagaactgcctaattcaggacctccacatgataggaggtttacatttcaagttataatagatggaagagaatttccagaaggtgaaggtagatcaaagaaggaagcaaaaaatgccgcagccaaattagctgttgagatacttaataaggaaaagaaggcagttagtcctttattattgacaacaacgaattcttcagaaggattatccatggggaattacataggccttatcaatagaattgcccagaagaaaagactaactgtaaattatgaacagtgtgcatcgggggtgcatgggccagaaggatttcattataaatgcaaaatgggacagaaagaatatagtattggtacaggttctactaaacaggaagcaaaacaattggccgctaaacttgcatatcttcagatattatcagaagaaacctcagtgaaatctgactacctgtcctctggttcttttgctactacgtgtgagtcccaaagcaactctttagtgaccagcacactcgcttctgaatcatcatctgaaggtgacttctcagcagatacatcagagataaattctaacagtgacagtttaaacagttcttcgttgcttatgaatggtctcagaaataatcaaaggaaggcaaaaagatctttggcacccagatttgaccttcctgacatgaaagaaacaaagtatactgtggacaagaggtttggcatggattttaaagaaatagaattaattggctcaggtggatttggccaagttttcaaagcaaaacacagaattgacggaaagacttacgttattaaacgtgttaaatataataacgagaaggcggagcgtgaagtaaaagcattggcaaaacttgatcatgtaaatattgttcactacaatggctgttgggatggatttgattatgatcctgagaccagtgatgattctcttgagagcagtgattatgatcctgagaacagcaaaaatagttcaaggtcaaagactaagtgccttttcatccaaatggaattctgtgataaagggaccttggaacaatggattgaaaaaagaagaggcgagaaactagacaaagttttggctttggaactctttgaacaaataacaaaaggggtggattatatacattcaaaaaaattaattcatagagatcttaagccaagtaatatattcttagtagatacaaaacaagtaaagattggagactttggacttgtaacatctctgaaaaatgatggaaagcgaacaaggagtaagggaactttgcgatacatgagcccagaacagatttcttcgcaagactatggaaaggaagtggacctctacgctttggggctaattcttgctgaacttcttcatgtatgtgacactgcttttgaaacatcaaagtttttcacagacctacgggatggcatcatctcagatatatttgataaaaaagaaaaaactcttctacagaaattactctcaaagaaacctgaggatcgacctaacacatctgaaatactaaggaccttgactgtgtggaagaaaagcccagagaaaaatgaacgacacacatgttagagcccttctgaaaaagtatcctgcttctgatatgcagttttccttaaattatctaaaatctgctagggaatatcaatagatatttaccttttattttaatgtttcctttaattttttactatttttactaatctttctgcagaaacagaaaggttttcttctttttgcttcaaaaacattcttacattttactttttcctggctcatctctttattctttttttttttttaaagacagagtctcgctctgttgcccaggctggagtgcaatgacacagtcttggctcactgcaacttctgcctcttgggttcaagtgattctcctgcctcagcctcctgagtagctggattacaggcatgtgccacccacccaactaatttttgtgtttttaataaagacagggtttcaccatgttggccaggctggtctcaaactcctgacctcaagtaatccacctgcctcggcctcccaaagtgctgggattacagggatgagccaccgcgcccagcctcatctctttgttctaaagatggaaaaaccacccccaaattttctttttatactattaatgaatcaatcaattcatatctatttattaaatttctaccgcttttaggccaaaaaaatgtaagatcgttctctgcctcacatagcttacaagccagctggagaaatatggtactcattaaaaaaaaaaaaaaaagtgatgtacaacc

SEQ ID NO: 1541 - DNA, 548 bp, Homo sapiens
gtgcgagagggggccgggcggctgcagggaaggcggagtccaaggggaaaacgaaactgagaaccagctctcccgaagccgcgggtctccggccggcggcggcggcggcggcggcggcggcgcagaatcaacatccacacttccgtgattatctgcgtgcattttggacaaagcttccaaccaggatacgggaagaagaaatggctggtgatctttcagcaggtttcttcatggaggaacttaatacataccgtcagaagcagggagtagtacttaaatatcaagaactgcctaattcaggacctccacatgataggaggtttacatttcaagttataatagatggaagagaatttccagaaggtgaaggtagatcaaagaaggaagcaaaaaatgccgcagccaaattagctgttgagatacttaataaggaaaagaaggcagttagtcctttattattgacaacaacgaattcttcagaaggattatccatggggaattacataggccttatcaatagaattgcccagaagaaaagactaactgta

SEQ ID NO: 1542 - DNA, 1533 bp, Homo sapiens
atggctggtgatctttcagcaggtttcttcatggaggaacttaatacataccgtcagaagcagggagtagtacttaaatatcaagaactgcctaattcaggacctccacatgataggaggtttacatttcaagttataatagatggaagagaatttccagaaggtgaaggtagatcaaagaaggaagcaaaaaatgccgcagccaaattagctgttgagatacttaataaggaaaagaaggcagttagtcctttattattgacaacaacgaattcttcagaaggattatccatggggaattacataggccttatcaatagaattgcccagaagaaaagactaactgtaaattatgaacagtgtgcatcgggggtgcatgggccagaaggatttcattataaatgcaaaatgggacagaaagaatatagtattggtacaggttctactaaacaggaagcaaaacaattggccgctaaacttgcatatcttcagatattatcagaagaaacctcagtgaaatctgactacctgtcctctggttcttttgctactacgtgtgagtcccaaagcaactctttagtgaccagcacactcgcttctgaatcatcatctgaaggtgacttctcagcagatacatcagagataaattctaacagtgacagtttaaacagttcttcgttgcttatgaatggtctcagaaataatcaaaggaaggcaaaaagatctttggcacccagatttgaccttcctgacatgaaagaaacaaagtatactgtggacaagaggaaggcggagcgtgaagtaaaagcattggcaaaacttgatcatgtaaatattgttcactacaatggctgttgggatggatttgattatgatcctgagaccagtgatgattctcttgagagcagtgattatgatcctgagaacagcaaaaatagttcaaggtcaaagactaagtgccttttcatccaaatggaattctgtgataaagggaccttggaacaatggattgaaaaaagaagaggcgagaaactagacaaagttttggctttggaactctttgaacaaataacaaaaggggtggattatatacattcaaaaaaattaattcatagagatcttaagccaagtaatatattcttagtagatacaaaacaagtaaagattggagactttggacttgtaacatctctgaaaaatgatggaaagcgaacaaggagtaagggaactttgcgatacatgagcccagaacagatttcttcgcaagactatggaaaggaagtggacctctacgctttggggctaattcttgctgaacttcttcatgtatgtgacactgcttttgaaacatcaaagtttttcacagacctacgggatggcatcatctcagatatatttgataaaaaagaaaaaactcttctacagaaattactctcaaagaaacctgaggatcgacctaacacatctgaaatactaaggaccttgactgtgtggaagaaaagcccagagaaaaatgaacgacacacatgttag

SEQ ID NO: 1543 - DNA, 5646 bp, Homo sapiens
tcctcgacggccgccgcccgcctggccttttagggcctgactcccgcccttcctggcctacactcctgggcggcggcaggcctagcttctggcccagtgcgggttccccggcggcaggcgtatcctgtgtgcccctgggccaggcccgaacccggtgtccccgggtggggggtggggacgccacggccgaagcagctagctccgttcgtgatccgggagcctggtgccagcgagacctggaatttccggtctggttggtctggggccccgcggagccaggttgataccctcacctcccaaccccaggccctcggatgcccagaacctgtaggccgcaccgtggacttgttcttaatcgagggggtgctggggggaccctgatgtggcaccaaatgaaatgaacaaagctccacagtccacaggccccccacccgccccatcccccggactcccacagccagcgtttcccccggggcagacagcgccggtggtgttcagtacgccacaagcgacacaaatgaacacgccttctcagccccgccagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccaccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcaatggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctc

SEQ ID NO: 1544 - DNA, 5667 bp, Homo sapiens
acttgcctgaaaccggctcctcgacggccgccgcccgcctggccttttagggcctgactcccgcccttcctggcctacactcctgggcggcggcaggcctagcttctggcccagtgcgggttccccggcggcaggcgtatcctgtgtgcccctgggccaggcccgaacccggtgtccccgggtggggggtggggacgccacggccgaagcagctagctccgttcgtgatccgggagcctggtgccagcgagacctggaatttccggtctggttggtctggggccccgcggagccaggttgataccctcacctcccaaccccaggccctcggatgcccagaacctgtaggccgcaccgtggacttgttcttaatcgagggggtgctggggggaccctgatgtggcaccaaatgaaatgaacaaagctccacagtccacaggccccccacccgccccatcccccggactcccacagccagcgtttcccccggggcagacagcgccggtggtgttcagtacgccacaagcgacacaaatgaacacgccttctcagccccgccagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccaccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcaatggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccgcaggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctca

SEQ ID NO: 1545 - DNA, 5516 bp, Homo sapiens
cggcggcgcagatcgcccggcgcggctccgccccctgcgccggtcacgtgggggcgccggctgcgcctgcggagaagcggtggccgccgagcgggatctgtgcggggagccggaaatggttgtggactacgtctgtgcggctgcgtggggctcggccgcgcggactgaaggagactgaaggccctcggatgcccagaacctgtaggccgcaccgtggacttgttcttaatcgagggggtgctggggggaccctgatgtggcaccaaatgaaatgaacaaagctccacagtccacaggccccccacccgccccatcccccggactcccacagccagcgtttcccccggggcagacagcgccggtggtgttcagtacgccacaagcgacacaaatgaacacgccttctcagccccgccagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccaccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcaatggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaa

SEQ ID NO: 1546 - DNA, 4990 bp, Homo sapiens
ggaaatggttgtggactacgtctgtgcggctgcgtggggctcggccgcgcggactgaaggagactgaaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccaccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcaatggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaa

SEQ ID NO: 1547 - DNA, 4986 bp, Homo sapiens
cgcggactgaaggagactgaaggtgctggggggaccctgatgtggcaccaaatgaaatgaacaaagctccacagtccacaggccccccacccgccccatcccccggactcccacagccagcgtttcccccggggcagacagcgccggtggtgttcagtacgccacaagcgacacaaatgaacacgccttctcagccccgccagggaggattcaggtctctgcagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccaccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcaatggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtag

SEQ ID NO: 1548 - DNA, 5129 bp, Homo sapiens
agaagcggtggccgccgagcgggatctgtgcggggagccggaaatggttgtggactacgtctgtgcggctgcgtggggctcggccgcgcggactgaaggagactgaaggccctcggatgcccagaacctgtaggccgcaccgtggacttgttcttaatcgagggggtgctggggggaccctgatgtggcaccaaatgaaatgaacaaagctccacagtccacaggccccccacccgccccatcccccggactcccacagccagcgtttcccccggggcagacagcgccggtggtgttcagtacgccacaagcgacacaaatgaacacgccttctcagccccgccagggaggattcaggtctctgcagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccaccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcaatggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtag

SEQ ID NO: 1549 - DNA, 5229 bp, Homo sapiens
gtgggggcgccggctgcgcctgcggagaagcggtggccgccgagcgggatctgtgcggggagccggaaatggttgtggactacgtctgtgcggctgcgtggggctcggccgcgcggactgaaggagactgaagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccaccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcaatggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaatt

SEQ ID NO: 1550 - DNA, 5229 bp, Homo sapiens; identical to SEQ ID NO: 1549

SEQ ID NO: 1551 - DNA, 4683 bp, Homo sapiens
atgaacacgccttctcagccccgccagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccaccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcaatggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccgcaggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactga

SEQ ID NO: 1552 - DNA, 5569 bp, Homo sapiens
gcagatcgcccggcgcggctccgccccctgcgccggtcacgtgggggcgccggctgcgcctgcggagaagcggtggccgccgagcgggatctgtgcggggagccggaaatggttgtggactacgtctgtgcggctgcgtggggctcggccgcgcggactgaaggagactgaaggccctcggatgcccagaacctgtaggccgcaccgtggacttgttcttaatcgagggggtgctggggggaccctgatgtggcaccaaatgaaatgaacaaagctccacagtccacaggccccccacccgccccatcccccggactcccacagcttgggtttctgccccacctgggcttcccctcttgctgaactctggtctcccctcttcagccagcgtttcccccggggcagacagcgccggtggtgttcagtacgccacaagcgacacaaatgaacacgccttctcagccccgccagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccaccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcaatggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaa

SEQ ID NO: 1553 - DNA, 5653 bp, Homo sapiens
gccagcgagacctggaatttccggtctggttggtctggggccccgcggagccaggttgataccctcacctcccaaccccaggccctcggatgcccagaacctgtaggccgcaccgtggacttgttcttaatcgagggggtgagtgaggggtctgtttcagtaggtcaggggttggttggaagtgatgcgggtttgacagcatgttggtggggacaggctgtatcttttctgcttcaccctcttggcatctctgggactccgtatgggacccagcccttgcatcaaccctttcaccgccccatttgccttaagcttgggtcccttcctcttcctgagcgccactctttcccaacaggtgctggggggaccctgatgtggcaccaaatgaaatgaacaaagctccacagtccacaggccccccacccgccccatcccccggactcccacagccagcgtttcccccggggcagacagcgccggtggtgttcagtacgccacaagcgacacaaatgaacacgccttctcagccccgccagggaggattcaggtctctgcagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccaccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcaatggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaatt

SEQ ID NO: 1554 - DNA, 596 bp, Homo sapiens
gagctggggcagggactacgagagcagccagatgggctgaaagtggaactcaagggatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcat

SEQ ID NO: 1555 - DNA, 5038 bp, Homo sapiens
tcacttgcctgaaaccggctcctcgacggccgccgcccgcctggccttttagggcctgactcccgcccttcctggcctacactcctgggcggcggcaggcctagcttctggcccagtgcgggttccccggcggcaggcgtatcctgtgtgcccctgggccaggcccgaacccggtgtccccgggtggggggtggggacgccacggccgaagcagctagctccgttcgtgatccgggagcctggtgccagcgagacctggaatttccggtctggttggtctggggccccgcggagccaggttgataccctcacctcccaaccccaggccctcggatgcccagaacctgtaggccgcaccgtggacttgttcttaatcgaggggcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccaccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcaatggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccgcaggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactga

SEQ ID NO: 1556 - DNA, 524 bp, Homo sapiens
agtgagccgattgggttctagatgggggtcctgggccccaggatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagtt

SEQ ID NO: 1557 - DNA, 5026 bp, Homo sapiens
tctagatgggggtcctgggccccagggtgtgcagccactgacttggggactgctggtggggtagggatgagggagggaggggcattgtgatgtacagggctgctctgtgagatcaagggtctcttaagggtgggagctggggcagggactacgagagcagccagatgggctgaaagtggaactcaaggggtttctggcacctacctacctgcttcccgctggggggtggggagttggcccagagtcttaagattggggcagggtggagaggtgggctcttcctgcttcccactcatcttatagctttctttccccagatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcaatggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccgcaggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaatt

SEQ ID NO: 1558 - DNA, 4668 bp, Homo sapiens
atatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcaatggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattc

SEQ ID NO: 1559 - DNA, 4311 bp, Homo sapiens
atgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcaatggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccgcaggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactga

SEQ ID NO: 1560 - DNA, 558 bp, Homo sapiens
gccggctgcgcctgcggagaagcggtggccgccgagcgggatctgtgcggggagccggaaatggttgtggactacgtctgtgcggctgcgtggggctcggccgcgcggactgaaggagactgaagatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaaccca

SEQ ID NO: 1561 - DNA, 542 bp, Homo sapiens
aaatggttgtggactacgtctgtgcggctgcgtggggctcggccgcgcggactgaaggagactgaaggtgctggggggaccctgatgtggcaccaaatgaaatgaacaaagctccacagtccacaggccccccacccgccccatcccccggactcccacagcttgggtttctgccccacctgggcttcccctcttgctgaactctggtctcccctcttcagccagcgtttcccccggggcagacagcgccggtggtgttcagtacgccacaagcgacacaaatgaacacgccttctcagccccgccagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagcccca

SEQ ID NO: 1562 - DNA, 983 bp, Homo sapiens
ctacgagagcagccagatgggctgaaagtggaactcaaggggtttctggcacctacctacctgcttcccgctgggggatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcaatggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagag

SEQ ID NO: 1563 - DNA, 4148 bp, Homo sapiens
tcttccggcaggaagtctgtgcgtcaggaggccggccaggactcagctccagccccgcgctcgcgtgtagccctacgtaaagcgtgaggggtttcgcgacaacccaggccccgcccctttggccacatgtcgcgcatgtcttcccgtcggacggcgtgccacctcgccgcgcagctttacgaacctagagcagcgccgccccgcctcctgtctccgtcctcacctccccgccccctcccagcttcgcgtctcctagctcgacgcgcccgctataatcacgtgattgcctcatccgggtcttttgcgttctctttccctctcccaacatggcggcctcagcaaaaaagaagaataagaaggggaagactatctccctaacagactttctggctgaggatgggggtactggtggaggaagcacctatgtttccaaaccagtcagctgggctgatgaaacggatgacctggaaggagatgtttcgaccacttggcacagtaacgatgacgatgtgtatagggcgcctccaattgaccgttccatccttcccactgctccacgggctgctcgggaacccaatatcgaccggagccgtcttcccaaatcgccaccctacactgcttttctaggaaacctaccctatgatgttacagaagagtcaattaaggaattctttcgaggattaaatatcagtgcagtgcgtttaccacgtgaacccagcaatccagagaggttgaaaggttttggttatgctgaatttgaggacctggattccctgctcagtgccctgagtctcaatgaagagtctctaggtaacaggagaattcgagtggacgttgctgatcaagcacaggataaagacagggatgatcgttcttttggccgtgatagaaatcgggattctgacaaaacagatacagactggagggctcgtcctgctacagacagctttgatgactacccacctagaagaggtgatgatagctttggagacaagtatcgagatcgttatgattcagaccggtatcgggatgggtatcgggatgggtatcgggatggcccacgccgggatatggatcgatatggtggccgggatcgctatgatgaccgaggcagcagagactatgatagaggctatgattcccggataggcagtggcagaagagcatttggcagtgggtatcgcagggatgatgactacagaggaggcggggaccgctatgaagaccgatatgacagacgggatgatcggtcgtggagctccagagatgattactctcgggatgattataggcgtgatgatagaggtcccccccaaagacccaaactgaatctaaagcctcggagtactcctaaggaagatgattcctctgctagtacctcccagtccactcgagctgcttctatctttggaggggcaaagcctgttgacacagctgctagagaaagagaagtagaagaacggctacagaaggaacaagagaagttgcagcgtcagctggatgagccaaaactagaacgacggcctcgggagagacacccaagctggcgaagtgaagaaactcaggaacgggaacggtcgaggacaggaagtgagtcatcacaaactgggacctccaccacatctagcagaaatgcacgaaggagagagagtgagaagtctctagaaaatgaaacactcaataaggaggaagattgccactctccaacttctaaacctcccaaacctgatcagcccctaaaggtaatgccagcccctccaccaaaggagaatgcttgggtgaagcgaagttctaaccctcctgctcgatctcagagctcagacacagagcagcagtcccctacaagtggtgggggaaaagtagctccagctcaaccatctgaggaaggaccaggaaggaaagatgaaaataaagtagatgggatgaatgccccaaaaggccaaactgggaactctagccgtggtccaggcgacggagggaacagagaccactggaaggagtcagataggaaagatggcaaaaaggatcaagactccagatctgcacctgagccaaagaaacctgaggaaaatccagcttccaagttcagttctgcaagcaagtatgctgctctctctgttgatggtgaagatgaaaatgagggagaagattatgccgaatagacctctacatcctgtgcttttctcctagtttctctccaccctggaacattcgagagcaaatcaaaacctctatccagacaagacaaaataaaactcaccatctcctgaagacctttcttacctttttttaaaaacaaaaaatgaaattattttgcatgctgctgcagcctttaaagtattgaagtaactggagaattgccaatacagccagagagaaagggactacagctttttagaggaaaagttgtggtgcgttatgtcaccatgcagttgccagtgtgattagtgcctaggggtctccatttagcagaaatggtaatgacagtgatataatgcctggaacctggttgggcagtaggggagggaggtagaaggaaaagtgtgagatttctaccttttagtttttatcctattgtggcatatatgaattctcaaacattatctgaataaattttccactcttggaaaggtagatttagcctcaagttgttctagtctccaggaggctgccagcccctcctcttatttaattctgagttttgggggccagcctagagggaattccttttttttttttaaccccccaggggggtagttgggagtgagactataggccataaagaatgggactgcattggaccaaaataaatgggaaaatcgtggtttgaaaagaagcttttgggaagtgatgagtcattttgcaccaggtaataggggaaaattgtgtgacctccagcaaacacatgaatggttatttcctggagccggaagcacttgggggtcgtggtaattcccagtgttttctgtgtcctagttttaccctttctaaacactgtcctttttgaaagttttgaatatatccacattctattgaaaccttgaaactaaaaatttagactcttatcatcatcttaagttcttcatgctactcttaacctcccaaaaagcagtatctaagtcacatacatgatgtcttgggcattttctcagccatggagaactctgaaaggaagaatcgctgcttttctcaagcaaatcggtttcttgatgtcttttggttctccttgcctgctcctgatgcttggaccccttttattgatcagagtgctctagaataatggatggtcttggatgatggataaatagggacagggacagttaaattgggagcctttcttacaaccttgatgggatttttccccccaagtttccttctccactgaaatgccacactaatgcttgttggattcatgaggtggccagaccaatgtgttgttttgttgttgtttttttaagcttcccttgagagaataaatggtaatggagagaactatttaacaaggtcctggtttctcttgcaacacagtagctaaacttgcctgcttttatatgcatttttgtagggatcagcttggtagacagtattagcggagaaacaccttgatcttggtttgcaagcccttctcccatcagtcctagattaggccctgttcagccatgcaggggtgttggtttatgcgtgctgcagcagtgggcataatgaatataatttacccagtggacaaaggtgtgtaccaagtgaatttaaataattggtgtggattggccagtagctaagaagtgggcttttaaagagtattgaagattgaaagggtttttctttcttttttaaaaaagaaaaacaaactattgattgtagataatgaaaagctagggtttgccctcttcatgtctactctccttccaaatagttatatccaaaactgtttttccctctcccctaccttgtcccccctattaaaatagaaacagggattgattaatgtcccgctcctgaatacatgtaaaatttgtacaaaaatatcttctatgaaaatgatttgtaatctgtagacttattacctgggagatgtcttgatgtaaaatcccatcctttgggttgtgggttttttgttttctccaaataaatctgatctttaaagttca

SEQ ID NO: 1564 - DNA, 1899 bp, Homo sapiens
cttttgcgttctctttccctctcccaacatggcggcctcagcaaaaaagaagaataagaaggggaagactatctccctaacagactttctggctgaggatgggggtactggtggaggaagcacctatgtttccaaaccagtcagctgggctgatgaaacggatgacctggaaggagatgtttcgaccacttggcacagtaacgatgacgatgtgtatagggcgcctccaattgaccgttccatccttcccactgctccacgggctgctcgggaacccaatatcgaccggagccgtcttcccaaatcgccaccctacactgcttttctaggaaacctaccctatgatgttacagaagagtcaattaaggaattctttcgaggattaaatatcagtgcagtgcgtttaccacgtgaacccagcaatccagagaggttgaaaggttttggttatgctgaatttgaggacctggattccctgctcagtgccctgagtctcaatgaagagtctctaggtaacaggagaattcgagtggacgttgctgatcaagcacaggataaagacagggatgatcgttcttttggccgtgatagaaatcgggattctgacaaaacagatacagactggagggctcgtcctgctacagacagctttgatgactacccacctagaagaggtgatgatagctttggagacaagtatcgagatcgatatggtggccgggatcgctatgatgaccgaggcagcagagactatgatagaggctatgattcccggataggcagtggcagaagagcatttggcagtgggtatcgcagggatgatgactacagaggaggcggggaccgctatgaagaccgatatgacagacgggatgatcggtcgtggagctccagagatgattactctcgggatgattataggcgtgatgatagaggtcccccccaaagacccaaactgaatctaaagcctcggagtactcctaaggaagatgattcctctgctagtacctcccagtccactcgagctgcttctatctttggaggggcaaagcctgttgacacagctgctagagaaagagaagtagaagaacggctacagaaggaacaagagaagttgcagcgtcagctggatgagccaaaactagaacgacggcctcgggagagacacccaagctggcgaagtgaagaaactcaggaacgggaacggtcgaggacaggaagtgagtcatcacaaactgggacctccaccacatctagcagaaatgcacgaaggagagagagtgagaagtctctagaaaatgaaacactcaataaggaggaagattgccactctccaacttctaaacctcccaaacctgatcagcccctaaaggtaatgccagcccctccaccaaaggagaatgcttgggtgaagcgaagttctaaccctcctgctcgatctcagagctcagacacagagcagcagtcccctacaagtggtgggggaaaagtagctccagctcaaccatctgaggaaggaccaggaaggaaagatgaaaataaagtagatgggatgaatgccccaaaaggccaaactgggaactctagccgtggtccaggcgacggagggaacagagaccactggaaggagtcagataggaaagatggcaaaaaggatcaagactccagatctgcacctgagccaaagaaacctgaggaaaatccagcttccaagttcagttctgcaagcaagtatgctgctctctctgttgatggtgaagatgaaaatgagggagaagattatgccgaatagacctctacatcctgtgcttttctcctagtttctctccaccctggaacattcgagagcaaatcaaaacctctatccagacaagacaaaataaaactcaccatctcctg

SEQ ID NO: 1565 - DNA, 1097 bp, Homo sapiens
gagtattgcctttggcccccacccccacgggtccccgcgctccgtcttccttctgactgggggactccgcgggacggcgttcccggcgcgcactgtaccccttgccgccccttccccttcatgttggacctgacctcccgcggacaagtggggacgtcccggaggatggccgaggcggcgtgtagcgcacactttctggaaaccacccctactcctaatcccccgactacagaagaggagaaaacggaatctaatcaggaggttgctaacccagaacactatattaaacatcccctacagaacagatgggcactctggttttttaaaaatgataaaagcaaaacttggcaagcaaacctgcggctgatctccaagtttgatactgttgaagacttttgggctctgtacaaccatatccagttgtctagtaatttaatgcctggctgtgactactcactttttaaggatggtattgagcctatgtgggaagatgagaaaaacaaacggggaggacgatggctaattacattgaacaaacagcagagacgaagtgacctcgatcgcttttggctagagacacttctgtgccttattggagaatcttttgatgactacagtgatgatgtatgtggcgctgttgttaatgttagagctaaaggtgataagatagcaatatggactactgaatgtgaaaacagagaagctgttacacatatagggagggtatacaaggaaaggttaggacttcctccaaagatagtgattggttatcagtcccacgcagacacagctactaagagcggctccaccactaaaaataggtttgttgtttaagaagacaccttctgagtattctcataggagactgcgtcaagcaatcgagatttgggagctgaaccaaagcctcttcaaaaagcagagtggactgcatttaaatttgatttccatcttaatgttactcagatataagagaagtctcattcgcctttgtcttgtacttctgtgttcatttttttttttttttttggctagagtttccactatcccaatcaaagaattacagtacacatccccagaatccataaatgtgttcctgg

SEQ ID NO: 1566 - DNA, 11523 bp, Homo sapiens
aggcacaggcagcctgcatacactccttttcctggtgtcaacattatttaaaagcatgggaaatagtaatgagacagtgtcttcttcattagaaccttaggagtctactagatttcttcatctctatttgttgttattagtagccaaactgtgcaaaaaacacggtcttgagaaatgacagcacagtatcttagagggaaaggaaatgtaggatgccagtgtggggacaaatttctgattgccagtgattgttgtgagcataacaataatttcatgaacattaaagcctctattgagggcagctgcagttgtaaaggaaaaaaaatggtcctgaacatttaaaactacactggtgtacatcataatcaaacaaagtaaacagaaaaaaatttaaactttgctaaaaaaaaaaagcagaagcacttgatctttaggaaggcacgcagttgcttattatgaatcatttctagagtccgatgcattttcaaagccggttacagtcattacgaagcacacccttgtgaggtaagtgtatcatcacctttggttcataaataaaaaagctgagacgccgagcgattaagtcactcgcctaaggagaatgagtcaacgtcaagagtcatagttgacccggcctaaagactccagaccatcagtccagggcttagtcagcggggcccggagtggcttccctggctggcatctggacttaggctatttccgtgcacgtaaaagcggaatattggaacggttgcacagaacttccaaataatttttaccgccacgcaagatttagccctgaggtcttaatctcaggatttgggacagtaaaagctgtcgtccctccccctcgtccagccggtggcaagcgggtactgcgggcggttccgtccgtcccctttcgcagaaatggcaacgaatgaccaccagcattagctgagccaggggacgtgggagggttgattgcctaaacgactctgcatcgccgcctctttttgaaactaagagaaaatggtgggagatcaaaagaaaactaaataaacacacaggcaacttgtcctgggacctcaactaagcaaatgaagccttattgtgtgtgctgagcctgcagttcccaaccttccggggaagatgggaggacagggcgacaaagggcacagtaggcttgcctggcagtaagtgtgaccgcagctatccaggcggaagagcagaggactgaaaccaccctccagcaagcgagtgtccgccgcgttgagaaccgcgcaccctacccatcggccacgtgaccagtcctttttaaaaaaaatttctttaccttaaaaaaaaaaaaaaaaaaaaggtgggggagagactccacttcccagaagcctctcgttactcacgcagccgcagtcttgcgcaggtgccgccagggccaaacggacatatccgtcacgtggccagaagctggccaatccggtttgaatctcatttttttcctcttacccccccttctggagcggttgtgcgatcagatcgatctaagatggcgactgtcgaaccggaaaccacccctactcctaatcccccgactacagaagaggagaaaacggaatctaatcaggaggttgctaacccagaacactatattaaacatcccctacagaacagatgggcactctggttttttaaaaatgataaaagcaaaacttggcaagcaaacctgcggctgatctccaagtttgatactgttgaagacttttgggctctgtacaaccatatccagttgtctagtaatttaatgcctggctgtgactactcactttttaaggatggtattgagcctatgtgggaagatgagaaaaacaaacggggaggacgatggctaattacattgaacaaacagcagagacgaagtgacctcgatcgcttttggctagagacacttctgtgccttattggagaatcttttgatgactacagtgatgatgtatgtggcgctgttgttaatgttagagctaaaggtgataagatagcaatatggactactgaatgtgaaaacagagaagctgttacacatatagggagggtatacaaggaaaggttaggacttcctccaaagatagtgattggttatcagtcccacgcagacacagctactaagagcggctccaccactaaaaataggtttgttgtttaagaagacaccttctgagtattctcataggagactgcgtcaagcaatcgagatttgggagctgaaccaaagcctcttcaaaaagcagagtggactgcatttaaatttgatttccatcttaatgttactcagatataagagaagtctcattcgcctttgtcttgtacttctgtgttcatttttttttttttttttggctagagtttccactatcccaatcaaagaattacagtacacatccccagaatccataaatgtgttcctggcccactctgtaatagttcagtagaattaccattaattacatacagattttacctatccacaatagtcagaaaacaacttggcatttctatactttacaggaaaaaaaattctgttgttccattttatgcagaagcatattttgctggtttgaaagattatgatgcatacagttttctagcaattttctttgtttctttttacagcattgtctttgctgtactcttgctgatggctgctagattttaatttatttgtttccctacttgataatattagtgattctgatttcagtttttcatttgttttgcttttgtttttttcctcatgtaacattggtgaaggatccaggaatatgacacaaaggtggaataaacattaattttgtgcattctttggtaattttttttgttttttgtaactacaaagctttgctacaaatttatgcatttcattcaaatcagtgatctatgtttgtgtgatttcctaaacataattgtggattataaaaaatgtaacatcataattacattcctaactagaattagtatgtctgtttttgtatctttatgctgtattttaacactttgtattacttaggttattttgctttggttaaaaatggctcaagtagaaaagcagtcccattcatattaagacagtgtacaaaactgtaaataaaatgtgtacagtgaattgtcttttagacaactagatttgtccttttatttctccatctttatagaaggaatttgtacttcttattgcaaggcagtctctatattatgtcttcttttgtggtgtcttccatgtgaacagcataagtttggagcactagtttgattattatgtttattacaatttttaataaattgaataggtagtatcatatatatggaattaaattgatgtggctatctttgtttttttataaagtaaggcacagtcattcagtcttaggtaaataatgtactctcttaatatgttaatactcatgagaattgggatctgatgcatcaccatttgattggtagcaacagtggttgtaaaacttggttgctgaattgagttgtttctatgttaagtgtcaaaatgatagtgtagggaaagtacaggtggtggggacatatgcattaagaatcttgttagtgttgcaatctaaatagaatggaataaacaggtgttaagacatatttatagtggtaaattgttgtagtatggtattctgtaaacttgaaaacttgatctactctttgtaggtatcatttgaaagcaaacttgaaaatgttttgtacatagtacatacttgtatagtcctgtgagatgaagtatggctatcagaccaaaggataagccaaactgtaggtagcagaatggaaattattattttgagaggaaaatttgtctttgaatggtgattatgacttaatcattttaaaactgataaacttgacaaaaaccctgtatgaaataaacatgaaattaatagcactgatttcattgtaaaattttaaagcagtttaaagggtaccacaggttatcacagtactctcaatgccacaaacacctcttgttcagtattctagaaatactgaatcagaattctgtgtttattataatctcagcatactgtacataatatctgctagttaaacttgggtaattggttaaggtgacttactgtctatgtcaatatgtatagttttgagtacttcaagagtttacttaaaagtgatgatgttactggtatgttggcagtgggtgggactgaagtagtgtatctattataaattgatctattttcttaattctaagatgaagtccaattttaagcatcagcttttaggtgcaaaggaggaattaacacattaaatgtatacagttctaaatttttgaaataactgatgtgtagcatttgattattggtattaccattttagaatcatgatgttattttaaacctttttcctggggacaagaaaggataataaattacgctgaatcacttttggcagttgccacttaaatagtacagtgacttgcaacttttataactttatcagcatcttctctaaatacaaaattaggctatatgttattttccaacttactgttttctctctgtttagcaggatattataaatagattaaatagatatattttctttttttttttttttttttgagacggagtctcgctttgtctcccaggctggagtgcagtggcgtgatctcccagtagctgggactacaagcacctgccaccatgcccggctaattttttttgtatttttagtagagacggggtttcactgtgttagccaagatggtctcaatctcctgactttgtgatctgcctgcttctgcctcccaaagtgctgggattacaggtgtgagccaccgtacccagcccaaatagatgtattttcataatagagaattgaaataggctttaatgggtgaatagcagtttattgtaggcatgtgacatttcatttaatgaatttaaagtttattatcccaattctacagaaggatttaatgcatactatgcaattaaataattataacactacatagtaataatttatgtgccaggcagtagttcagtcactttacatgcttattaacctgcagaataatcttttgagatgtaggtgctgttactgagaatttaacttttgcttgtaaattgcaaagggtggatttgaattctggaaatttggttccagagacaataattacataacactttctccatagggtacagcctgtctaataggctatagtaaatcacctcagcttgttataggtcgggcatgcaaacatttctccattttactccctttggtaatgaatctagtaatagatggaaattttccctagattcactgtgttagtcagttggggaagtttggaggcaaagatacaggagtttatggggaggtagtgtacataaatataatcatatgctatataaggaagttttggtcagcagcagaccatatataggatggtgggccagtaacattgtaacactgtatttttactgtatcttttccatgttttgttatgtttagatacacaaataacattatggagtattcagtatggtaacatgccatacaggtttgtagcctaggagcagtaatagactgttccctgaaacctatatttgtggtaggtttataccattcaggtttgtgtaagtacacaacgaaatcatctaatggcccatttctcaaaacatattcccatcattaatcaatgcatggtcatgttttcgtatacattttaagcttctgtattctaatctaatataaatggcaaaatattcaaactgataggcattgagattcttaaatgctaaagttgcattcaaaaggataattttaggcgttgtgacaaagcagtgttatattttaaagttagtgacaaggctatgcaccttttatctctaattgtttcttacagaatgtttttattattgagtagtaaaacaataaatgtcagatcctttatacaaattcaagattgacattgataaacaaaacttcagcatatcactcaaggtcagcgtagaaattgtgtgtctggaaacttctatagtaattttatattactgtgacattagtatgtgatcacttttctagtaatgttttaaaaaaatatatcttacaggccaggcatagtgctttatgcctgtaatcccagcactttgggaggccaaggtggcaggattgcatgagtccaggagttcaacaccagtctgggcaataaagtgagaccccatcgctacaaacaaattaaaaaatatttatgtatgtgtgtaatatatataatatataacaaaacacatatgtatgtgtatatatagtatgtctggcagagtacaatttaggggttaagactggtccctcacatatggtgtgagaaacactgttcacaggttgctttccccattagcccagggcaactcatttgcccatcatttcctagaacaaccgggtctgttacgtctacagttttcatcttcatgcagttatggatttggtgtcaaaaactttggtcctgttctctaccatcttaaaataaactcttgtgtcctgctttactatgaattgcaaagtaggcattaggtagccttcctactaccatagtttagagttcaatattcttatgaccattctactggtagaagcaaaaaatgaacttgtaggcatgtgatcacatgtgcctatggtgctgtcttttccagtacaggggaactaattttcatattttaatcttgcagctttttgtttacttcatgcattgtgatttctcatagttttgcacagaactcacttccctaccttttctgaaacaaaagtatgtatacacacatacatatgtattgagcacctctatttactgtgttccacgtgctgggcatatagcaagaacagaatggtctggggccctgctctaaagaagatttaaaagcaaacatatattaaaaatgcgtgagtctggccaggagcagtggctcatgcctgcaaccccagcactttgggaggctgaagcgggtgaatcacctgagatcaggagttgagaccagcctggccaacatggtgaaaccccgtctctactaaaaatacaaaaattagcctggcatggtggcatgcgcctgtaattccagctactttggagactgagacaggagaatcacttgagcccaggaagtggaggttgcagtgagctgagatcgcgccactgcactccagcctgggtgacagagcaagactccatctcaaaaaaaaaaaaaaaacgtgtctgttcataaggttctacaaatagctgttgttacagaaaataggactagggttttattactggggattatgcagtcgaggtaaatataaaatgaggttgtttcttcttttttttatttgagacagagtcttgtttgccaggctggagtgcagtggcgtgctcttagctccgcctcccgggatcaaacgattctcttgcctcagcctctcgagtagctgggactacaggcgcgtgccaccacacccagctgatttttgtatttttagtagagatgggatttcaccatgatggccaggatggtctcgatcttttgacctcatgatccacccacctcggcctcccaaagtgctgggattacaggcgtgagccactgcacccggccctggttctaaatactcttccagctctaaaacattgattctaaacagatcacattccaggaggactctagcaaaccagcatatgcaaattatagcttttgcaagaccgtttctacttttatattactgaactctatatgattgtccaagtaaagttttgtgtctctttgattatttgattgtactttaaaattttttcaccattcatttaacattttttaccatactgtagtatttttaatgcaattgtgtttgcattggtgtggctttagaggcttctccaaccaccttcccaaaatactgatctgtgatttttttctttaatgtttggccaaacataatacatgcttattttatttttcatccctacagaaaggtagaagatgagaattctgtctcctactgttgtttttcaaggtgccactcaaatttcttgtacgtgtctagaaacttgtgcatacaatagaagtacactgtggctgggcatggtggctcatgcctgtaatcccagcactttgtgaagctgaggtgggtggatcacctgaggtcagggagtttgagaccagcctggccaacatgatgaaaccccgtctttactaaaattagaaaaaattagccaggcgtggtggtgtgcgcctgtaatcccagctactcgggaggctgaggcatgagaatcacttgaactcgggtggcagaggctgcagtgagctgagatcatgccactgcattccagcctgcgcagctgagccagactccatctccaaaaaaaaaaaaaaaaaaaaaaaaagatgtccaatatatgtaacttttttctttggacacaaaaattccattagctttgttttctcatttttacttgtcatgatgtatgtcgaacacattatttttagtgtctggtgttccattatacagatgtctctcttgttggttgaatttttgcattcacagaccctcaagttggattcatatctttttacactaagcataaagaagacggattggggtcgggtatggtggctcacgcctgtaatcccagcacttcgggaggctgaggtgggcggatcacgaggtcaggagttcgagaccagcctggccaacatactgaaaccccgtctctaaaaatatgaaaaaaaaattagccaggcgtggtggtgcgcagctgtagccccagctacttgggaggctgaggcaggagaatcacttgaacccaggaggtggaggttgcagtgagcatattgcaccattgcattccagcctgcacgacagaggaagacgccatttcaaaaaaaaaaaaaaaaagacggattgattttcttcagcagtatcaagtggcacttaccatccacccctttaacacccaaaccattctaatccatgtatacagaccatcatctgtttcgttattgtgttctataatgcagctttgcgagttatgcagttttggtcctcatgatatttttctgattggtttttaatgtattttgttctaacgagccaacattgttatacatgtaatttgtttatttgctagattgtactctttcccaaagatgggctatgaactagcatctactttcattttacctatttacctgtaaacattgaaaaaactgaatcaaatgcagtgatatcggacctagttttattgttatgccttataatgaatttaacttcacagttttctaaatgagagcatttcccaaagacatctttatggtcataaccagtttcccttggcatttgatttatttttatttttatttatttatctttttgagaaggagtttcgctcttgttgcccaggctagagtgcaatggcgtgatctcgggtcactgcaacctctgcctcccgggttcaagcgattctcctgcctcagcctccaagtagctgggattacaggcatgcaccaccacgcccgactaatttgtatttttagagacggggtttctccgtgttggtcaggctggtctcaaacttccaacctcaggtgatccgcccgccgtggcctcccaaagtgttgggattacaggcgtgagccacagtgtctggcctgatttgtttttaagagcattatttttctgctttattttgtgacttcaacatttgacacaattttgggtgaatggtttgtgcatggtgcctgacatcgtgttttgatgtgtagtatatgccataggacatgtgagacaagatatgtcccaacttgaccttgttttgtattgtttatgtcaaggtgttgagtgtattagatatactgttggggctctgtgttctagctctgccttttagataataaccatggttaaatattgcaatgtcctgcatgtctccacacatgggttttgtaactgagtcagaatgataagtgattagtaagcacattttttctcctttcaggaaaccactattttccttttctacatgctgttttgtaagtagtacttttatgaaggttgtcttcaaatgttcgcatcttccatttctactgcccttgggttatccatcctgtcattttgtgccaatcacttttttttttaacttttaagttcagggatgaaagtgtagatttgttacataggtaaacttgtgtcatggggttgttgtacagattatttcatcacccaggtgttaagcctagtatgcactagttgtttttcctgatcctctccctgctcccaccctccaccctctgataggccccagtgtgtgttgttcccctctgtgtgtccatgtgttctcatcatttagctcccacttacaagtgagaatgtggtgtttggttttctgttcctgcattagtttgctaaggataatggcctcgagctccatccaagtccctgtaaaggacatgatcttgtacttttttatggctgcatagtattctgtggtgtatatgtaccacattttctttatccagtctatcattaggcatttaggttgattccatgtttttgctattgtgaatagtgctgcaatgaacatacatgtgcatgtctttttataatagaatgatttatattctgttgtgtatatacccagtaatgggattgctgagttgaatgctatttctgcctttaggtctttgatgaattgccacactgtcttccacaatggttgaactaatttacactcccaccaacggtgaataagtgttcacttttctccacaaccttgtcagcatctattattttttgactttttagtaatagccattctgactgctcacatctattttgtaaataaagttttattgaaacatggccttacccatttgtttacatatattcatggctgtttttgtgccacaatgtcagagttgtcttaaagtagacagagactatctggctgtaaagcctgagatatatactaactggttctttatgtaaaaagtttgctgaccacctactctaaacgttttgcagtgatggtagtgttggcaaaaaaccaaatagcttaccctctttaaatttcccttttacttcttacaaactcctaacaccatttacgactttgtcatcaatatggtcaactaagcttggtttgcatggctctacttcctttcaccttccacttaggcagtgtctccaagtccactgcagtttctatttgtctcctgactgttactgtatcagttcttacctaaataacataacaactgatctccctactttttgcctatgccctcaaatgtgctcattgttgatctatctccctgttaggtgttctttttctcctctttagaaagcagccaaggaaaccagggttctctcaaagtggaaaatactggaacttatgtactgttatcataatgatagttggtgttttgaattataagaatgattccaggtggtttctaaatcatccaataaagctgtattcactctgta

SEQ ID NO: 1567 - DNA, 898 bp, Homo sapiens
gtgcgatcagatcgatctaagatggcgactgtcgaaccggaaaccacccctactcctaatcccccgactacagaagaggagaaaacggaatctaatcaggaggttgctaacccagaacactatattaaacatcccctacagaacagatgggcactctggttttttaaaaatgataaaagcaaaacttggcaagcaaacctgcggctgatctccaagtttgatactgttgaagacttttgggctctgtacaaccatatccagttgtctagtaatttaatgcctggctgtgactactcactttttaaggatggtattgagcctatgtgggaagatgagaaaaacaaacggggaggacgatggctaattacattgaacaaacagcagagacgaagtgacctcgatcgcttttggctagagacaagatgggatcttgctatgttgcccaggttggtctcaaacttctggcctcaagtgatcctcccacttcagcctcccaaagtgctggaattacagcttctgtgccttattggagaatcttttgatgactacagtgatgatgtatgtggcgctgttgttaatgttagagctaaaggtgataagatagcaatatggactactgaatgtgaaaacagagaagctgttacacatatagggagggtatacaaggaaaggttaggacttcctccaaagatagtgattggttatcagtcccacgcagacacagctactaagagcggctccaccactaaaaataggtttgttgtttaagaagacaccttctgagtattctcataggagactgcgtcaagcaatcgagatttgggagctgaaccaaagcctcttcaaaaagcagagtggactgcatttaaatttgatttccatcttaatgttactcaga

SEQ ID NO: 1568 - DNA, 1020 bp, Homo sapiens
gtgcggaagagcccgtgagcagacgggagtgggtcggggggcggcgggggatcccacgtggaagcagcgtcctggagctgggtggggctgcggcgcggactacaaatcccaggggcgtggggcgggagaggcggaaggggcgtcctggggcggggcggcacggggcgaggcggagcgaggctggaggcgcgggagggcagcgagaggttcgcgggtgcagcgcacaggagaccatgtccgggggcagcagctgcagccagaccccaagccgggccatccccgccactcgccgggtggtgctcggcgacggcgtgcagctcccgcccggggactacagcacgacccccggcggcacgctcttcagcaccaccccgggaggtaccaggatcatctatgaccggaaattcctgatggagtgtcggaactcacctgtgaccaaaacacccccaagggatctgcccaccattccgggggtcaccagcccttccagtgatgagccccccatggaagccagccagagccacctgcgcaatagcccagaagataagcgggcgggcggtgaagagtcacagtttgagatggacatttaaagcaccagccatcgtgtggagcactaccaaggggcccctcagggccttcctgggaggagtcccaccagccaggccttatgaaagtgatcatactgggcaggcgttggcgtggggtcggacaccccagccctttctccctcactcagggcacctgccccctcctcttcgtgaacaccagcagatacctccttgtgcctccactgatgcaggagctgccaccccaaggggagtgacccctgccagcacaccctgcagccaagggccaggaagtggacaagaacgaacccttccttccgaatgatcagcagttccagcccctcgctgctgggggcgcaaccaccccttccttaggttgatgtgcttgggaaagctccctccccctccttccccaagagaggaaataaaagccaccttcgccctagggccaaga

SEQ ID NO: 1569 - DNA, 2267 bp, Homo sapiens
gcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttataaagagtca

SEQ ID NO: 1570 - DNA, 1989 bp, Homo sapiens
aaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggta

SEQ ID NO: 1571 - DNA, 2443 bp, Homo sapiens
agagccagcggacggaaccattccaaacagcctagtctcgtgctgagagcctctccggtttcacgctgagacccgctcacccccgctctggccccttagatgctattttggcccgagtgtcacgtcgggcgctctttagagaggactgggacaagagttgcggacgcgaagaacgagtaagcggtggttcatccctcctgaccccacccccgtggcctggcccgatggtcgcgcccggggttgcgagatttgcgcctgcgcagtgcggcgcctagagggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttataaagagtc

SEQ ID NO: 1572 - DNA, 2654 bp, Homo sapiens
ggacggaaccattccaaacagcctagtctcgtgctgagagcctctccggtttcacgctgagacccgctcacccccgctctggccccttagatgctattttggcccgagtgtcacgtcgggcgctctttagagaggactgggacaagagttgcggacgcgaagaacgagtaagcggtggttcatccctcctgaccccacccccgtggcctggcccgatggtcgcgcccggggttgcgagatttgcgcctgcgcagtgcggcgcctagagggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcggagtttttttttcttccttcttttaaaaatggttgtttaagactttaacaatgggaaccccttgtgagcatgctcagtatcattgtggagaaccaagagggcctcttaactgtaacaatgttcatggttgtgatgttttttttttttttttaaataaaattccaaatgtttataaagagtca

SEQ ID NO: 1573 - DNA, 2207 bp, Homo sapiens
gcggcgcctagagggaaagcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggta

SEQ ID NO: 1574 - DNA, 2189 bp, Homo sapiens
aacgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactgtagaagggaccagtacaggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggtagtgtgcg

SEQ ID NO: 1575 - DNA, 587 bp, Homo sapiens
agcgagagggagacggacgttgagagaacgaggaggaaggagagaaaatggcgtccacggattacagtacctatagccaagctgcagcgcagcagggctacagtgcttacaccgcccagcccactcaaggatatgcacagaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagc

SEQ ID NO: 1576 - DNA, 1265 bp, Homo sapiens
cgaggaggaaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagaccgcaggatggaaacaagcccactgagactagtcaacctcaatctagcacagggggttacaaccagcccagcctaggatatggacagagtaactacagttatccccaggtacctgggagctaccccatgcagccagtcactgcacctccatcctaccctcctaccagctattcctctacacagccgactagttatgatcagagcagttactctcagcagaacacctatgggcaaccgagcagctatggacagcagagtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatggggttacaaagtgagagccttgtatacacttcaatacttaaaaagtacccgtactcagtactcagccggcagcataatgaaaagtgggactagacacggtgtccatatggagaggaaaaatatacatagaatatttttaacaaaatgtattcattgtataaatggaatccttctgtaactttggtaactgcatacttgttgtttggtaatgaaccagaggaggtataatactctagaattgtgtaacattaaagtgtaaacttttgtgtttaaa

SEQ ID NO: 1577 - DNA, 1273 bp, Homo sapiens
gagccgaaggtggaggtcaaaggggcgtggcgttacagagcctctagcgctgggtgttggggacctgacgctatggagctctcggagttttgtgggggacggctgtgagtggggggttcctgctgcgggatgagaacgtagacgccagtggctcactcgctcctggcaccttccctttcaggctccagatggaccctgggaaggacaaagagggggtgccccagccctcagggccgccagcaaggaagaaatttgtgatacccctcgacgaggatgaggtccctcctggagtggccaagcccttattccgatctacacagagccttcccactgtggacacctcggcccaggcggcccctcagacctacgccgaatatgccatctcacagcctctggaaggggctggggccacgtgccccacagggtcagagcccctggcaggagagacgcccaaccaggccctgaaacccggggcaaaatccaacagcatcattgtgagccctcggcagaggggcaatcccgtactgaagttcgtgcgcaatgtgccctgggaatttggcgacgtaattcccgactatgtgctgggccagagcacctgtgccctgttcctcagcctccgctaccacaacctgcacccagactacatccatgggcggctgcagagcctggggaagaacttcgccttgcgggtcctgcttgtccaggtggatgtgaaagatccccagcaggccctcaaggagctggctaagatgtgtatcctggccgactgcacattgatcctcgcctggagccccgaggaagctgggcggtacctggagacctacaaggcctatgagcagaaaccagcggacctcctgatggagaagctagagcaggacttcgtctcccgggtgactgaatgtctgaccaccgtgaagtcagtcaacaaaacggacagtcagaccctcctgaccacatttggatctctggaacagctcatcgccgcatcaagagaagatctggccttatgcccaggcctgggccctcagaaagtaagagctctgggaaagaacccaaggagttgggggaaggagagagccccaaataaacacaacctgagaccccaaagttttaaggtgaaaaaagaaccaaagaccagacacagtggcttccgcctgtaatcccaacattttgggaggccaaggcgggaggactgcttgaggccagaagttggagaccagcctgggcaagtggacacctcatttttactaaaaataaaaaaaactagctgggc

SEQ ID NO: 1578 - DNA, 3382 bp, Homo sapiens
ccggaagtgctgcgagccctgggccacgctggccgtgctggcagtgggccgcctcgatccctctgcagtctttcccttgaggctccaagaccagcaggtgaggcctcgcggcgctgaaaccgtgaggcccggaccacaggctccagatggaccctgggaaggacaaagagggggtgccccagccctcagggccgccagcaaggaagaaatttgtgatacccctcgacgaggatgaggtccctcctggagtggccaagcccttattccgatctacacagagccttcccactgtggacacctcggcccaggcggcccctcagacctacgccgaatatgccatctcacagcctctggaaggggctggggccacgtgccccacagggtcagagcccctggcaggagagacgcccaaccaggccctgaaacccggggcaaaatccaacagcatcattgtgagccctcggcagaggggcaatcccgtactgaagttcgtgcgcaatgtgccctgggaatttggcgacgtaattcccgactatgtgctgggccagagcacctgtgccctgttcctcagcctccgctaccacaacctgcacccagactacatccatgggcggctgcagagcctggggaagaacttcgccttgcgggtcctgcttgtccaggtggatgtgaaagatccccagcaggccctcaaggagctggctaagatgtgtatcctggccgactgcacattgatcctcgcctggagccccgaggaagctgggcggtacctggagacctacaaggcctatgagcagaaaccagcggacctcctgatggagaagctagagcaggacttcgtctcccgggtgactgaatgtctgaccaccgtgaagtcagtcaacaaaacggacagtcagaccctcctgaccacatttggatctctggaacagctcatcgccgcatcaagagaagatctggccttatgcccaggcctgggccctcagaaagcccggaggctgtttgatgtcctgcacgagcccttcttgaaagtaccctgatgaccccagctgccaaggaaacccccagtgtaataataaatcgtcctcccaggccaggctcctgctggctgcgctggtgcagtctctggggagggattctgggggtgtcaccttctggtggcccaggtgggcaccttcagctttctttagttcctcagtttcccgggggcagactacacaggctgctgctgctgctgcttccgcttcttgtcccggcctgtgggagcctcctccccagactctgaattcagtggcggccctggcatctcctcttggggcactgtctctggcatccggctttcctgactctgcttcttcctcttcttggtggatcccggagttgccctggcttcaggctgtccctcccctggcagttcaggctctagtggctgaattggctcagtcactgtgtgacctctctctttcttcttcttcttcttcttggtggatgtgggagctgcctgaggctcaaggtcatccggcagctcaggccccaccacctctgtctctggctccactgtggcatcttgctgtttttctttcttcgtcttctttttgggagctgccagagctgcctgggcctgaggcttcgctccttctggctgttgaggcgccatggtcccccctggggactccagaggcttcatctccggctccactggctccatcgcctccgtccctggctccatcattgccatctgtcccttttcttttttcctcttcttcgtagggggcagagggatggcttcctccagtggctccaccttcacctgtggctgagactcaactgtcaccccctcctctggctccatcccttccgtccccttttgcctctttctctttttggtcggggacaggactgtgtcttctagaggctcagtgttaatctgttcctgcttcactgtcttgtcttctggctcgaaggtttctttccctttgggcttcttcctcttcttggtggtggacgggaacagcactcccagaggctccagtgtctccactgtgggctctgtccccacaggccctgctgcctctggttctttcagctgctgattttttttcttcttcttcttccgcacatccatttctggcgaccccaaagccatgtccacctccagggccccgtgcccattcactgcctcctgagtgactggggcctctgtcacctgcatctcctttttcttcttccctgaggtgagcaggttgggggccaaggctgacctaggccctgtgactggtgggttgcccccaaaggcacagaaccgaggcctcaggccaggagggatctgtggtgggggacttgctgggatgggctgcagagggctccctgacagggattgctggggaccctcaaggatccttagggtgccctggggggctgaggcacaggtgagtccacctcctgcctccgttgagggggccagcagggtcgcttctccagcttggggacagctgctgaggactcgatagcggtgccgcttgcctgccaatttgcccttgacgatctgggagccagagagaggcacatgccgcccattgaagctacagagagaaacagggagggcagaggcttaagtggaacaggagagggaaggttttttgattttttttttgtttttttttgagagagtcttgctctgttgcctaggctggagtgcagtggcatgatctcggctcactgcaatgtccacctcctgggttcaagcgattctcctgcctcagcctctcaagtagctgggattacaggcacctgccaccacgcccagccaatttttgtatttttagtagagacaatttcactatgttggccaggctggtcttgaactcctgacctcaagtgatctgctcgcctcggcctcccaaaggatgggattacaggcaccagccactgcgcctggctggcctctggtttttaataaaacatgactagagtgactccatcttaaagtgagtagctaggcacttacaaggttcatgcttatggcctgaaaataaccacatcccaggctgaccaccaattataattacagaatatttatggccatacagaacatgttccaccaagcctgcagaatgtccaaatgtcctaagaatgcagcccccattacttaaatataacataaatgagcaagcttaggttgcaggattaatggtcgtggataacaccaatagcccctacctttagtgagcttatctgcacactccaagtttaactatagttccttatagtttcttataagtagaaatactaacaaagggctgtgggtttctccccctgctttctgaggacactctactctgtaaaggagtagtttccaataaacttgtttctttcactgtgc

SEQ ID NO: 1579 - DNA, 3310 bp, Homo sapiens
ccggaagtgctgcgagccctgggccacgctggccgtgctggcagtgggccgcctcgatccctctgcagtctttcccttgaggctccaagaccagcaggtgaggcctcgcggcgctgaaaccgtgaggcccggaccacaggctccagatggaccctgggaaggacaaagagggggtgccccagccctcagggccgccagcaaggaagaaatttgtgatacccctcgacgaggatgaggtccctcctggagtggccaagcccttattccgatctacacagagccttcccactgtggacacctcggcccaggcggcccctcagacctacgccgaatatgccatctcacagcctctggaaggggctggggccacgtgccccacagggtcagagcccctggcaggagagacgcccaaccaggccctgaaacccggggcaaaatccaacagcatcattgtgagccctcggcagaggggcaatcccgtactgaagttcgtgcgcaatgtgccctgggaatttggcgacgtaattcccgactatgtgctgggccagagcacctgtgccctgttcctcagcctccgctaccacaacctgcacccagactacatccatgggcggctgcagagcctggggaagaacttcgccttgcgggtcctgcttgtccaggtggatgtgaaagatccccagcaggccctcaaggagctggctaagatgtgtatcctggccgactgcacattgatcctcgcctggagccccgaggaagctgggcggtacctggagacctacaaggcctatgagcagaaaccagcggacctcctgatggagaagctagagcaggacttcgtctcccggtctctggaacagctcatcgccgcatcaagagaagatctggccttatgcccaggcctgggccctcagaaagcccggaggctgtttgatgtcctgcacgagcccttcttgaaagtaccctgatgaccccagctgccaaggaaacccccagtgtaataataaatcgtcctcccaggccaggctcctgctggctgcgctggtgcagtctctggggagggattctgggggtgtcaccttctggtggcccaggtgggcaccttcagctttctttagttcctcagtttcccgggggcagactacacaggctgctgctgctgctgcttccgcttcttgtcccggcctgtgggagcctcctccccagactctgaattcagtggcggccctggcatctcctcttggggcactgtctctggcatccggctttcctgactctgcttcttcctcttcttggtggatcccggagttgccctggcttcaggctgtccctcccctggcagttcaggctctagtggctgaattggctcagtcactgtgtgacctctctctttcttcttcttcttcttcttggtggatgtgggagctgcctgaggctcaaggtcatccggcagctcaggccccaccacctctgtctctggctccactgtggcatcttgctgtttttctttcttcgtcttctttttgggagctgccagagctgcctgggcctgaggcttcgctccttctggctgttgaggcgccatggtcccccctggggactccagaggcttcatctccggctccactggctccatcgcctccgtccctggctccatcattgccatctgtcccttttcttttttcctcttcttcgtagggggcagagggatggcttcctccagtggctccaccttcacctgtggctgagactcaactgtcaccccctcctctggctccatcccttccgtccccttttgcctctttctctttttggtcggggacaggactgtgtcttctagaggctcagtgttaatctgttcctgcttcactgtcttgtcttctggctcgaaggtttctttccctttgggcttcttcctcttcttggtggtggacgggaacagcactcccagaggctccagtgtctccactgtgggctctgtccccacaggccctgctgcctctggttctttcagctgctgattttttttcttcttcttcttccgcacatccatttctggcgaccccaaagccatgtccacctccagggccccgtgcccattcactgcctcctgagtgactggggcctctgtcacctgcatctcctttttcttcttccctgaggtgagcaggttgggggccaaggctgacctaggccctgtgactggtgggttgcccccaaaggcacagaaccgaggcctcaggccaggagggatctgtggtgggggacttgctgggatgggctgcagagggctccctgacagggattgctggggaccctcaaggatccttagggtgccctggggggctgaggcacaggtgagtccacctcctgcctccgttgagggggccagcagggtcgcttctccagcttggggacagctgctgaggactcgatagcggtgccgcttgcctgccaatttgcccttgacgatctgggagccagagagaggcacatgccgcccattgaagctacagagagaaacagggagggcagaggcttaagtggaacaggagagggaaggttttttgattttttttttgtttttttttgagagagtcttgctctgttgcctaggctggagtgcagtggcatgatctcggctcactgcaatgtccacctcctgggttcaagcgattctcctgcctcagcctctcaagtagctgggattacaggcacctgccaccacgcccagccaatttttgtatttttagtagagacaatttcactatgttggccaggctggtcttgaactcctgacctcaagtgatctgctcgcctcggcctcccaaaggatgggattacaggcaccagccactgcgcctggctggcctctggtttttaataaaacatgactagagtgactccatcttaaagtgagtagctaggcacttacaaggttcatgcttatggcctgaaaataaccacatcccaggctgaccaccaattataattacagaatatttatggccatacagaacatgttccaccaagcctgcagaatgtccaaatgtcctaagaatgcagcccccattacttaaatataacataaatgagcaagcttaggttgcaggattaatggtcgtggataacaccaatagcccctacctttagtgagcttatctgcacactccaagtttaactatagttccttatagtttcttataagtagaaatactaacaaagggctgtgggtttctccccctgctttctgaggacactctactctgtaaaggagtagtttccaataaacttgtttctttcactgtgc

SEQ ID NO: 1580 - DNA, 3119 bp, Homo sapiens
acatctctcacgataaatgagtggggagaacttatagcccttgaagtcaaccatctcacacctttccaaaggacgcgaccataactctaaaaggctccagatggaccctgggaaggacaaagagggggtgccccagccctcagggccgccagcaaggaagaaatttgtgatacccctcgacgaggatgaggtccctcctggagtgaggggcaatcccgtactgaagttcgtgcgcaatgtgccctgggaatttggcgacgtaattcccgactatgtgctgggccagagcacctgtgccctgttcctcagcctccgctaccacaacctgcacccagactacatccatgggcggctgcagagcctggggaagaacttcgccttgcgggtcctgcttgtccaggtggatgtgaaagatccccagcaggccctcaaggagctggctaagatgtgtatcctggccgactgcacattgatcctcgcctggagccccgaggaagctgggcggtacctggagacctacaaggcctatgagcagaaaccagcggacctcctgatggagaagctagagcaggacttcgtctcccgggtgactgaatgtctgaccaccgtgaagtcagtcaacaaaacggacagtcagaccctcctgaccacatttggatctctggaacagctcatcgccgcatcaagagaagatctggccttatgcccaggcctgggccctcagaaagcccggaggctgtttgatgtcctgcacgagcccttcttgaaagtaccctgatgaccccagctgccaaggaaacccccagtgtaataataaatcgtcctcccaggccaggctcctgctggctgcgctggtgcagtctctggggagggattctgggggtgtcaccttctggtggcccaggtgggcaccttcagctttctttagttcctcagtttcccgggggcagactacacaggctgctgctgctgctgcttccgcttcttgtcccggcctgtgggagcctcctccccagactctgaattcagtggcggccctggcatctcctcttggggcactgtctctggcatccggctttcctgactctgcttcttcctcttcttggtggatcccggagttgccctggcttcaggctgtccctcccctggcagttcaggctctagtggctgaattggctcagtcactgtgtgacctctctctttcttcttcttcttcttcttggtggatgtgggagctgcctgaggctcaaggtcatccggcagctcaggccccaccacctctgtctctggctccactgtggcatcttgctgtttttctttcttcgtcttctttttgggagctgccagagctgcctgggcctgaggcttcgctccttctggctgttgaggcgccatggtcccccctggggactccagaggcttcatctccggctccactggctccatcgcctccgtccctggctccatcattgccatctgtcccttttcttttttcctcttcttcgtagggggcagagggatggcttcctccagtggctccaccttcacctgtggctgagactcaactgtcaccccctcctctggctccatcccttccgtccccttttgcctctttctctttttggtcggggacaggactgtgtcttctagaggctcagtgttaatctgttcctgcttcactgtcttgtcttctggctcgaaggtttctttccctttgggcttcttcctcttcttggtggtggacgggaacagcactcccagaggctccagtgtctccactgtgggctctgtccccacaggccctgctgcctctggttctttcagctgctgattttttttcttcttcttcttccgcacatccatttctggcgaccccaaagccatgtccacctccagggccccgtgcccattcactgcctcctgagtgactggggcctctgtcacctgcatctcctttttcttcttccctgaggtgagcaggttgggggccaaggctgacctaggccctgtgactggtgggttgcccccaaaggcacagaaccgaggcctcaggccaggagggatctgtggtgggggacttgctgggatgggctgcagagggctccctgacagggattgctggggaccctcaaggatccttagggtgccctggggggctgaggcacaggtgagtccacctcctgcctccgttgagggggccagcagggtcgcttctccagcttggggacagctgctgaggactcgatagcggtgccgcttgcctgccaatttgcccttgacgatctgggagccagagagaggcacatgccgcccattgaagctacagagagaaacagggagggcagaggcttaagtggaacaggagagggaaggttttttgattttttttttgtttttttttgagagagtcttgctctgttgcctaggctggagtgcagtggcatgatctcggctcactgcaatgtccacctcctgggttcaagcgattctcctgcctcagcctctcaagtagctgggattacaggcacctgccaccacgcccagccaatttttgtatttttagtagagacaatttcactatgttggccaggctggtcttgaactcctgacctcaagtgatctgctcgcctcggcctcccaaaggatgggattacaggcaccagccactgcgcctggctggcctctggtttttaataaaacatgactagagtgactccatcttaaagtgagtagctaggcacttacaaggttcatgcttatggcctgaaaataaccacatcccaggctgaccaccaattataattacagaatatttatggccatacagaacatgttccaccaagcctgcagaatgtccaaatgtcctaagaatgcagcccccattacttaaatataacataaatgagcaagcttaggttgcaggattaatggtcgtggataacaccaatagcccctacctttagtgagcttatctgcacactccaagtttaactatagttccttatagtttcttataagtagaaatactaacaaagggctgtgggtttctccccctgctttctgaggacactctactctgtaaaggagtagtttccaataaacttgtttctttcactgtg

SEQ ID NO: 1581 - DNA, 259 bp, Homo sapiens
aagtgctgcgagccctgggccacgctggccgtgctggcagtgggccgcctcgatccctctgcagtctttcccttgaggctccaagaccagcaggtgaggcctcgcggcgctgaaaccgtgaggcccggaccacaggctccagatggaccctgggaaggacaaagagggggtgccccagccctcagggccgccagcaaggaagaaatttgtgatacccctcgacgaggatgaggtccctcctggagtgagcaaaccactg

SEQ ID NO: 1582 - DNA, 745 bp, Homo sapiens
acagtccggccggcgccatgaagctcaacgtggacgggctcctggtctacttcccgtacgactacatctaccccgagcagttctcctacatgcgggagctcaaacgcacgctggacgccaagggtcatggagtcctggagatgccctcaggcaccgggaagacagtatccctgttggccctgatcatggcataccagagagcatatccgctggaggtgaccaaactcatctactgctcaagaactgtgccagagattgagaaggtgattgaagagcttcgaaagttgctcaacttctatgagaagcaggagggcgagaagctgccgtttctgggactggctctgagctcccgcaaaaacttgtgtattcaccctgagacaacgtctgcatcgactccatgagcgtcaacctcacccgccggacccttgaccggtgccagggcaacctggagaccctgcagaagacggtgctcaggatcaaagagacagacgagcagcgcctgcgggacgagtaccggcgtctggtggaggggctgcgggaggccagcgccgcccgggagacggacgcccacctggccaaccccgtgctgcccgacgaagtgctgcaggaggcagtgcctggctccatccgcacggccgagcatttcctgggcttcctgaggcggctgctggagtacgtgaagtggcggctgcgtgtgcagcatgtggtgcaggagagcccgcccgccttcctgagcggcctggcc

SEQ ID NO: 1583 - DNA, 1300 bp, Homo sapiens
ggccggcgccatgaagctcaacgtggacgggctcctggtctacttcccgtacgactacatctaccccgagcagttctcctacatgcgggagctcaaacgcacgctggacgccaagggtcatggagtcctggagatgccctcaggcaccgggaagacagtatccctgttggccctgatcatggcataccagagagcatatccgctggaggtgaccaaactcatctactgctcaagaactgtgccagagattgagaaggtgattgaagagcttcgaaagttgctcaacttctatgagaagcaggagggcgagaagctgccgtttctgggactggctctgagctcccgcaaaaacttgtgtattcaccctgaggtgacacccctgcgctttgggaaggacgtcgatgggaaatgccacagcctcacagcctcctatgtgcgggcgcagtaccagcatgacaccagcctgccccactgccgattctatgaggaatttgatgcccatgggcgtgaggtgcccctccccgctggcatctacaacctggatgacctgaaggccctggggcggcgccagggctggtgcccatacttccttgctcgatactcaatcctgcatgccaatgtggtggtttatagctaccactacctcctggaccccaagattgcagacctggtgtccaaggaactggcccgcaaggccgtcgtggtcttcgacgaggcccacaacattgacaacgtctgcatcgactccatgagcgtcaacctcacccgccggacccttgaccggtgccagggcaacctggagaccctgcagaagacggtgctcaggatcaaagagacagacgagcagcgcctgcgggacgagtaccggcgtctggtggaggggctgcgggaggccagcgccgcccgggagacggacgcccacctggccaaccccgtgctgcccgacgaagtgctgcaggaggcagtgcctggctccatccgcacggccgagcatttcctgggcttcctgaggcggctgctggagtacgtgaagtggcggctgcgtgtgcagcatgtggtgcaggagagcccgcccgccttcctgagcggcctggcccagcgcgtgtgcatccagcgcaagcccctcagattctgtgctgaacgcctccggtccctgctgcatactctggagatcaccgaccttgctgacttctccccgctcaccctccttgctaactttgccacccttgtcagcacctacgccaaaggccaggctcagcactgtggaagcagcaggaaccaaaaaagatctcatccctaa

SEQ ID NO: 1584 - DNA, 3137 bp, Homo sapiens
gggggctgggggtcgcgctcgctagcgggcgcggggggtcttgaagatggggtcatcggtgggcgcgcctgggtccccaagggggcgaggggagggtgaaggggtgggacgggggcagccgcagggagcagcagtgatagcgaggagacactgagggggccccgaggctcctgaggacctgagggttaccgggggcgccgggcccgtcacccttctctgggctcgacgaccgggcactgtggaggcgggagaggggctgaggggacgggaactgacccagcagcccctgccgccaggctcaacgtggacgggctcctggtctacttcccgtacgactacatctaccccgagcagttctcctacatgcgggagctcaaacgcacgctggacgccaaggcatatccgctggaggtgaccaaactcatctactgctcaagaactgtgccagagattgagaaggtgattgaagagcttcgaaagttgctcaacttctatgagaagcaggagggcgagaagctgccgtttctgggactggctctgagctcccgcaaaaacttgtgtattcaccctgaggtgacacccctgcgctttgggaaggacgtcgatgggaaatgccacagcctcacagcctcctatgtgcgggcgcagtaccagcatgacaccagcctgccccactgccgattctatgaggaatttgatgcccatgggcgtgaggtgcccctccccgctggcatctacaacctggatgacctgaaggccctggggcggcgccagggctggtgcccatacttccttgctcgatactcaatcctgcatgccaatgtggtggtttatagctaccactacctcctggaccccaagattgcagacctggtgtccaaggaactggcccgcaaggccgtcgtggtcttcgacgaggcccacaacattgacaacgtctgcatcgactccatgagcgtcaacctcacccgccggacccttgaccggtgccagggcaacctggagaccctgcagaagacggtgctcaggatcaaagagacagacgagcagcgcctgcgggacgagtaccggcgtctggtggaggggctgcgggaggccagcgccgcccgggagacggacgcccacctggccaaccccgtgctgcccgacgaagtgctgcaggaggcagtgcctggctccatccgcacggccgagcatttcctgggcttcctgaggcggctgctggagtacgtgaagtggcggctgcgtgtgcagcatgtggtgcaggagagcccgcccgccttcctgagcggcctggcccagcgcgtgtgcatccagcgcaagcccctcagattctgtgctgaacgcctccggtccctgctgcatactctggagatcaccgaccttgctgacttctccccgctcaccctccttgctaactttgccacccttgtcagcacctacgccaaaggcttcaccatcatcatcgagccctttgacgacagaaccccgaccattgccaaccccatcctgcacttcagctgcatggacgcctcgctggccatcaaacccgtatttgagcgtttccagtctgtcatcatcacatctgggacactgtccccgctggacatctaccccaagatcctggacttccaccccgtcaccatggcaaccttcaccatgacgctggcacgggtctgcctctgccctatgatcatcggccgtggcaatgaccaggtggccatcagctccaaatttgagacccgggaggatattgctgtgatccggaactatgggaacctcctgctggagatgtccgctgtggtccctgatggcatcgtggccttcttcaccagctaccagtacatggagagcaccgtggcctcctggtatgagcaggggatccttgagaacatccagaggaacaagctgctctttattgagacccaggatggtgccgaaaccagtgtcgccctggagaagtaccaggaggcctgcgagaatggccgcggggccatcctgctgtcagtggcccggggcaaagtgtccgagggaatcgactttgtgcaccactacgggcgggccgtcatcatgtttggcgtcccctacgtctacacacagagccgcattctcaaggcgcggctggaatacctgcgggaccagttccagattcgtgagaatgactttcttaccttcgatgccatgcgccacgcggcccagtgtgtgggtcgggccatcaggggcaagacggactacggcctcatggtctttgccgacaagcggtttgcccgtggggacaagcgggggaagctgccccgctggatccaggagcacctcacagatgccaacctcaacctgaccgtggacgagggtgtccaggtggccaagtacttcctgcggcagatggcacagcccttccaccgggaggatcagctgggcctgtccctgctcagcctggagcagctagaatcagaggagacgctgaagaggatagagcagattgctcagcagctctgagtggggcgggtggggccataaacggttcctggtgactcctgagtcttgcctggccctggttcccagcggcggtggtgctagaaggtcttatgaagtcaggtgacatttctcactgtcacgtccacagcctttaatcgcaggagaaggcagctatccaccaggtacccagaggcaagggggggccaggagatgatagaccccctctcaccccaccagcccatccctcctgcactgttcccaagaagctgcggccagcgcagttcactggacgttagtgggggctcaggtcctgggtgctggcgctgagggtccgaggggccttgtccaggtgccagctgggaaactggagacaggcacaggggatggttggaggggaggtgaggggcaagtgttacatccaccctccagctccaggtccagcctggcagccaactatccaaccccctcgcctctaccccaagtaaaacccatctttgctcctgtcctgggtctcttctgacaccaacccaccacctgctgactccaccactggcccgaccgccctgcctttgcctcatctctgcacctacccacatggcctcctctatttttgacccagatgtccccctcacctgagtcccaggagcccttggagcatccac

SEQ ID NO: 1585 - DNA, 2982 bp, Homo sapiens
gagaagggggctgggggtcgcgctcgctagcgggcgcggggggtcttgaagatggggtcatcggctcaacgtggacgggctcctggtctacttcccgtacgactacatctaccccgagcagttctcctacatgcgggagctcaaacgcacgctggacgccaagggtcatggagtcctggagatgccctcaggcaccgggaagacagtatccctgttggccctgatcatggcataccagagagcatatccgctggaggtgaccaaactcatctactgctcaagaactgtgccagagattgagaaggtgattgaagagcttcgaaagttgctcaacttctatgagaagcaggagggcgagaagctgccgtttctgggactggctctgagctcccgcaaaaacttgtgtattcaccctgaggtgacacccctgcgctttgggaaggacgtcgatgggaaatgccacagcctcacagcctcctatgtgcgggcgcagtaccagcatgacaccagcctgccccactgccgattctatgaggaatttgatgcccatgggcgtgaggtgcccctccccgctggcatctacaacctggatgacctgaaggccctggggcggcgccagggctggtgcccatacttccttgctcgatactcaatcctgcatgccaatgtggtggtttatagctaccactacctcctggaccccaagattgcagacctggtgtccaaggaactggcccgcaaggccgtcgtggtcttcgacgaggcccacaacattgacaacgtctgcatcgactccatgagcgtcaacctcacccgccggacccttgaccggtgccagggcaacctggagaccctgcagaagacggtgctcaggatcaaagagacagacgagcagcgcctgcgggacgagtaccggcgtctggtggaggggctgcgggaggccagcgccgcccgggagacggacgcccacctggccaaccccgtgctgcccgacgaagtgctgcaggaggcagtgcctggctccatccgcacggccgagcatttcctgggcttcctgaggcggctgctggagtacgtgaagtggcggctgcgtgtgcagcatgtggtgcaggagagcccgcccgccttcctgagcggcctggcccagcgcgtgtgcatccagcgcaagcccctcagattctgtgctgaacgcctccggtccctgctgcatactctggagatcaccgaccttgctgacttctccccgctcaccctccttgctaactttgccacccttgtcagcacctacgccaaaggcttcaccatcatcatcgagccctttgacgacagaaccccgaccattgccaaccccatcctgcacttcagctgcatggacgcctcgctggccatcaaacccgtatttgagcgtttccagtctgtcatcatcacatctgggacactgtccccgctggacatctaccccaagatcctggacttccaccccgtcaccatggcaaccttcaccatgacgctggcacgggtctgcctctgccctatgatcatcggccgtggcaatgaccaggtggccatcagctccaaatttgagacccgggaggatattgctgtgatccggaactatgggaacctcctgctggagatgtccgctgtggtccctgatggcatcgtggccttcttcaccagctaccagtacatggagagcaccgtggcctcctggtatgagcaggggatccttgagaacatccagaggaacaagctgctctttattgagacccaggatggtgccgaaaccagtgtcgccctggagaagtaccaggaggcctgcgagaatggccgcggggccatcctgctgtcagtggcccggggcaaagtgtccgagggaatcgactttgtgcaccactacgggcgggccgtcatcatgtttggcgtcccctacgtctacacacagagccgcattctcaaggcgcggctggaatacctgcgggaccagttccagattcgtgagaatgactttcttaccttcgatgccatgcgccacgcggcccagtgtgtgggtcgggccatcaggggcaagacggactacggcctcatggtctttgccgacaagcggtttgcccgtggggacaagcgggggaagctgccccgctggatccaggagcacctcacagatgccaacctcaacctgaccgtggacgagggtgtccaggtggccaagtacttcctgcggcagatggcacagcccttccaccgggaggatcagctgggcctgtccctgctcagcctggagcagctagaatcagaggagacgctgaagaggatagagcagattgctcagcagctctgagtggggcgggtggggccataaacggttcctggtgactcctgagtcttgcctggccctggttcccagcggcggtggtgctagaaggtcttatgaagtcaggtgacatttctcactgtcacgtccacagcctttaatcgcaggagaaggcagctatccaccaggtacccagaggcaagggggggccaggagatgatagaccccctctcaccccaccagcccatccctcctgcactgttcccaagaagctgcggccagcgcagttcactggacgttagtgggggctcaggtcctgggtgctggcgctgagggtccgaggggccttgtccaggtgccagctgggaaactggagacaggcacaggggatggttggaggggaggtgaggggcaagtgttacatccaccctccagctccaggtccagcctggcagccaactatccaaccccctcgcctctaccccaagtaaaacccatctttgctcctgtcctgggtctcttctgacaccaacccaccacctgctgactccaccactggcccgaccgccctgcctttgcctcatctctgcacctacccacatggcctcctctatttttgacccagatgtccccctcacctgagtcccaggagcccttggagcatccac

SEQ ID NO: 1586 - DNA, 2103 bp, Homo sapiens
gaccccgctgcacagtccggccggcgccatgaagctcaacgtggacgggctcctggtctacttcccgtacgactacatctaccccgagcagttctcctacatgcgggagctcaaacgcacgctggacgccaagggtcatggagtcctggagatgccctcaggcaccgggaagacagtatccctgttggccctgatcatggcataccagagagcatatccgctggaggtgaccaaactcatctactgctcaagaactgtgccagagattgagaaggtgattgaagagcttcgaaagttgctcaacttctatgagaagcaggagggcgagaagctgccgtttctgggactggctctgagctcccgcaaaaacttgtgtattcaccctgagatcctgcatgccaatgtggtggtttatagctaccactacctcctggaccccaagattgcagacctggtgtccaaggaactggcccgcaaggccgtcgtggtcttcgacgaggcccacaacattgacaacgtctgcatcgactccatgagcgtcaacctcacccgccggacccttgaccggtgccagggcaacctggagaccctgcagaagacggtgctcaggatcaaagagacagacgagcagcgcctgcgggacgagtaccggcgtctggtggaggggctgcgggaggccagcgccgcccgggagacggacgcccacctggccaaccccgtgctgcccgacgaagtgctgcaggaggcagtgcctggctccatccgcacggccgagcatttcctgggcttcctgaggcggctgctggagtacgtgaagtggcggctgcgtgtgcagcatgtggtgcaggagagcccgcccgccttcctgagcggcctggcccagcgcgtgtgcatccagcgcaagcccctcagattctgtgctgaacgcctccggtccctgctgcatactctggagatcaccgaccttgctgacttctccccgctcaccctccttgctaactttgccacccttgtcagcacctacgccaaaggcttcaccatcatcatcgagccctttgacgacagaaccccgaccattgccaaccccatcctgcacttcagctgcatggacgcctcgctggccatcaaacccgtatttgagcgtttccagtctgtcatcatcacatctgggacactgtccccgctggacatctaccccaagatcctggacttccaccccgtcaccatggcaaccttcaccatgacgctggcacgggtctgcctctgccctatgatcatcggccgtggcaatgaccaggtggccatcagctccaaatttgagacccgggaggatattgctgtgatccggaactatgggaacctcctgctggagatgtccgctgtggtccctgatggcatcgtggccttcttcaccagctaccagtacatggagagcaccgtggcctcctggtatgagcaggggatccttgagaacatccagaggaacaagctgctctttattgagacccaggatggtgccgaaaccagtgtcgccctggagaagtaccaggaggcctgcgagaatggccgcggggccatcctgctgtcagtggcccggggcaaagtgtccgagggaatcgactttgtgcaccactacgggcgggccgtcatcatgtttggcgtcccctacgtctacacacagagccgcattctcaaggcgcggctggaatacctgcgggaccagttccagattcgtgagaatgactttcttaccttcgatgccatgcgccacgcggcccagtgtgtgggtcgggccatcaggggcaagacggactacggcctcatggtctttgccgacaagcggtttgcccgtggggacaagcgggggaagctgccccgctggatccaggagcacctcacagatgccaacctcaacctgaccgtggacgagggtgtccaggtggccaagtacttcctgcggcagatggcacagcccttccaccgggaggatcagctgggcctgtccctgctcagcctggagcagctagaatcagaggagacgctgaagaggatagagcagattgctcagcagctctgagtggggcgggtggggccataaacggt

SEQ ID NO: 1587 - DNA, 3002 bp, Homo sapiens
ggatgtccacgacccggcctctcgctgaatattcatgagggaggcgggtcgaccccgctgcacagtccggccggcgccatgaagctcaacgtggacgggctcctggtctacttcccgtacgactacatctaccccgagcagttctcctacatgcgggagctcaaacgcacgctggacgccaagggtcatggagtcctggagatgccctcaggcaccgggaagacagtatccctgttggccctgatcatggcataccagagagcatatccgctggaggtgaccaaactcatctactgctcaagaactgtgccagagattgagaaggtgattgaagagcttcgaaagttgctcaacttctatgagaagcaggagggcgagaagctgccgtttctgggactggctctgagctcccgcaaaaacttgtgtattcaccctgaggtgacacccctgcgctttgggaaggacgtcgatgggaaatgccacagcctcacagcctcctatgtgcgggcgcagtaccagcatgacaccagcctgccccactgccgattctatgaggaatttgatgcccatgggcgtgaggtgcccctccccgctggcatctacaacctggatgacctgaaggccctggggcggcgccagggctggtgcccatacttccttgctcgatactcaatcctgcatgccaatgtggtggtttatagctaccactacctcctggaccccaagattgcagacctggtgtccaaggaactggcccgcaaggccgtcgtggtcttcgacgaggcccacaacattgacaacgtctgcatcgactccatgagcgtcaacctcacccgccggacccttgaccggtgccagggcaacctggagaccctgcagaagacggtgctcaggatcaaagagacagacgagcagcgcctgcgggacgagtaccggcgtctggtggaggggctgcgggaggccagcgccgcccgggagacggacgcccacctggccaaccccgtgctgcccgacgaagtgctgcaggaggcagtgcctggctccatccgcacggccgagcatttcctgggcttcctgaggcggctgctggagtacgtgaagtggcggctgcgtgtgcagcatgtggtgcaggagagcccgcccgccttcctgagcggcctggcccagcgcgtgtgcatccagcgcaagcccctcagattctgtgctgaacgcctccggtccctgctgcatactctggagatcaccgaccttgctgacttctccccgctcaccctccttgctaactttgccacccttgtcagcacctacgccaaaggcttcaccatcatcatcgagccctttgacgacagaaccccgaccattgccaaccccatcctgcacttcagctgcatggacgcctcgctggccatcaaacccgtatttgagcgtttccagtctgtcatcatcacatctgggacactgtccccgctggacatctaccccaagatcctggacttccaccccgtcaccatggcaaccttcaccatgacgctggcacgggtctgcctctgccctatgatcatcggccgtggcaatgaccaggtggccatcagctccaaatttgagacccgggaggatattgctgtgatccggaactatgggaacctcctgctggagatgtccgctgtggtccctgatggcatcgtggccttcttcaccagctaccagtacatggagagcaccgtggcctcctggtatgagcaggggatccttgagaacatccagaggaacaagctgctctttattgagacccaggatggtgccgaaaccagtgtcgccctggagaagtaccaggaggcctgcgagaatggccgcggggccatcctgctgtcagtggcccggggcaaagtgtccgagggaatcgactttgtgcaccactacgggcgggccgtcatcatgtttggcgtcccctacgtctacacacagagccgcattctcaaggcgcggctggaatacctgcgggaccagttccagattcgtgagaatgactttcttaccttcgatgccatgcgccacgcggcccagtgtgtgggtcgggccatcaggggcaagacggactacggcctcatggtctttgccgacaagcggtttgcccgtggggacaagcgggggaagctgccccgctggatccaggagcacctcacagatgccaacctcaacctgaccgtggacgagggtgtccaggtggccaagtacttcctgcggcagatggcacagcccttccaccgggaggatcagctgggcctgtccctgctcagcctggagcagctagaatcagaggagacgctgaagaggatagagcagattgctcagcagctctgagtggggcgggtggggccataaacggttcctggtgactcctgagtcttgcctggccctggttcccagcggcggtggtgctagaaggtcttatgaagtcaggtgacatttctcactgtcacgtccacagcctttaatcgcaggagaaggcagctatccaccaggtacccagaggcaagggggggccaggagatgatagaccccctctcaccccaccagcccatccctcctgcactgttcccaagaagctgcggccagcgcagttcactggacgttagtgggggctcaggtcctgggtgctggcgctgagggtccgaggggccttgtccaggtgccagctgggaaactggagacaggcacaggggatggttggaggggaggtgaggggcaagtgttacatccaccctccagctccaggtccagcctggcagccaactatccaaccccctcgcctctaccccaagtaaaacccatctttgctcctgtcctgggtctcttctgacaccaacccaccacctgctgactccaccactggcccgaccgccctgcctttgcctcatctctgcacctacccacatggcctcctctatttttgacccagatgtccccctcacctgagtcccaggagcccttggagcatccac

SEQ ID NO: 1588 - DNA, 6761 bp, Homo sapiens
agagcttccatggagtcagggcagccggctcgacggattgccatggcgccgctgctggagtacgagcgacagctggtgctggaactgctcgacactgacgggctagtagtgtgcgcccgcgggctcggcgcggaccggctcctctaccactttctccagctgcactgccacccagcctgcctggtgctggtgctcaacacgcagccggccgaggaggagtattttatcaatcagctgaagatagaaggagttgaacacctccctcgccgtgtaacaaatgaaatcacaagcaacagtcgctatgaagtttacacacaaggtggtgttatatttgcgacaagtaggatacttgtggttgacttcttgactgatagaataccttcagatttaattactggcatcttggtgtatagagcccacagaataatcgagtcttgtcaagaagcattcatcttgcgcctctttcgccagaaaaacaaacgtggttttattaaagctttcacagacaatgctgttgcctttgatactggtttttgtcatgtggaaagagtgatgagaaatctttttgtgaggaaactgtatctgtggccaaggttccatgtagcagtaaactcatttttagaacagcacaaacctgaagttgtagaaatccatgtttctatgacacctaccatgcttgctatacagactgctatactggacattttaaatgcatgtctaaaggaactaaaatgccataacccatcgcttgaagtggaagatttatctttagaaaatgctattggaaaaccttttgacaagacaatccgccattatctggatcctttgtggcaccagcttggagccaagactaaatccttagttcaggatttgaagatattacgaactttgctgcagtatctctctcagtatgattgtgtcacatttcttaatcttctggaatctctgagagcaacggaaaaagcttttggtcagaattcaggttggctgtttcttgactccagcacctcgatgtttataaatgctcgagcaagggtttatcatcttccagatgccaaaatgagtaaaaaagaaaaaatatctgaaaaaatggaaattaaagaaggggaagaaacaaaaaaggaactggtcctagaaagcaacccaaagtgggaggcactgactgaagtattaaaagaaattgaggcagaaaataaggagagtgaagctcttggtggtccaggtcaagtactgatttgtgcaagtgatgaccgaacatgttcccagctgagagactatatcactcttggagcggaggccttcttattgaggctctacaggaaaacctttgagaaggatagcaaagctgaagaagtctggatgaaatttaggaaggaagacagttcaaagagaattaggaaatctcacaaaagacctaaagacccccaaaacaaagaacgggcttctaccaaagaaagaaccctcaaaaagaaaaaacggaagttgaccttaactcaaatggtaggaaaacctgaagaactggaagaggaaggagatgtcgaggaaggatatcgtcgagaaataagcagtagcccagaaagctgcccggaagaaattaagcatgaagaatttgatgtaaatttgtcatcggatgctgctttcggaatcctgaaagaacccctcactatcatccatccgcttctgggttgcagcgacccctatgctctgacaagggtactacatgaagtggagccaagatacgtggttctttatgacgcagagctaacctttgttcggcagcttgaaatttacagggcgagtaggcctgggaaacctctgagggtttactttcttatatacggaggttcaactgaggaacaacgctatctcactgctttgcggaaagaaaaggaagcttttgaaaaactcataagggaaaaagcaagcatggttgtccctgaagaaagagaaggcagagatgaaacaaacttagacctagtaagaggcacagcatctgcagatgtttccactgacactcggaaagccggtggccaggaacagaatggtacacagcaaagcatagttgtggatatgcgtgaatttcgaagtgagcttccatctctgatccatcgtcggggcattgacattgaacccgtgactttagaggttggagattacatcctcactccagaaatgtgcgtggagcgcaagagtatcagtgatttaatcggctctttaaataacggccgcctctacagccagtgcatctccatgtcccgctactacaagcgtcccgtgcttctgattgagtttgaccctagcaagcctttctctctcacttcccgaggtgccttgtttcaggagatctccagcaatgacattagttccaaactcactcttcttacacttcacttccccagactacggattctctggtgcccctctcctcatgcaacggcggagttgtttgaggagctgaaacaaagcaagccacagcctgatgcggcgacagcactggccattacagcagattctgaaacccttcccgagtcagagaagtataatcctggtccccaagacttcttgttaaaaatgccaggggtgaatgccaaaaactgccgctccttgatgcaccacgttaagaacatcgcagaattagcagccctgtcacaagacgagctcacgagtattctggggaatgctgcaaatgccaaacagctttatgatttcattcacacctcttttgcagaagtcgtatcaaaaggaaaagggaaaaagtgaacagtgatggctgttttcttatcccatgcctgtacttttcagcggctccttgccagacatcataggtcattattaattattggtttgctatttcattcttttccaatgctcttaatgattgtacggtggaccagaagccaggattcctctctgaactctgcagttaggcatcacttgaacttgcctgtgcctgctctttttcctccctgcaccgtctatgccgggcttagcatgtttctttttaaatgaggtttgtcaggatcaggtaaagttcctacaagtgattacagaaggtagaaactttacctgatcctaacagatctcatttagaaaggaatatgctaagcctggcatggacggtgcagggagggaaaagagcaggcacaagaaagctaccatttttaacagtccttgttatctagtgcaacataaataacagtcttaattgcacttatacccatgtcctgtggctctccaaatctggtctttgctgttgtgtctgctggacgcttgaactgatgtttgtgtaggaaatcatgttctgaccctttgtctacaaaggagccttctggaacactgagaagaaacatctctttgccattcctgaccagttctctctaccacattttcttcagctccatacttctgcctgtctgctctaaggaaatttcatggagccttcctactactaattcaagacagtctcctcaaaaactggttgactagtcttctaatgaccctaacatatgtagcatatactataatttcattgttccaaattagtatttttaaagcaaaatgaattacctgtttgcaaaagttaatgatgaaggagctcttagaattctcaatttttgcacatattcagtctcctaatatcagagatccctaagtccagctggctagttacagagttttttcagacttcctcgtttctcagctcttatatcctaagacaccagcatcatatcctctagaaatacaacctaattggcagtgagccgagatcgcaccactgcacccctgcctgggcgacagagtgagactttgtctctattacaaaaagaaaagaaaagaaatacaacctaagctcacctgcctgtgattcctcatttctcaccatcctgtgccagggtggctacttctctctgtgaggactcaaatacaagccaatgagtggcccactaagcttttaagatttgattttcctgccttgagataaaaaggagtgtaggtaaatgaaagatcaatgtatggaatatataaaaatacgaaagaaatatatacgtttaaaaatccataaagaaaaaaatctcattctaaacctgattaagttggctttttacgtaagtgtacaaataggatattcacagcatctttgtgcagtttttaaacttttatatttaaacattattaagttggcttttgttcacatgttgagtaatgggtagtaaattttctacctcaggagctgatatagacatcagttctgctagccatatcacatattttaatgtttcatcaacatcagctgtttttttgtttgctacactatttgaactaatagacagtggatcatgtaacacaaaattgtcttcaactttaacaaaattgtcattgttatttttttttgagacagagtctccctctgttgcccaggctggagtgcagtggcgcaatctcggctcactgcaacctcgcctgctgggttcaagcagttctcccacctcagcctcccaagtagctgggattataggtgtgcaccaccagacccggctaatttttgtatttttagtagagacggggtttcaccatgttggccaggctggtctcaaactactgacctcaggtgatccacccaccttggcctcccaaagtgctgagataacaggcgtgagccaccgcacccacccaacaaaattatttttaactgtcgtttctgaactgaacctctcacattggcatcttgatttattggtacttaacagtatatatggattttgaactctacacaagggtataaccagaatgaattgaggggtatcaagaaccagattggttacagtagaactctgtaagatgatgtggagagtaaggaaaaggagaagaaataaaaattagtttaagatggaataaagatttgggctgctaattttttcccaggattcaaaatatacccgctagaatggaaaacaaaaatttgaatgattacaacattatcgttaacattcaattttgtatttattgttttattgaatatagttcagagtatattaaaatagacctaccacttcaaatgataatgattattataatgtctcttcaccctattctagcacttctgcttgcagtatgtggtttctatttttttcctcttgtataattccacttgcttttaattgttgtttcattatataaaaggaacatcttcccatagcatattctatgaaaggggtttcattccaagttgagttttcaaaaaaaaggtcttcctaaagctaccattttcaaccgtccttgttatctagtacaacataaataacagtcttaaaaattgcactaataccagtgcccccctggctctccaaatctgttctttgctcttgtatctgctggacgcttgaagacaggtgcactgtctcgtatgtatttgaattatgaacagtaatttctaatgaattctaaaatggtcattgtaagtgaaagcctctcgctaccacttcctcttccaactacataaatatatttcaatgtatttccagttttggaaagttttcaatacatacatcaagtgtttacttagatttttataaaaattttttttacaatctaataatctttggtaaaggaactagagatgcatgcagttgcaaaattaatgtatttattttccagcataattttattaacttcactttttttctctctagtaaatatccagtgtacttatgaactcatgtttggctcttttaaaaccttttctaaaagctagatcagcatttttctattttacaagttttttgtataaaaaggtgaacatatgagatattgtgagaaatcattttaagtttcatttaaatcatggtgcctcttttgatactttcttaaaattgtgcaagaagaaatcatttttagtagtggtcataaatattatccttttggcagtaagctattactaattcagcctgaagctcggtagacaatatgtctacatgtgtttgagtacatcctggatacagtttcccagctcatgagggactgaaaatagtcttattcatcaacccactaggatgtgaagggttaagtctagatttggtcgcattgaaaccccacaatatagaattaataaatggccttcagtaggaaaacctacactaaagcaaatccgaagaagtggggcagggggaaagaggcattactggtctttccttttgttttgcaagcataatttgattttcctttggctcagaaaactcatttggggaaattctcttttgtgttcagtttaacctagaaaggtcctcttgaaaaaccaacattttaggaaagttcttttttcaggatggagtatattaaaattaagccaggctttgacgtgaattatcacttttctttattattttgttttctattttggtttatagctatttctggttcagttctgaacttcagcacttaatcatccttatcaaccaggcttttggtagcctaaaccgctatgctgttgtttttttaatttaaagatgtataagccaaaatttggatgggagtgagacataactgatttatatgaattttaacagagttgtatttgtgtgtgtttaataaaatatatatttattcagtactttcctcagtattttatgggcaaagtaaaaataacaatgcatagtgaaagggcatatattaccagcagtaataattcaaaatcctgaaaatgtttcattttttttgtttttgttatgcagaataaacaaggcagaaatgctctttgaaccact

SEQ ID NO: 1589 - DNA, 2865 bp, Homo sapiens
gctcgacggattgccatggcgccgctgctggagtacgagcgacagctggtgctggaactgctcgacactgacgggctagtagtgtgcgcccgcgggctcggcgcggaccggctcctctaccactttctccagctgcactgccacccagcctgcctggtgctggtgctcaacacgcagccggccgaggaggagtattttatcaatcagctgaagatagaaggagttgaacacctccctcgccgtgtaacaaatgaaatcacaagcaacagtcgctatgaagtttacacacaaggtggtgttatatttgcgacaagtaggatacttgtggttgacttcttgactgatagaataccttcagatttaattactggcatcttggtgtatagagcccacagaataatcgagtcttgtcaagaagcattcatcttgcgcctctttcgccagaaaaacaaacgtggttttattaaagctttcacagacaatgctgttgcctttgatactggtttttgtcatgtggaaagagtgatgagaaatctttttgtgaggaaactgtatctgtggccaaggttccatgtagcagtaaactcatttttagaacagcacaaacctgaagttgtagaaatccatgtttctatgacacctaccatgcttgctatacagactgctatactggacattttaaatgcatgtctaaaggaactaaaatgccataacccatcgcttgaagtggaagatttatctttagaaaatgctattggaaaaccttttgacaagacaatccgccattatctggatcctttgtggcaccagcttggagccaagactaaatccttagttcaggatttgaagatattacgaactttgctgcagtatctctctcagtatgattgtgtcacatttcttaatcttctggaatctctgagagcaacggaaaaagcttttggtcagaattcaggttggctgtttcttgactccagcacctcgatgtttataaatgctcgagcaagggtttatcatcttccagatgccaaaatgagtaaaaaagaaaaaatatctgaaaaaatggaaattaaagaaggggaagaaacaaaaaaggaactggtcctagaaagcaacccaaagtgggaggcactgactgaagtattaaaagaaattgaggcagaaaataaggagagtgaagctcttggtggtccaggtcaagtactgatttgtgcaagtgatgaccgaacatgttcccagctgagagactatatcactcttggagcggaggccttcttattgaggctctacaggaaaacctttgagaaggatagcaaagctgaagaagtctggatgaaatttaggaaggaagacagttcaaagagaattaggaaatctcacaaaagacctaaagacccccaaaacaaagaacgggcttctaccaaagaaagaaccctcaaaaagaaaaaacggaagttgaccttaactcaaatggtaggaaaacctgaagaactggaagaggaaggagatgtcgaggaaggatatcgtcgagaaataagcagtagcccagaaagctgcccggaagaaattaagcatgaagaatttgatgtaaatttgtcatcggatgctgctttcggaatcctgaaagaacccctcactatcatccatccgcttctgggttgcagcgacccctatgctctgacaagggtactacatgaagtggagccaagatacgtggttctttatgacgcagagctaacctttgttcggcagcttgaaatttacagggcgagtaggcctgggaaacctctgaggtactttcttatatacggaggttcaactgaggaacaacgctatctcactgctttgcggaaagaaaaggaagcttttgaaaaactcataagggaaaaagcaagcatggttgtccctgaagaaagagaaggcagagatgaaacaaacttagacctagtaagaggcacagcatctgcagatgtttccactgacactcggaaagccggtggccaggaacagaatggtacacagcaaagcatagttgtggatatgcgtgaatttcgaagtgagcttccatctctgatccatcgtcggggcattgacattgaacccgtgactttagaggttggagattacatcctcactccagaaatgtgcgtggagcgcaagagtatcagtgatttaatcggctctttaaataacggccgcctctacagccagtgcatctccatgtcccgctactacaagcgtcccgtgcttctgattgagtttgaccctagcaagcctttctctctcacttcccgaggtgccttgtttcaggagatctccagcaatgacattagttccaaactcactcttcttacacttcacttccccagactacggattctctggtgcccctctcctcatgcaacggcggagttgtttgaggagctgaaacaaagcaagccacagcctgatgcggcgacagcactggccattacagcagattctgaaacccttcccgagtcagagaagtataatcctggtccccaagacttcttgttaaaaatgccaggggtgaatgccaaaaactgccgctccttgatgcaccacgttaagaacatcgcagaattagcagccctgtcacaagacgagctcacgagtattctggggaatgctgcaaatgccaaacagctttatgatttcattcacacctcttttgcagaagtcgtatcaaaaggaaaagggaaaaagtgaacagtgatggctgttttcttatcccatgcctgtacttttcagcggctccttgccagacatcataggtcattattaattattggtttgctatttcattcttttccaatgctcttaatgattgtacggtggaccaga

SEQ ID NO: 1590 - DNA, 1110 bp, Homo sapiens
agagcttccatggagtcagggcagccggctcgacggattgccatggcgccgctgctggagtacgagcgacagctggtgctggaactgctcgacactgacgggctagtagtgtgcgcccgcgggctcggcgcggaccggctcctctaccactttctccagctgcactgccacccagcctgcctggtgctggtgctcaacacgcagccggccgaggaggagtattttatcaatcagctgaagatagaaggagttgaacacctccctcgccgtgtaacaaatgaaatcacaagcaacagtcgctatgaagtttacacacaaggtggtgttatatttgcgacaagtaggatacttgtggttgacttcttgactgatagaataccttcagatttaattactggcatcttggtgtatagagcccacagaataatcgagtcttgtcaagaagcattcatcttgcgcctctttcgccagaaaaacaaacgtggttttattaaagctttcacagacaatgctgttgcctttgatactggtttttgtcatgtggaaagagtgatgagaaatctttttgtgaggaaactgtatctgtggccaaggttccatgtagcagtaaactcatttttagaacagcacaaacctgaagttgtagaaatccatgtttctatgacacctaccatgcttgctatacagactgctatactggacattttaaatgcatgtctaaaggaactaaaatgccataacccatcgcttgaagtggaagatttatctttagaaaatgctattggaaaaccttttgacaagacaatccgccattatctggatcctttgtggcaccagcttggagccaagactaaatccttagttcaggatttgaagatattacgaactttgctgcagtatctctctcagtatgattgtgtcacatttcttaatcttctggaatctctgagagcaacggaaaaagcttttggtcagaattcaggttggctgtttcttgactccagcacctcgatgtttataaatgctcgagcaagggtttatcatcttccagatgccaaaatgagtaaaaaagaaaaaatatctgaaaaaataaaaaaaaaaaaaaaaaaa

SEQ ID NO: 1591 - DNA, 5076 bp, Homo sapiens
tttgccaacgttaaggacgcgcagctgtgacacagccccaggaagtccagatgacatgtgcccaaggtggttggggcacagattggttttatacattttagggagacaggagacatcaatcaacatatgtaagtacactggttccttccagaaaggtggggacaactcggaagcaggaagggcttctaggtcacaggtagatgagagacaaaaggctgcatacgagtttctgataagcctttccaaaggagacaatcagaatatgcatctatctcagtgagcagaaggatgactgactagaatgggaggcaggttttgccctgagcagttcccagcttgacttttcccttttgcttagtaattttgggaccctaacattttcacaggctttaaattttattattctttagttactacgtgctagcatataaataaatagtacaaaaccaagaaggcatccaccttttggttgtctcttcacgtgtaaaacaacactttgtgttaagtatcttcacacacggcggcgcaaaggtagaaaccgatactaaaaaagcgtgtagaaaatagttcccagcctgggcaacacagggagacctcatttctacaaaaataattcgccaagcatagtggtgcgcacctgcggtcccagctacttgagaggctgagatgggaaagttgcttgagctcgggcagcaggagttccaggctgcagtgagctaagaatgcgccactggactccagtatgggcgacagcgtgagaccctgtctcaaacaaaaacaaaagcccgttactccaccaagaaggcgcttttgcacattgttttaatgcttaacgccttcaggatgccagcgtgacggaagcaagtaaccaccaaggcatcaccactggcgctaaacttctcacttccggagtgctgcaagcgcagaaaatatacgtcatgtgcggaggcggagcttccgccctgcgcgtcgtattagacggaaaccgagcgggcccatttttcatgggtttgcggacccaccagcgaaggcgggaggtgtcgcagggacatcttctggctgtttccgtcgcctgcgtggcccttgcaccccggtcttccattagcggcgcagacgtttgggcctaagcgctgggcgaggcgaggccctgcccctccccgccaacggccattctctggacctgtctttcttccgggaggcggtgacagctgctgagacgtgttgcagccagagtctctccgctttaatgcgctcccattagtgccgtcccccactggaaaaccgtggcttctgtattatttgccatctttgttgtgtaggagcagggagggcttcctcccggggtcctaggcggcggtgcagtccgtcgtagaagaattagagtagaagttgtcggggtccgctcttaggacgcagccgcctcatgggggtccaggggctctggaagctgctggagtgctccgggcggcaggtcagccccgaagcgctggaagggaagatcctggctgttgatattagcatttggttaaaccaagcacttaaaggagtccgggatcgccatgggaactcaatagaaaatcctcatcttctcactttgtttcatcggctctgcaaactcttattttttcgaattcgtcctatttttgtgtttgatggggatgctccactattgaagaaacagactttggtgaagagaaggcagagaaaggacttagcgtccagtgactccaggaaaacgacagagaagcttctgaaaacatttttgaaaagacaagccatcaaaactgccttcagaagcaaaagagatgaagcactacccagtcttacccaagttcgaagagaaaacgacctctatgttttgcctcctttacaagaggaagaaaaacacagttcagaagaggaagatgaaaaagaatggcaagaaagaatgaatcaaaaacaagcattacaggaagagttctttcataatcctcaagcgatagatattgagtctgaggacttcagcagcctgccccctgaagtaaagcatgaaatcttgactgatatgaaagagttcaccaagcgcagaagaacattatttgaagcaatgccagaggagtctgatgacttttcacagtaccaactcaaaggcttgcttaaaaagaactatctgaaccagcatatagaacatgtccaaaaggaaatgaatcagcaacattcaggacacatccgaaggcagtatgaagatgaagggggctttctgaaggaggtagagtcaaggagagtggtctctgaagacacttcacattacatcttgataaaaggtattcaagctaagacagttgcagaagtggattcagagtctcttccttcttccagcaaaatgcacggcatgtcttttgacgtgaagtcatctccatgtgaaaaactgaagacagagaaagagcctgatgctacccctccttctccaagaactttactagctatgcaagctgccctgctgggaagtagctcagaagaggagctggagagtgaaaatcgaaggcaggcccgtgggaggaacgcacctgctgctgtagacgaaggctccatatcaccccggactctttcagccattaagagagctcttgacgatgacgaagatgtaaaagtgtgtgctggggatgatgtgcagacgggagggccaggagcagaagaaatgcgtataaacagctccaccgagaacagtgatgaaggacttaaagtgagagatggaaaaggaataccgtttactgcaacacttgcgtcatctagtgtgaactctgcagaggagcacgtagccagcactaatgaggggagagagcccacagactcagttccaaaagaacaaatgtcacttgttcacgtggggactgaagcctttccgataagtgatgagtctatgattaaggacagaaaagatcggctgcctctggagagtgcagtggttagacatagtgacgcacctgggctcccgaatggaagggaactgacaccggcatctccaacttgtacaaattctgtgtcaaagaatgaaacacatgctgaagtgcttgagcagcagaacgaactttgcccatatgagagtaaattcgattcttctcttctttcaagtgatgatgaaacaaaatgtaaaccgaattctgcttctgaagtcattggccctgtcagtttgcaagaaacaagtagcatagtaagtgtcccttcagaggcagtagataatgtggaaaatgtggtgtcatttaatgctaaagagcatgagaattttctggaaaccatccaagaacagcagaccactgaatctgcaggccaggatttaatttccattccaaaggccgtggaaccaatggaaattgactcggaagaaagtgaatctgatggaagtttcattgaagtgcaaagtgtgattagtgatgaggaacttcaagcagaattccctgaaacttccaaacctccctcagaacaaggcgaagaggaactggtaggaactagggagggagaagcccctgctgagtccgagagcctcctgagggacaactctgagagggacgacgtggatggtgagccacaggaagctgagaaagatgcggaagattcgctccatgaatggcaagatattaatttggaggagttggaaactctggagagcaacctcttagcacagcagaattcactgaaagctcaaaaacagcagcaagaacggatcgctgctactgtcaccggacagatgttcctggaaagccaggaactcctgcgcctgttcggcattccctacatccaggctcccatggaagcagaggcgcagtgcgccatcctggacctgactgatcagacttccggaaccatcactgatgacagtgatatctggctgtttggagcgcggcatgtctatagaaacttttttaataaaaacaagtttgtagaatattatcaatatgtggactttcacaatcaattgggattggaccggaataagttaataaatttggcttatttgcttggaagtgattataccgaaggaataccaactgtgggttgtgtaaccgccatggaaattctcaatgaattccctgggcatggcctggaacctctcctaaaattctcagaatggtggcatgaagctcaaaaaaatccaaagataagacctaatcctcatgacaccaaagtgaaaaaaaaattacggacattgcaactcacccctggctttcctaacccagctgttgccgaggcctacctcaaacccgtggtggatgactcgaagggatcctttctgtgggggaaacctgatctcgacaaaattagagaattttgtcagcggtatttcggctggaacagaacgaagacagatgaatctctgtttcctgtattaaagcaactcgatgcccagcagacacagctccgaattgattccttctttagattagcacaacaggagaaagaagatgctaaacgtattaagagccagagactaaacagagctgtgacatgtatgctaaggaaagagaaagaagcagcagccagcgaaatagaagcagtttctgttgccatggagaaagaatttgagctacttgataaggcaaaaggaaaaacccagaagagaggcataacaaataccttagaagagtcatcaagcctgaaaagaaagaggctttcagattctaaaggaaagaatacatgcggtggatttttgggggagacctgcctctcagaatcatctgatggatcttcaagtgaagatgctgaaagttcatctttaatgaatgtacaaaggagaacagctgcgaaagagccaaaaaccagtgcttcagattcgcagaactcagtgaaggaagctcccgtgaagaatggaggtgcgaccaccagcagctctagtgatagtgatgacgatggagggaaagagaagatggtcctcgtgaccgccagatctgtgtttgggaagaaaagaaggaaactaagacgtgcgaggggaagaaaaaggaaaacctaattaaaaaatatgtatcctctataattagttatgacagccatttgtaatgaatttgtcgcaaagacgtaataaaattaactggtggcacggtc

SEQ ID NO: 1592 - DNA, 2986 bp, Homo sapiens
caccacaagctggatgtgagtgtgcttatggatcctgaggtataactgtctcaggccttttcagcaacagtgccaggaagtatatttatgtatacatatacatgcacacacacatctatatttatttctatgtctatctgtactaaaatccatgagtttatactgacatctgcaattccatggggttcagtctagcctcctgcttctttatagtttccctaacaatgagaaacattgctccccttatcctcaatacatttacatctgcttattctccctggatatgtaaccatctccccctcccactggcctcctccttggccctgctctcttctttgcttcagctgtgtccttggtgccagctcccagtccctgagagccccctcctctgttctgattgtctccttaaacccagctggacaggccttgccagccctctccacctacagggaaggaaggcaaccattaaatatattttaaggagaaggaaagacagtaagacagtaagagaggagagaagggaagtggaagaggaagaactatttcttagtcacagctttattctgtgctgtgtaaatagcataaaaacatactgagcaacttccatgattgtttatatactttgataatcctcctttttgaatttttaaaacaatgtcagttaacttagaacatatttatataaagcgaatatacaaatcttaagagagtttcctactttcaaagacagtgccagtttacctaattgaaaaggcttgttttgaagttacaggcatttgtgattacatttatttattaataacgctactattacatgtattctgttatagtcatatctttcctttttaggatgtagcatttttcaggttcctccagaaagctcttgatgattgcaggatcattttaatgttttgattgtagatgaagtgaccttttaattttggtacaggaagtttcattgaagtgcaaagtgtgattagtgatgaggaacttcaagcagaattccctgaaacttccaaacctccctcagaacaaggcgaagaggaactggtaggaactagggagggagaagcccctgctgagtccgagagcctcctgagggacaactctgagagggacgacgtggatggtgagccacaggaagctgagaaagatgcggaagattcgctccatgaatggcaagatattaatttggtaataccgtaacattgtgtttcgacttcttgctgaggaagccaggttaagtaggttttgagttttaaggagttggtggatgagtatttagtagctatttgcagtacatcttgtggttgctgatggcttcatttttgtgtaggttactggctgggatagactccgttttccatgtggtttagtgatgaatctctaaagatattacagagtcttggttagacatccagtggagtacttcctaaggagaaagagcttattggtaatttcagtcagactaaatgcaggctttttgtaaacaaaactcatttggattattaatataaatctataaatgaaaaaacattttataggaggagttggaaactctggagagcaacctcttagcacagcagaattcactgaaagctcaaaaacagcagcaagaacggatcgctgctactgtcaccggacagatgttcctggaaagccaggaactcctgcgcctgttcggcattccctacatccaggctcccatggaagcagaggcgcagtgcgccatcctggacctgactgatcagacttccggaaccatcactgatgacagtgatatctggctgtttggagcgcggcatgtctatagaaacttttttaataaaaacaagtttgtagaatattatcaatatgtggactttcacaatcaattgggattggaccggaataagttaataaatttggcttatttgcttggaagtgattataccgaaggaataccaactgtgggttgtgtaaccgccatggaaattctcaatgaattccctgggcatggcctggaacctctcctaaaattctcagaatggtggcatgaagctcaaaaaaatccaaagataagacctaatcctcatgacaccaaagtgaaaaaaaaattacggacattgcaactcacccctggctttcctaacccagctgttgccgaggcctacctcaaacccgtggtggatgactcgaagggatcctttctgtgggggaaacctgatctcgacaaaattagagaattttgtcagcggtatttcggctggaacagaacgaagacagatgaatctctgtttcctgtattaaagcaactcgatgcccagcagacacagctccgaattgattccttctttagattagcacaacaggagaaagaagatgctaaacgtattaagagccagagactaaacagagctgtgacatgtatgctaaggaaagagaaagaagcagcagccagcgaaatagaagcagtttctgttgccatggagaaagaatttgagctacttgataaggcaaaaggaaaaacccagaagagaggcataacaaataccttagaagagtcatcaagcctgaaaagaaagaggctttcagattctaaaggaaagaatacatgcggtggatttttgggggagacctgcctctcagaatcatctgatggatcttcaagtgaagatgctgaaagttcatctttaatgaatgtacaaaggagaacagctgcgaaagagccaaaaaccagtgcttcagattcgcagaactcagtgaaggaagctcccgtgaagaatggaggtgcgaccaccagcagctctagtgatagtgatgacgatggagggaaagagaagatggtcctcgtgaccgccagatctgtgtttgggaagaaaagaaggaaactaagacgtgcgaggggaagaaaaaggaaaacctaattaaaaaatatgtatcctctataattagttatgacagccatttgtaatgaatttgtcgcaaagacgtaataaaattaact

SEQ ID NO: 1593 - DNA, 4008 bp, Homo sapiens
gtttccgtcgcctgcgtggcccttgcaccccggtcttccattagcggcgcagacgtttgggcctaagcgctgggcgaggcgaggccctgcccctccccgccaacggccattctctggacctgtctttcttccgggaggcggtgacagctgctgagacgtgttgcagccagagtctctccgctttaatgcgctcccattagtgccgtcccccactggaaaaccgtggcttctgtattatttgccatctttgttgtgtaggagcagggagggcttcctcccggggtcctaggcggcggtgcagtccgtcgtagaagaattagagtagaagttgtcggggtccgctcttaggacgcagccgcctcatgggggtccaggggctctggaagctgctggagtgctccgggcggcaggtcagccccgaagcgctggaagggaagatcctggctgttgaaacttcccagtggccgtatcacctcctgccattccttttgtcctgctgcactggcttcctggagatagggaccgtctctgttttgttcatggctgaattgtttggtgtatattagcatttggttaaaccaagcacttaaaggagtccgggatcgccatgggaactcaatagaaaatcctcatcttctcactttgtttcatcggctctgcaaactcttattttttcgaattcgtcctatttttgtgtttgatggggatgctccactattgaagaaacagactttgagatgaagcactacccagtcttacccaagttcgaagagaaaacgacctctatgttttgcctcctttacaagaggaagaaaaacacagttcagaagaggaagatgaaaaagaatggcaagaaagaatgaatcaaaaacaagcattacaggaagagttctttcataatcctcaagcgatagatattgagtctgaggacttcagcagcctgccccctgaagtaaagcatgaaatcttgactgatatgaaagagttcaccaagcgcagaagaacattatttgaagcaatgccagaggagtctgatgacttttcacagtaccaactcaaaggcttgcttaaaaagaactatctgaaccagcatatagaacatgtccaaaaggaaatgaatcagcaacattcaggacacatccgaaggcagtatgaagatgaagggggctttctgaaggaggtagagtcaaggagagtggtctctgaagacacttcacattacatcttgataaaaggtattcaagctaagacagttgcagaagtggattcagagtctcttccttcttccagcaaaatgcacggcatgtcttttgacgtgaagtcatctccatgtgaaaaactgaagacagagaaagagcctgatgctacccctccttctccaagaactttactagctatgcaagctgccctgctgggaagtagctcagaagaggagctggagagtgaaaatcgaaggcaggcccgtgggaggaacgcacctgctgctgtagacgaaggctccatatcaccccggactctttcagccattaagagagctcttgacgatgacgaagatgtaaaagtgtgtgctggggatgatgtgcagacgggagggccaggagcagaagaaatgcgtataaacagctccaccgagaacagtgatgaaggacttaaagtgagagatggaaaaggaataccgtttactgcaacacttgcgtcatctagtgtgaactctgcagaggagcacgtagccagcactaatgaggggagagagcccacagactcagttccaaaagaacaaatgtcacttgttcacgtggggactgaagcctttccgataagtgatgagtctatgattaaggacagaaaagatcggctgcctctggagagtgcagtggttagacatagtgacgcacctgggctcccgaatggaagggaactgacaccggcatctccaacttgtacaaattctgtgtcaaagaatgaaacacatgctgaagtgcttgagcagcagaacgaactttgcccatatgagagtaaattcgattcttctcttctttcaagtgatgatgaaacaaaatgtaaaccgaattctgcttctgaagtcattggccctgtcagtttgcaagaaacaagtagcatagtaagtgtcccttcagaggcagtagataatgtggaaaatgtggtgtcatttaatgctaaagagcatgagaattttctggaaaccatccaagaacagcagaccactgaatctgcaggccaggatttaatttccattccaaaggccgtggaaccaatggaaattgactcggaagaaagtgaatctgatggaagtttcattgaagtgcaaagtgtgattagtgatgaggaacttcaagcagaattccctgaaacttccaaacctccctcagaacaaggcgaagaggaactggtaggaactagggagggagaagcccctgctgagtccgagagcctcctgagggacaactctgagagggacgacgtggatggtgagccacaggaagctgagaaagatgcggaagattcgctccatgaatggcaagatattaatttggaggagttggaaactctggagagcaacctcttagcacagcagaattcactgaaagctcaaaaacagcagcaagaacggatcgctgctactgtcaccggacagatgttcctggaaagccaggaactcctgcgcctgttcggcattccctacatccaggctcccatggaagcagaggcgcagtgcgccatcctggacctgactgatcagacttccggaaccatcactgatgacagtgatatctggctgtttggagcgcggcatgtctatagaaacttttttaataaaaacaagtttgtagaatattatcaatatgtggactttcacaatcaattgggattggaccggaataagttaataaatttggcttatttgcttggaagtgattataccgaaggaataccaactgtgggttgtgtaaccgccatggaaattctcaatgaattccctgggcatggcctggaacctctcctaaaattctcagaatggtggcatgaagctcaaaaaaatccaaagataagacctaatcctcatgacaccaaagtgaaaaaaaaattacggacattgcaactcacccctggctttcctaacccagctgttgccgaggcctacctcaaacccgtggtggatgactcgaagggatcctttctgtgggggaaacctgatctcgacaaaattagagaattttgtcagcggtatttcggctggaacagaacgaagacagatgaatctctgtttcctgtattaaagcaactcgatgcccagcagacacagctccgaattgattccttctttagattagcacaacaggagaaagaagatgctaaacgtattaagagccagagactaaacagagctgtgacatgtatgctaaggaaagagaaagaagcagcagccagcgaaatagaagcagtttctgttgccatggagaaagaatttgagctacttgataaggcaaaaggaaaaacccagaagagaggcataacaaataccttagaagagtcatcaagcctgaaaagaaagaggctttcagattctaaaggaaagaatacatgcggtggatttttgggggagacctgcctctcagaatcatctgatggatcttcaagtgaagatgctgaaagttcatctttaatgaatgtacaaaggagaacagctgcgaaagagccaaaaaccagtgcttcagattcgcagaactcagtgaaggaagctcccgtgaagaatggaggtgcgaccaccagcagctctagtgatagtgatgacgatggagggaaagagaagatggtcctcgtgaccgccagatctgtgtttgggaagaaaagaaggaaactaagacgtgcgaggggaagaaaaaggaaaacctaattaaaaaatatgtatcctctataattagttatgacagccatttgtaatgaatttgtcgcaaagacgtaataaaattaactggtggcacggtc

SEQ ID NO: 1594 - DNA, 4928 bp, Homo sapiens
caaggtgctgtaaaatctttctgcacaagtgcctcaggagcacccttgggtcccaaaggagatggtcattatccatggagttgtccagtgactcatacacgggaaaaaatttatgccatctgttcggactatgcctttctcaaccaggcgacctcaatctataaaactccaaatccatcccgctctccttgcctccctgatagtacctctttatctgctggaaataattcatcaagatacattggtatcccgactagtacatcggaaattatctacaatgaagaaaatagcttggaaaacttatccaacagcctgggcaagctacctctcgcatgggaaattgataaatctgaatttgatggggtgaccacaaattcgaaacacaaatcaggcaatgcaaagaaacaagtttccaagagaaaaacttcagataaaaagggaagatatcagaaggaatgtcctcagcattctcctcttgaagatattaaacagcggaaagtattagacctcagacgatggtactgcataagccgaccacagtataagacttcttgtggcatctcttcattaatttcttgttggaatttcttatacagcacaatgggagctggaaaccttccacctattacccaagaagaagctttacatattctgggctttcaacctccatttgaagatattaggtttggtcctttcacggggaatacaacacttatgaggtggtttagacaaattaatgaccacttccatgtaaaaggatgctcttatgttctatataagcctcatgggaagaataaaacagcaggagaaactgcttcaggggccctgtcaaagttaacccgtggattgaaagatgaatcgctggcttatatctatcattgccaaaatcattatttttgtccaattggcttcgaagcaacccctgttaaagctaataaagcattcagcaggggacctctctcaccacaggaagttgaatattggatcttaattggagaatcaagtagaaaacatcctgccattcactgtaaaaaatgggcagatattgttactgatctaaacactcaaaatccagaatacctggatatccggcacttagagaggggactgcagtatagaaaaacaaagaaggttgggggaaatttgcattgcatcatagcattccagagacttaactggcaaagatttggcctttggaactttccatttggaaccattagacaagaatcacaacctccaacacatgcccagggaattgccaaatctgagagtgaagacaatatttccaagaagcagcatgggcgtctgggccggtctttcagtgctagtttccatcaggactcggcatggaaaaagatgtctaatattagcatttggttaaaccaagcacttaaaggagtccgggatcgccatgggaactcaatagaaaatcctcatcttctcactttgtttcatcggctctgcaaactcttattttttcgaattcgtcctatttttgtgtttgatggggatgctccactattgaagaaacagactttggtgaagagaaggcagagaaaggacttagcgtccagtgactccaggaaaacgacagagaagcttctgaaaacatttttgaaaagacaagccatcaaaactgccttcagaagcaaaagagatgaagcactacccagtcttacccaagttcgaagagaaaacgacctctatgttttgcctcctttacaagaggaagaaaaacacagttcagaagaggaagatgaaaaagaatggcaagaaagaatgaatcaaaaacaagcattacaggaagagttctttcataatcctcaagcgatagatattgagtctgaggacttcagcagcctgccccctgaagtaaagcatgaaatcttgactgatatgaaagagttcaccaagcgcagaagaacattatttgaagcaatgccagaggagtctgatgacttttcacagtaccaactcaaaggcttgcttaaaaagaactatctgaaccagcatatagaacatgtccaaaaggaaatgaatcagcaacattcaggacacatccgaaggcagtatgaagatgaagggggctttctgaaggaggtagagtcaaggagagtggtctctgaagacacttcacattacatcttgataaaaggtattcaagctaagacagttgcagaagtggattcagagtctcttccttcttccagcaaaatgcacggcatgtcttttgacgtgaagtcatctccatgtgaaaaactgaagacagagaaagagcctgatgctacccctccttctccaagaactttactagctatgcaagctgccctgctgggaagtagctcagaagaggagctggagagtgaaaatcgaaggcaggcccgtgggaggaacgcacctgctgctgtagacgaaggctccatatcaccccggactctttcagccattaagagagctcttgacgatgacgaagatgtaaaagtgtgtgctggggatgatgtgcagacgggagggccaggagcagaagaaatgcgtataaacagctccaccgagaacagtgatgaaggacttaaagtgagagatggaaaaggaataccgtttactgcaacacttgcgtcatctagtgtgaactctgcagaggagcacgtagccagcactaatgaggggagagagcccacagactcagttccaaaagaacaaatgtcacttgttcacgtggggactgaagcctttccgataagtgatgagtctatgattaaggacagaaaagatcggctgcctctggagagtgcagtggttagacatagtgacgcacctgggctcccgaatggaagggaactgacaccggcatctccaacttgtacaaattctgtgtcaaagaatgaaacacatgctgaagtgcttgagcagcagaacgaactttgcccatatgagagtaaattcgattcttctcttctttcaagtgatgatgaaacaaaatgtaaaccgaattctgcttctgaagtcattggccctgtcagtttgcaagaaacaagtagcatagtaagtgtcccttcagaggcagtagataatgtggaaaatgtggtgtcatttaatgctaaagagcatgagaattttctggaaaccatccaagaacagcagaccactgaatctgcaggccaggatttaatttccattccaaaggccgtggaaccaatggaaattgactcggaagaaagtgaatctgatggaagtttcattgaagtgcaaagtgtgattagtgatgaggaacttcaagcagaattccctgaaacttccaaacctccctcagaacaaggcgaagaggaactggtaggaactagggagggagaagcccctgctgagtccgagagcctcctgagggacaactctgagagggacgacgtggatggtgagccacaggaagctgagaaagatgcggaagattcgctccatgaatggcaagatattaatttggaggagttggaaactctggagagcaacctcttagcacagcagaattcactgaaagctcaaaaacagcagcaagaacggatcgctgctactgtcaccggacagatgttcctggaaagccaggaactcctgcgcctgttcggcattccctacatccaggctcccatggaagcagaggcgcagtgcgccatcctggacctgactgatcagacttccggaaccatcactgatgacagtgatatctggctgtttggagcgcggcatgtctatagaaacttttttaataaaaacaagtttgtagaatattatcaatatgtggactttcacaatcaattgggattggaccggaataagttaataaatttggcttatttgcttggaagtgattataccgaaggaataccaactgtgggttgtgtaaccgccatggaaattctcaatgaattccctgggcatggcctggaacctctcctaaaattctcagaatggtggcatgaagctcaaaaaaatccaaagataagacctaatcctcatgacaccaaagtgaaaaaaaaattacggacattgcaactcacccctggctttcctaacccagctgttgccgaggcctacctcaaacccgtggtggatgactcgaagggatcctttctgtgggggaaacctgatctcgacaaaattagagaattttgtcagcggtatttcggctggaacagaacgaagacagatgaatctctgtttcctgtattaaagcaactcgatgcccagcagacacagctccgaattgattccttctttagattagcacaacaggagaaagaagatgctaaacgtattaagagccagagactaaacagagctgtgacatgtatgctaaggaaagagaaagaagcagcagccagcgaaatagaagcagtttctgttgccatggagaaagaatttgagctacttgataaggcaaaaggaaaaacccagaagagaggcataacaaataccttagaagagtcatcaagcctgaaaagaaagaggctttcagattctaaaggaaagaatacatgcggtggatttttgggggagacctgcctctcagaatcatctgatggatcttcaagtgaagatgctgaaagttcatctttaatgaatgtacaaaggagaacagctgcgaaagagccaaaaaccagtgcttcagattcgcagaactcagtgaaggaagctcccgtgaagaatggaggtgcgaccaccagcagctctagtgatagtgatgacgatggagggaaagagaagatggtcctcgtgaccgccagatctgtgtttgggaagaaaagaaggaaactaagacgtgcgaggggaagaaaaaggaaaacctaattaaaaaatatgtatcctctataattagttatgacagccatttgtaatgaatttgtcgcaaagacgtaataaaattaactggtggcacggtc

SEQ ID NO: 1595 - DNA, 1142 bp, Homo sapiens
ggaaaccgagcgggcccatttttcatgggtttgcggacccaccagcgaaggcgggaggtgtcgcagggacatcttctggctgtttccgtcgcctgcgtggcccttgcaccccggtcttccattagcggcgcagacgtttgggcctaagcgctgggcgaggcgaggccctgcccctccccgccaacggccattctctggacctgtctttcttccgggaggcggtgacagctgctgagacgtgttgcagccagagtctctccgctttaatgcgctcccattagtgccgtcccccactggaaaaccgtggcttctgtattatttgccatctttgttgtgtaggagcagggagggcttcctcccggggtcctaggcggcggtgcagtccgtcgtagaagaattagagtagaagttgtcggggtccgctcttaggacgcagccgcctcatgggggtccaggggctctggaagctgctggagtgctccgggcggcaggtcagccccgaagcgctggaagggaagatcctggctgttgatattagcatttggttaaaccaagcacttaaaggagtccgggatcgccatgggaactcaatagaaaatcctcatcttctcactttgtttcatcggctctgcaaactcttattttttcgaattcgtcctatttttgtgtttgatggggatgctccactattgaagaaacagactttggtgaagagaaggcagagaaaggacttagcgtccagtgactccaggaaaacgacagagaagcttctgaaaacatttttgaaaagacaagccatcaaaactgccttcagaagcaaaagagatgaagcactacccagtcttacccaagttcgaagagaaaacgacctctatgttttgcctcctttacaagaggaagaaaaacacagttcagaagaggaagatgaaaaagaatggcaagaaagaatgaatcaaaaacaagcattacaggaagagttctttcataatcctcaagcgatagatattgagtctgaggacttcagcagcctgccccctgaagtaaagcatgaaatcttgactgatatgaaagagttcaccaagcgcagaagaacattatttgaagcaatgccagaggtatatcttcctctgctgcagccctag

SEQ ID NO: 1596 - DNA, 8008 bp, Homo sapiens
tgggttccaaggcggctggcggcggtagcgtctctgtttccttgtgggcgctcgcgcggccctgggtagtctgtagagaatgccaaatgagggaatcccccactcaagtcaaactcaggagcaagactgtttacagagtcaacctgtcagtaataatgaagaaatggcaatcaagcaagaaagtggtggtgatggggaggtggaggagtacctctcctttcgttctgtgggtgacgggctgtccacctctgctgtggggtgcgcatcagcagctccgaggagagggccagccctgctgcacatcgaccgacatcagatccaggcagtagagcctagcgcccaggcccttgagctgcagggtttgggtgtggacgtctatgaccaggacgtgctggaacagggagtgcttcagcaggtggacaatgccatccatgaggccagccgtgcctcccagctcgttgacgtggagaaggagtatcggtcggtcctggatgacctcacgtcatgtacgacatccctaaggcaaatcaataaaattattgaacagcttagccctcaagctgccaccagcagagacatcaacaggaaactagattctgtaaaacgacagaagtataataaggaacaacagctaaaaaagatcactgcaaaacaaaagcatctccaggccatccttggaggagcagaggtgaaaattgaactagatcacgccagtctggaggaggatgcagagccggggccatccagtcttggcagcatgctcatgcctgtccaggagactgcctgggaagagctcatccgcactggccagatgacaccttttggtacccagatccctcagaaacaggagaaaaagcccagaaaaatcatgcttaatgaagcatcaggcttcgaaaagtatttggcagatcaagcaaaactgtcttttgaaaggaagaagcaaggttgtaataaaagagcagctagaaaagctccagccccagtcacgcctccagccccagtgcaaaataaaaacaaaccaaacaagaaagccagagttctgtccaaaaaagaggagcgtttgaaaaagcacatcaagaaactccagaagagggctttgcagttccaggggaaagtgggattgccaaaggcaaggagaccttgggagtcagacatgaggccagaggcagagggagactctgagggtgaagagtctgagtatttccccacagaggaggaggaagaggaggaagatgacgaggtggagggggcagaggcggacctgtctggagatggtactgactatgagctgaagcctctgcccaagggcgggaaacggcagaagaaagtgccagtgcaggagattgatgatgactttttcccaagttctggggaagaagctgaagctgcttctgtaggagaaggaggaggaggaggtcggaaagtgggaagataccgagatgatggagatgaagattattataagcagcggttaaggagatggaataaactgagactgcaggacaaagagaaacgtctgaagctggaggacgattctgaggaaagtgatgctgaatttgacgaaggttttaaagtgccaggttttctgttcaaaaagctttttaagtaccagcagacaggtgttaggtggctgtgggaattgcactgccagcaggcaggaggaattctgggagatgaaatgggattgggcaagaccatccagataattgccttcttggcaggtctgagctacagcaagatcaggactcgtggttcaaattacaggtttgaggggttgggtccaactgtaattgtctgtccaacaacagtgatgcatcagtgggtgaaggaatttcacacgtggtggcctccgttcagagtggcaattctacatgaaaccggttcctatacccacaaaaaggagaaactaattcgagatgttgctcattgtcatggaattttgatcacatcttactcctacattcgattgatgcaggatgacattagcaggtatgactggcactatgtgatcttggacgaaggacacaaaattcgaaatccaaatgctgctgtcacccttgcttgcaaacagtttcgcacccctcatcggatcattctgtctggctcaccgatgcaaaataacctccgagagctgtggtcgctctttgacttcatcttcccgggaaagttaggcacgttgcctgtgtttatggagcagttctccgtccccatcaccatggggggatattcaaatgcttccccagtacaggtcaaaactgcttacaagtgtgcatgtgtcttacgagataccataaatccatacctactgcggagaatgaagtcagatgtcaagatgagcctttctttgccagataaaaatgaacaggtcttattttgccgtcttacagatgagcagcataaagtctaccaaaatttcgttgattccaaagaagtttacaggattctcaatggagagatgcagattttctccggacttatagccctaagaaaaatttgcaaccaccctgatctcttttctggaggtcccaagaatctcaaaggtcttcctgatgatgaactagaagaagatcagtttgggtactggaaacgttctgggaaaatgattgttgttgagtctttgttgaaaatatggcacaagcagggtcagcgagtattgctgttttctcagtcaaggcagatgctggacatacttgaagtattccttagagcccaaaagtatacctatctcaagatggatggtaccactacaatagcttcaagacagccactgattacgagatacaatgaggacacatccatatttgtgtttcttctgaccacgcgggtgggcggcttaggtgtcaacctgacgggggcaaacagagttgtcatctatgacccagactggaacccaagcacggacacgcaggcccgggagcgagcatggagaataggccagaagaagcaagtgactgtgtacaggctcctgactgcgggcaccattgaagaaaagatctaccaccgacaaatcttcaagcagtttttgacaaatagagtgctaaaagacccaaaacaaaggcggtttttcaaatccaatgatctctatgagctatttactctgactagtcctgatgcatcccagagcactgaaacaagtgcaatttttgcaggaactggatcagatgttcagacacccaaatgccatctaaaaagaaggattcaaccagcctttggagcagaccatgatgttccaaaacgcaagaagttccctgcttctaacatatctgtaaatgatgccacatcatctgaagagaaatctgaggctaaaggagctgaagtaaatgcagtaacttctaatcgaagtgatcctttgaaagatgaccctcacatgagtagtaatgtaactagcaatgataggcttggagaagagacaaatgcagtatctggaccagaagagttgtcagtgattagtggaaatggggaatgttcaaattcttcaggaacaggcaaaacttctatgccatctggtgatgaaagcattgatgaaaagttaggtctttcttacaaaagagaaagacccagccaggctcaaacagaagctttttgggagaataaacaaatggaaaataatttttataagcacaagtcaaaaacaaaacatcatagtgtggcagaagaagagaccctggagaaacatctgagaccaaagcaaaagcctaagaactctaagcattgcagagacgccaagtttgaaggaactcgaattccacacctggtgaagaaaaggcgttaccagaagcaagacagtgaaaacaagagtgaggccaaggaacagagcaatgacgattatgttttggaaaagcttttcaaaaaatcagttggcgtgcacagtgtcatgaagcacgatgccatcatggatggagccagcccagattatgtactggtggaggcagaagccaaccgagtggcccaggatgccctgaaagcactgaggctctctcgtcagcggtgtctgggagcagtgtctggtgttcccacctggactggccacagggggatttctggtgcaccagcaggaaaaaagagtagatttggtaagaaaaggaattctaacttctctgtgcagcatccttcatcaacatctccaacagagaagtgccaggatggcatcatgaaaaaggagggaaaagataatgtccctgagcattttagtggaagagcagaagatgcagactcttcatccgggcccctcgcttcctcctcactcttggctaaaatgagagctagaaaccacctgattctgccagagcgtttagaaagtgaaagcgggcacctgcaggaagcttctgccctgctgcccaccacagaacacgatgaccttctggtggagatgagaaacttcatcgctttccaggcccacactgatggccaggccagcaccagggagatactgcaggagtttgaatccaagttatctgcatcacagtcttgtgtcttccgagaactattgagaaatctgtgcactttccatagaacttctggtggtgaaggaatttggaaactcaagccagaatactgctaaacaacattgcttcctaaactttcaagtccctttttctaacgggcatttctgattattaatttattattaataatcatgtttgtcaatggaagttggctgcacttgatgtttgtttgcatgatgtctacctcagaattaaaactttaaggaagaagaaactcttctctgaaagttaaaagttttaataatgctagctaaaggagaaaatacttggattgatttttttttttttggcaatctaattatattgtaaatcaggtacctaacagttactccttggagcacatttgttcctttacccaaaagatgctgtcagggagcacagttagaagtttgcagaacagaaatctcaatatttttttttattggtgctaaaaacaggtcttacattcagtcagacctgttcaataagttcatcaatatctgataacagcattattttgatgcttaaactttaaacatttatatttaccatttgccacccacaaaggtcaggtttgttatttgttgtttgataattatattaattttcttggaaagatcctcttttcaaggtactggtaaattggtgagtatttttattagtaaagcatgaaatagtatggtaataaatgataagacatgtatttgtggaaagctgtagggtattcagtttaccctggctttcctttaagcagagggcatctttttctctcctacagtcacaaaatgtgttatcattaaaaaaaatcaaattaaagccaaaagtaggtacataaaaaccacacacatgcatgcacacaaacatcactgcagcccacagcagacccagccgttgttaccatgaagtgacaccactccaggcctctcttgtctgcaggctggcaggctgtcttctctccagttgccttcgtcttgcgcctgcctttgcattccttgcgacgggctttcttgtttctgcggtttggattccagccaaggctgtttgtatctcactactgtttatgtgtttgtggttctgtgatggtgttgctttgatcctcagtttattttcttacccatgtttttcttgtttccttctcaggatgattttatcatctcatctttgaagtgttgttttccgaaattcatcgtattcctgaaatttcttcttagctgtcttagtgcagtttgtttcttggatttgtattctctggcatgctcttttcctctctctcatttttctgtagtatgcctgccctcctaccctgctatttctttacatctctctcatgcttaacatggatagctgtgtccagatcttctgtctgctcatccatgtgactcagagaggagggttctgggcaggggggccttgccggactgcatgagaggacatgagttttgctttctctgctctaatattttgcttaagccaagaatccttttcttagagatgttctatatgattcctgtcaggattttctagttttttttggattatagcttgttcatttcttttgtttttagtttggtttatatataatgagggaagaagatgattacattatttttgtcactttgccatcattgtttagaagtcatagaaagaatttttaaataggccaataagtcttaaacttgagtacttggcttagaagaaagtcaaaactccttcctttttgactaagtggtttgtttctggggagctcttaatttctatttttataatcattagcctataaggaaattgtgtcttccttgttctcagggtgatctgctgaccttgttcactcatgaagcatttgggtatcatacttatagtgtctgaaacataaactgtattgagctagacaaggtatagcctcctcttcaagtagcaaatactatcaaaagctataatgcagtaggagcaaggtggtccttgttccagtttttgtctcagttctgctgctgatgtaccatgatcttgggaaggtggtgtctcagtgtggagatctgacacattgttaccgtgcctcctggctggagggacttggagaacaatgcagttaagtagaatggttttaacaatacagagaaatttattcatttagataaaaatctgatttttagaactttaaaagctttgtacagtgtaaatagatttaatgtatttaacatgctttatcagcacaaataaaggattttaaaattttgtcaaaaaattaaatgttaatactatcaccattaaaaatgttcaagcaatagtctgcctccccacccccacaccatcttgcacctgttccacagctaagtacagccctaggtttggtgtgtattctccatgcatttagagaatcacatgacacagactgctgctataatgtcattttcccattcttcctttactaataaaatttttgagttttacctggacgtctggctgctcagcttaagactacttctcagcctctcttatagttaattgtggccatatgactaagttttaaacttcccaattggccctttaaagaagcagggtatgcactctccttgacattcccctttcttgctggctgggaggccaatgggagcttcagtagtgacctggcatctcaagagatggaagtgatgtgttgaggaaggagaagttggcctgccagtcttgaactgctctcctttgacctgttatttaagagtaaaataaaatactgacttgcttaagctactgtcttttgaagtctattatagcaattagtttgctttaaatatgtaatttatattaatggccttataccatccttattttgcaactaacttttcatttaatattatatgcaagacatttctattcctgtaagtatagctctgcctgcacagaattgttggattaatgatgtagattttaaatgtcagtggatgtagcagaattgcttgcatcaattcaccctccataaaaggacccatttctccaaacccttgccaacagtaagtggtatcaatatcgataggttgttttgttttgttttaaccagtctcgtgattgaaagtaccttgttttcacttgaatttccctgattacgtacaaaatcaaacatttccatgtttattggccatttgtagatctctaccgtacattgcctattagtgttatgttggcctagttttcctgtgggttgtttatcttttaggattgctcccctaaacaaaaacaaaaaggcagttattccaatgatcaacaaatattcttttctccaccagtttaaaatgtcagctttcaactcatcacatgctaagttgtctatttctgtcctgtggatccaggtgttggttctaccaaccacactcctcacgctgtcatttggtgctttgcattgtgttttgccattcatgggcaagttccttttcctttctccccctcttcagtgtcttatacttgggtgttttctgttccagctgaatcaagaattagtttattaaattccagtaaaattgtggtgttctttt

SEQ ID NO: 1597 - DNA, 4983 bp, Homo sapiens
cagcagccctttcacagacatcttctaatgacaacagcactgcattcagagaaactaattcgagatgttgctcattgtcatggaattttgatcacatcttactcctacattcgattgatgcaggatgacattagcaggtatgactggcactatgtgatcttggacgaaggacacaaaattcgaaatccaaatgctgctgtcacccttgcttgcaaacagtttcgcacccctcatcggatcattctgtctggctcaccgatgcaaaataacctccgagagctgtggtcgctctttgacttcatcttcccgggaaagttaggcacgttgcctgtgtttatggagcagttctccgtccccatcaccatggggggatattcaaatgcttccccagtacaggtcaaaactgcttacaagtgtgcatgtgtcttacgagataccataaatccatacctactgcggagaatgaagtcagatgtcaagatgagcctttctttgccagataaaaatgaacagattttctccggacttatagccctaagaaaaatttgcaaccaccctgatctcttttctggaggtcccaagaatctcaaaggtcttcctgatgatgaactagaagaagatcagtttgggtactggaaacgttctgggaaaatgattgttgttgagtctttgttgaaaatatggcacaagcagggtcagcgagtattgctgttttctcagtcaaggcagatgctggacatacttgaagtattccttagagcccaaaagtatacctatctcaagatggatggtaccactacaatagcttcaagacagccactgattacgagatacaatgaggacacatccatatttgtgtttcttctgaccacgcgggtgggcggcttaggtgtcaacctgacgggggcaaacagagttgtcatctatgacccagactggaacccaagcacggacacgcaggcccgggagcgagcatggagaataggccagaagaagcaagtgactgtgtacaggctcctgactgcgggcaccattgaagaaaagatctaccaccgacaaatcttcaagcagtttttgacaaatagagtgctaaaagacccaaaacaaaggcggtttttcaaatccaatgatctctatgagctatttactctgactagtcctgatgcatcccagagcactgaaacaagtgcaatttttgcaggaactggatcagatgttcagacacccaaatgccatctaaaaagaaggattcaaccagcctttggagcagaccatgatgttccaaaacgcaagaagttccctgcttctaacatatctgtaaatgatgccacatcatctgaagagaaatctgaggctaaaggagctgaagtaaatgcagtaacttctaatcgaagtgatcctttgaaagatgaccctcacatgagtagtaatgtaactagcaatgataggcttggagaagagacaaatgcagtatctggaccagaagagttgtcagtgattagtggaaatggggaatgttcaaattcttcaggaacaggcaaaacttctatgccatctggtgatgaaagcattgatgaaaagttaggtctttcttacaaaagagaaagacccagccaggctcaaacagaagctttttgggagaataaacaaatggaaaataatttttataagcacaagtcaaaaacaaaacatcatagtgtggcagaagaagagaccctggagaaacatctgagaccaaagcaaaagcctaagaactctaagcattgcagagacgccaagtttgaaggaactcgaattccacacctggtgaagaaaaggcgttaccagaagcaagacagtgaaaacaagagtgaggccaaggaacagagcaatgacgattatgttttggaaaagcttttcaaaaaatcagttggcgtgcacagtgtcatgaagcacgatgccatcatggatggagccagcccagattatgtactggtggaggcagaagccaaccgagtggcccaggatgccctgaaagcactgaggctctctcgtcagcggtgtctgggagcagtgtctggtgttcccacctggactggccacagggggatttctggtgcaccagcaggaaaaaagagtagatttggtaagaaaaggaattctaacttctctgtgcagcatccttcatcaacatctccaacagagaagtgccaggatggcatcatgaaaaaggagggaaaagataatgtccctgagcattttagtggaagagcagaagatgcagactcttcatccgggcccctcgcttcctcctcactcttggctaaaatgagagctagaaaccacctgattctgccagagcgtttagaaagtgaaagcgggcacctgcaggaagcttctgccctgctgcccaccacagaacacgatgaccttctggtggagatgagaaacttcatcgctttccaggcccacactgatggccaggccagcaccagggagatactgcaggagtttgaatccaagttatctgcatcacagtcttgtgtcttccgagaactattgagaaatctgtgcactttccatagaacttctggtggtgaaggaatttggaaactcaagccagaatactgctaaacaacattgcttcctaaactttcaagtccctttttctaacgggcatttctgattattaatttattattaataatcatgtttgtcaatggaagttggctgcacttgatgtttgtttgcatgatgtctacctcagaattaaaactttaaggaagaagaaactcttctctgaaagttaaaagttttaataatgctagctaaaggagaaaatacttggattgatttttttttttttggcaatctaattatattgtaaatcaggtacctaacagttactccttggagcacatttgttcctttacccaaaagatgctgtcagggagcacagttagaagtttgcagaacagaaatctcaatatttttttttattggtgctaaaaacaggtcttacattcagtcagacctgttcaataagttcatcaatatctgataacagcattattttgatgcttaaactttaaacatttatatttaccatttgccacccacaaaggtcaggtttgttatttgttgtttgataattatattaattttcttggaaagatcctcttttcaaggtactggtaaattggtgagtatttttattagtaaagcatgaaatagtatggtaataaatgataagacatgtatttgtggaaagctgtagggtattcagtttaccctggctttcctttaagcagagggcatctttttctctcctacagtcacaaaatgtgttatcattaaaaaaaatcaaattaaagccaaaagtaggtacataaaaaccacacacatgcatgcacacaaacatcactgcagcccacagcagacccagccgttgttaccatgaagtgacaccactccaggcctctcttgtctgcaggctggcaggctgtcttctctccagttgccttcgtcttgcgcctgcctttgcattccttgcgacgggctttcttgtttctgcggtttggattccagccaaggctgtttgtatctcactactgtttatgtgtttgtggttctgtgatggtgttgctttgatcctcagtttattttcttacccatgtttttcttgtttccttctcaggatgattttatcatctcatctttgaagtgttgttttccgaaattcatcgtattcctgaaatttcttcttagctgtcttagtgcagtttgtttcttggatttgtattctctggcatgctcttttcctctctctcatttttctgtagtatgcctgccctcctaccctgctatttctttacatctctctcatgcttaacatggatagctgtgtccagatcttctgtctgctcatccatgtgactcagagaggagggttctgggcaggggggccttgccggactgcatgagaggacatgagttttgctttctctgctctaatattttgcttaagccaagaatccttttcttagagatgttctatatgattcctgtcaggattttctagttttttttggattatagcttgttcatttcttttgtttttagtttggtttatatataatgagggaagaagatgattacattatttttgtcactttgccatcattgtttagaagtcatagaaagaatttttaaataggccaataagtcttaaacttgagtacttggcttagaagaaagtcaaaactccttcctttttgactaagtggtttgtttctggggagctcttaatttctatttttataatcattagcctataaggaaattgtgtcttccttgttctcagggtgatctgctgaccttgttcactcatgaagcatttgggtatcatacttatagtgtctgaaacataaactgtattgagctagacaaggtatagcctcctcttcaagtagcaaatactatcaaaagctataatgcagtaggagcaaggtggtccttgttccagtttttgtctcagttctgctgctgatgtaccatgatcttgggaaggtggtgtctcagtgtggagatctgacacattgttaccgtgcctcctggctggagggacttggagaacaatgcagttaagtagaatggttttaacaatacagagaaatttattcatttagataaaaatctgatttttagaactttaaaagctttgtacagtgtaaatagatttaatgtatttaacatgctttatcagcacaaataaaggattttaaaattttgtcaaaaaattaaatgttaatactatcaccattaaaaatgttcaagcaatagtctgcctccccacccccacaccatcttgcacctgttccacagctaagtacagccctaggtttggtgtgtattctccatgcatttagagaatcacatgacacagactgctgctataatgtcattttcccattcttcctttactaataaaatttttgagtttta

SEQ ID NO: 1598 - DNA, 660 bp, Homo sapiens
aggtgcgcgcgtggcggagggggaacagagaagcaggacagctctccatccttcccgtgttcagtcgtgggagacaacaagagaggtcacagcctggcgaccaaaaagtagtctgtagagaatgccaaatgagggaatcccccactcaagtcaaactcaggagcaagactgtttacagagtcaacctgtcagtaataatgaagaaatggcaatcaagcaagaaagtggtggtgatggggaggtggaggagtacctctcctttcgttctgtgggtgacgggctgtccacctctgctgtggggtgcgcatcagcagctccgaggagagggccagccctgctgcacatcgaccgacatcagatccaggcagtagagcctagcgcccaggcccttgagctgcagggtttgggtgtggacgtctatgaccaggacgtgctggaacagggagtgcttcagcaggtggacaatgccatccatgaggccagccgtgcctcccagctcgttgacgtggagaaggagtatcggtcggtcctggatgacctcacgtcatgtacgacatccctaaggcaaatcaataaaattattgaacagcttagccctcaagctgccaccagcagagacatcaacaggaaactagattctgtaaaacgacagaagtataa

SEQ ID NO: 1599 - DNA, 2256 bp, Homo sapiens
aagtgatgctgaatttgacgaaggttttaaagtgccaggttttctgttcaaaaagctttttaagtaccagcagacaggtgttaggtggctgtgggaattgcactgccagcaggcaggaggaattctgggagatgaaatgggattgggcaagaccatccagataattgccttcttggcaggtctgagctacagcaagatcaggactcgtggttcaaattacaggtttgaggggttgggtccaactgtaattgtctgtccaacaacagtgatgcatcagtgggtgaaggaatttcacacgtggtggcctccgttcagagtggcaattctacatgaaaccggttcctatacccacaaaaaggagaaactaattcgagatgttgctcattgtcatggaattttgatcacatcttactcctacattcgattgatgcaggatgacattagcaggtatgactggcactatgtgatcttggacgaaggacacaaaattcgaaatccaaatgctgctgtcacccttgcttgcaaacagtttcgcacccctcatcggatcattctgtctggctcaccgatgcaaaataacctccgagagctgtggtcgctctttgacttcatcttcccgggaaagttaggcacgttgcctgtgtttatggagcagttctccgtccccatcaccatggggggatattcaaatgcttccccagtacaggtcaaaactgcttacaagtgtgcatgtgtcttacgagataccataaatccatacctactgcggagaatgaagtcagatgtcaagatgagcctttctttgccagataaaaatgaacaggtcttattttgccgtcttacagatgagcagcataaagtctaccaaaatttcgttgattccaaagaagtttacaggattctcaatggagagatgcaggaggttcttcagtcattcacatctattcatctccatgaatctccccttaacttcttcaggtctttccaagttagggggtctagatcacactatccaggaaagggaatgcaaactacacttggaattgtaaattttctagtagtcacattaaaaaggaaaaagagaaacagattttctccggacttatagccctaagaaaaatttgcaaccaccctgatctcttttctggaggtcccaagaatctcaaaggtcttcctgatgatgaactagaagaagatcagtttgggtactggaaacgttctgggaaaatgattgttgttgagtctttgttgaaaatatggcacaagcagggtcagcgagtattgctgttttctcagtcaaggcagatgctggacatacttgaagtattccttagagcccaaaagtatacctatctcaagatggatggtaccactacaatagcttcaagacagccactgattacgagatacaatgaggacacatccatatttgtgtttcttctgaccacgcgggtgggcggcttaggtgtcaacctgacgggggcaaacagagttgtcatctatgacccagactggaacccaagcacggacacgcaggcccgggagcgagcatggagaataggccagaagaagcaagtgactgtgtacaggctcctgactgcgggcaccattgaagaaaagatctaccaccgacaaatcttcaagcagtttttgacaaatagagtgctaaaagacccaaaacaaaggcggtttttcaaatccaatgatctctatgagctatttactctgactagtcctgatgcatcccagagcactgaaacaagtgcaatttttgcaggaactggatcagatgttcagacacccaaatgccatctaaaaagaaggattcaaccagcctttggagcagaccatgatgttccaaaacgcaagaagttccctgcttctaacatatctgtaaatgatgccacatcatctgaagagaaatctgaggctaaaggagctgaagtaaatgcagtaacttctaatcgaagtgatcctttgaaagatgaccctcacatgagtagtaatgtaactagcaatgataggcttggagatactgcaggagtttgaatccaagttatctgcatcacagtcttgtgtcttccgagaactattgagaaatctgtgcactttccatagaacttctggtggtgaaggaatttggaaactcaagccagaatactgctaaacaacattgcttcctaaactttcaagtccctttttctaacgggcatttctgattattaatttattattaataatcatgtttgtcaatgg

SEQ ID NO: 1600 - DNA, 2932 bp, Homo sapiens
aaaatgagattttaggtagacatacctataggtaccagatagtaagtatttggacagcaaaacaacaaaactatcttcttttaaggtaccagcagacaggtgttaggtggctgtgggaattgcactgccagcaggcaggaggaattctgggagatgaaatgggattgggcaagaccatccagataattgccttcttggcaggtctgagctacagcaagatcaggactcgtggttcaaattacaggagaaactaattcgagatgttgctcattgtcatggaattttgatcacatcttactcctacattcgattgatgcaggatgacattagcaggtatgactggcactatgtgatcttggacgaaggacacaaaattcgaaatccaaatgctgctgtcacccttgcttgcaaacagtttcgcacccctcatcggatcattctgtctggctcaccgatgcaaaataacctccgagagctgtggtcgctctttgacttcatcttcccgggaaagttaggcacgttgcctgtgtttatggagcagttctccgtccccatcaccatggggggatattcaaatgcttccccagtacaggtcaaaactgcttacaagtgtgcatgtgtcttacgagataccataaatccatacctactgcggagaatgaagtcagatgtcaagatgagcctttctttgccagataaaaatgaacaggtcttattttgccgtcttacagatgagcagcataaagtctaccaaaatttcgttgattccaaagaagtttacaggattctcaatggagagatgcagattttctccggacttatagccctaagaaaaatttgcaaccaccctgatctcttttctggaggtcccaagaatctcaaaggtcttcctgatgatgaactagaagaagatcagtttgggtactggaaacgttctgggaaaatgattgttgttgagtctttgttgaaaatatggcacaagcagggtcagcgagtattgctgttttctcagtcaaggcagatgctggacatacttgaagtattccttagagcccaaaagtatacctatctcaagatggatggtaccactacaatagcttcaagacagccactgattacgagatacaatgaggacacatccatatttgtgtttcttctgaccacgcgggtgggcggcttaggtgtcaacctgacgggggcaaacagagttgtcatctatgacccagactggaacccaagcacggacacgcaggcccgggagcgagcatggagaataggccagaagaagcaagtgactgtgtacaggctcctgactgcgggcaccattgaagaaaagatctaccaccgacaaatcttcaagcagtttttgacaaatagagtgctaaaagacccaaaacaaaggcggtttttcaaatccaatgatctctatgagctatttactctgactagtcctgatgcatcccagagcactgaaacaagtgcaatttttgcaggaactggatcagatgttcagacacccaaatgccatctaaaaagaaggattcaaccagcctttggagcagaccatgatgttccaaaacgcaagaagttccctgcttctaacatatctgtaaatgatgccacatcatctgaagagaaatctgaggctaaaggagctgaagtaaatgcagtaacttctaatcgaagtgatcctttgaaagatgaccctcacatgagtagtaatgtaactagcaatgataggcttggagaagagacaaatgcagtatctggaccagaagagttgtcagtgattagtggaaatggggaatgttcaaattcttcaggaacaggcaaaacttctatgccatctggtgatgaaagcattgatgaaaagttaggtctttcttacaaaagagaaagacccagccaggctcaaacagaagctttttgggagaataaacaaatggaaaataatttttataagcacaagtcaaaaacaaaacatcatagtgtggcagaagaagagaccctggagaaacatctgagaccaaagcaaaagcctaagaactctaagcattgcagagacgccaagtttgaaggaactcgaattccacacctggtgaagaaaaggcgttaccagaagcaagacagtgaaaacaagagtgaggccaaggaacagagcaatgacgattatgttttggaaaagcttttcaaaaaatcagttggcgtgcacagtgtcatgaagcacgatgccatcatggatggagccagcccagattatgtactggtggaggcagaagccaaccgagtggcccaggatgccctgaaagcactgaggctctctcgtcagcggtgtctgggagcagtgtctggtgttcccacctggactggccacagggggatttctggtgcaccagcaggaaaaaagagtagatttggtaagaaaaggaattctaacttctctgtgcagcatccttcatcaacatctccaacagagaagtgccaggatggcatcatgaaaaaggagggaaaagataatgtccctgagcattttagtggaagagcagaagatgcagactcttcatccgggcccctcgcttcctcctcactcttggctaaaatgagagctagaaaccacctgattctgccagagcgtttagaaagtgaaagcgggcacctgcaggaagcttctgccctgctgcccaccacagaacacgatgaccttctggtggagatgagaaacttcatcgctttccaggcccacactgatggccaggccagcaccagggagatactgcaggagtttgaatccaagttatctgcatcacagtcttgtgtcttccgagaactattgagaaatctgtgcactttccatagaacttctggtggtgaaggaatttggaaactcaagccagaatactgctaaacaacattgcttcctaaactttcaagt

SEQ ID NO: 1601 - DNA, 2017 bp, Homo sapiens
gtcatggcgacgtccagtgctccagccggtgtgaggacacgatatgctggggtttttgtccgcacgccaaacgggtttggaggaccctcttcgccttcggagagcagagtcaacacggagagttttgggactggaattaaataaagacagagatgttgaaagaatccacggcggtggaattaacacccttgacattgaacctgttgaagggagatacatgttatcaggtggttcagatggtgtgattgtactttatgaccttgagaactccagcagacaatcttattacacatgtaaagcagtgtgttccattggcagagatcatcctgatgttcacagatacagtgtggagactgtacagtggtatcctcatgacactggcatgttcacatcaagctcatttgataaaactctgaaagtatgggatacaaatacattacaaactgcagatgtatttaattttgaggaaacagtttatagtcatcatatgtctccagtctccaccaagcactgtttggtagcagttggtactagaggacccaaagtacaactttgtgacttgaagtctggatcctgttctcacattctacagggtcacagacaagaaatattagcagtttcctggtctccacgttatgactatatcttggcaacagcaagtgctgacagtagagtaaaattatgggatgtgagaagagcatcaggatgtttgattactcttgatcaacataatgggaaaaagtcacaagctgttgaatcagcaaacactgctcataatgggaaagttaatggcttatgttttacaagtgatggacttcacctcctcactgttggtacagataatcgaatgaggctctggaatagttccaatggagaaaacacacttgtgaactatggaaaagtttgtaataacagtaaaaaaggattgaaattcactgtctcctgtggctgcagttcagaatttgtttttgtaccatatggtagcaccattgctgtttatacagtttactcaggagaacagataactatgcttaagggacattataaaactgttgactgctgtgtatttcagtcaaatttccaggaactttatagtggtagcagagactgcaacattctggcttgggttccatccttatatgaaccagttcctgatgatgatgagactacaacaaaatcacaattaaatccggcctttgaagatgcctggagcagcagtgatgaagaaggatgaatatcatctttagtacctttttgtctctgctgaaactttttaaatgagactgtgtttttttcaactgtatggtctattcctgacagctaaattagccctaaatgtgggtaatatttttcctcatgttttaaaatgaggttaatatttgcataaaatcctaaaacagacttctgtatagtttatttagtcaaaatgtgttccttgatcccagatgttgtggcctgggaaagccctcattgctacagtacaagtaacacaagtcgttgtacctcagttgtgaccttcagcagattttatgaactataagatgcagtctcagaggatcagcaagtggaggccatcagtattgactttctcttacttgctgtactatcagcctgctcgtttccacctttaagaatgattttgccaagaatgattatatcaaaaatagtagttgaaatggtaacatcaaaattattttattctttcttcttcatgtattcacatttttcagtggtttcatttaattaaccatgctttatgttaaacattttggggctcaatgtctcctactatccaaaatgtgcatcacaggaggcttttaactttgtgaaaatcccatgtttgctttattttattttaatgtcagaaggcagtttgcgctaatgcttgaactctttttctgtgaaactcattaaggtatgaccaaatcctgcctcattaattcaagcagaaaatatcctggcagggaatctggcttaaacatgaaatgctgtaataaaatttctatgttattgtctc

SEQ ID NO: 1602 - DNA, 2236 bp, Homo sapiens
gtcatggcgacgtccagtgctccagccggtgtgaggacacgatatgctggggtttttgtccgcacgccaaacgggtttggaggaccctcttcgccttcggagagcagagtcaacacggagagttttgggactggaattaaataaagacagagatgttgaaagaatccacggcggtggaattaacacccttgacattgaacctgttgaagggagataaaatgaagcttcttatccaagatgctcaaggaaataaaatgtgagtcaaggattttatatccagccaaactgatttcagatacaaaaaggacggataaattgtcaacaacacaagaattcagagactgttgttctcattagccattccttaggaatcaaccagagaatgaaatcattcaaccagaatgacaagagagacagcaacttaaggattgacgcatgttatcaggtggttcagatggtgtgattgtactttatgaccttgagaactccagcagacaatcttattacacatgtaaagcagtgtgttccattggcagagatcatcctgatgttcacagatacagtgtggagactgtacagtggtatcctcatgacactggcatgttcacatcaagctcatttgataaaactctgaaagtatgggatacaaatacattacaaactgcagatgtatttaattttgaggaaacagtttatagtcatcatatgtctccagtctccaccaagcactgtttggtagcagttggtactagaggacccaaagtacaactttgtgacttgaagtctggatcctgttctcacattctacagggtcacagacaagaaatattagcagtttcctggtctccacgttatgactatatcttggcaacagcaagtgctgacagtagagtaaaattatgggatgtgagaagagcatcaggatgtttgattactcttgatcaacataatgggaaaaagtcacaagctgttgaatcagcaaacactgctcataatgggaaagttaatggcttatgttttacaagtgatggacttcacctcctcactgttggtacagataatcgaatgaggctctggaatagttccaatggagaaaacacacttgtgaactatggaaaagtttgtaataacagtaaaaaaggattgaaattcactgtctcctgtggctgcagttcagaatttgtttttgtaccatatggtagcaccattgctgtttatacagtttactcaggagaacagataactatgcttaagggacattataaaactgttgactgctgtgtatttcagtcaaatttccaggaactttatagtggtagcagagactgcaacattctggcttgggttccatccttatatgaaccagttcctgatgatgatgagactacaacaaaatcacaattaaatccggcctttgaagatgcctggagcagcagtgatgaagaaggatgaatatcatctttagtacctttttgtctctgctgaaactttttaaatgagactgtgtttttttcaactgtatggtctattcctgacagctaaattagccctaaatgtgggtaatatttttcctcatgttttaaaatgaggttaatatttgcataaaatcctaaaacagacttctgtatagtttatttagtcaaaatgtgttccttgatcccagatgttgtggcctgggaaagccctcattgctacagtacaagtaacacaagtcgttgtacctcagttgtgaccttcagcagattttatgaactataagatgcagtctcagaggatcagcaagtggaggccatcagtattgactttctcttacttgctgtactatcagcctgctcgtttccacctttaagaatgattttgccaagaatgattatatcaaaaatagtagttgaaatggtaacatcaaaattattttattctttcttcttcatgtattcacatttttcagtggtttcatttaattaaccatgctttatgttaaacattttggggctcaatgtctcctactatccaaaatgtgcatcacaggaggcttttaactttgtgaaaatcccatgtttgctttattttattttaatgtcagaaggcagtttgcgctaatgcttgaactctttttctgtgaaactcattaaggtatgaccaaatcctgcctcattaattcaagcagaaaatatcctggcagggaatctggcttaaacatgaaatgctgtaataaaatttctatgttattgtctcc

SEQ ID NO: 1603 - DNA, 1414 bp, Homo sapiens
gtcatggcgacgtccagtgctccagccggtgtgaggacacgatatgctggggtttttgtccgcacgccaaacgggtttggaggaccctcttcgccttcggagagcagagtcaacacggagagttttgggactggaattaacacccttgacattgaacctgttgaagggagatacatgttatcaggtggttcagatggtgtgattgtactttatgaccttgagaactccagcagacaatcttattacacatgtaaagcagtgtgttccattggcagagatcatcctgatgttcacagatacagtgtggagactgtacagtggtatcctcatgacactggcatgttcacatcaagctcatttgataaaactctgaaagtatgggatacaaatacattacaaactgcagatgtatttaattttgaggaaacagtttatagtcatcatatgtctccagtctccaccaagcactgtttggtagcagttggtactagaggacccaaagtacaactttgtgacttgaagtctggatcctgttctcacattctacagggtcacagacaagaaatattagcagtttcctggtctccacgttatgactatatcttggcaacagcaagtgctgacagtagagtaaaattatgggatgtgagaagagcatcaggatgtttgattactcttgatcaacataatgggaaaaagtcacaagctgttgaatcagcaaacactgctcataatgggaaagttaatggcttatgttttacaagtgatggacttcacctcctcactgttggtacagataatcgaatgaggctctggaatagttccaatggagaaaacacacttgtgaactatggaaaagtttgtaataacagtaaaaaaggattgaaattcactgtctcctgtggctgcagttcagaatttgtttttgtaccatatggtagcaccattgctgtttatacagtttactcaggagaacagataactatgcttaagggacattataaaactgttgactgctgtgtatttcagtcaaatttccaggaactttatagtggtagcagagactgcaacattctggcttgggttccatccttatatgaaccagttcctgatgatgatgagactacaacaaaatcacaattaaatccggcctttgaagatgcctggagcagcagtgatgaagaaggatgaatatcatctttagtacctttttgtctctgctgaaactttttaaatgagactgtgtttttttcaactgtatggtctattcctgacagctaaattagccctaaatgtgggtaatatttttcctcatgttttaaaatgaggttaatatttgcataaaatcctaaaacagacttctgtatagtttatttagtcaaaatgtgttccttgatcccagatgttgtggcct

SEQ ID NO: 1604 - DNA, 1554 bp, Homo sapiens
gagctctgtcatggcgacgtccagtgctccagccggtgtgaggacacgatatgctggggtttttgtccgcacgccaaacgggtttggaggaccctcttcgccttcggagagcagagtcaacacggagagttttgggactggaattaaataaagacagagatgttgaaagaatccacggcggtggaattaacacccttgacattgaacctgttgaagggagatacatgttatcaggtggttcagatggtgtgattgtactttatgaccttgagaactccagcagacaatcttattacacatgtaaagcagtgtgttccattggcagagatcatcctgatgttcacagatacagtgtggagactgtacagtggtatcctcatgacactggcatgttcacatcaagctcatttgataaaactctgaaagtatgggatacaaatacattacaattggtactagaggacccaaagtacaactttgtgacttgaagtctggatcctgttctcacattctacagggtcacagacaagaaatattagcagtttcctggtctccacgttatgactatatcttggcaacagcaagtgctgacagtagagtaaaattatgggatgtgagaagagcatcaggatgtttgattactcttgatcaacataatgggaaaaagtcacaagctgttgaatcagcaaacactgctcataatgggaaagttaatggcttatgttttacaagtgatggacttcacctcctcactgttggtacagataatcgaatgaggctctggaatagttccaatggagaaaacacacttgtgaactatggaaaagtttgtaataacagtaaaaaaggattgaaattcactgtctcctgtggctgcagttcagaatttgtttttgtaccatatggtagcaccattgctgtttatacagtttactcaggagaacagataactatgcttaagggacattataaaactgttgactgctgtgtatttcagtcaaatttccaggaactttatagtggtagcagagactgcaacattctggcttgggttccatccttatatgaaccagttcctgatgatgatgagactacaacaaaatcacaattaaatccggcctttgaagatgcctggagcagcagtgatgaagaaggatgaatatcatctttagtacctttttgtctctgctgaaactttttaaatgagactgtgtttttttcaactgtatggtctattcctgacagctaaattagccctaaatgtgggtaatatttttcctcatgttttaaaatgaggttaatatttgcataaaatcctaaaacagacttctgtatagtttatttagtcaaaatgtgttccttgatcccagatgttgtggcctgggaaagccctcattgctacagtacaagtaacacaagtcgttgtacctcagttgtgaccttcagcagattttatgaactataagatgcagtctcagaggatcagcaagtggaggccatcagtattgactttctcttacttgctgtactatcagcctgctcgtttccaccttt

SEQ ID NO: 1605 - DNA, 3190 bp, Homo sapiens
gcctaaggaaacgtgtcgtctggaatgggcttgggggccacgcctgcacatctccgcgagacagagggataaagtgaagatggtgctgttattgttacctcgagtgccacatgcgacctctgagatatgtacacagtcattcttactatcgcactcagccattcttactacgctaaagaagaaataattattcgaggatatttgcctggcccagaagaaacttatgtaaatttcatgaactattatatccgttttcctcggagtgagagaaaactctttttagatatcatctgagaggtagttaatttggcaccatggggatacagggattgctacaatttatcaaagaagcttcagaacccatccatgtgaggaagtataaagggcaggtagtagctgtggatacatattgctggcttcacaaaggagctattgcttgtgctgaaaaactagccaaaggtgaacctactgataggtatgtaggattttgtatgaaatttgtaaatatgttactatctcatgggatcaagcctattctcgtatttgatggatgtactttaccttctaaaaaggaagtagagagatctagaagagaaagacgacaagccaatcttcttaagggaaagcaacttcttcgtgaggggaaagtctcggaagctcgagagtgtttcacccggtctatcaatatcacacatgccatggcccacaaagtaattaaagctgcccggtctcagggggtagattgcctcgtggctccctatgaagctgatgcgcagttggcctatcttaacaaagcgggaattgtgcaagccataattacagaggactcggatctcctagcttttggctgtaaaaaggtaattttaaagatggaccagtttggaaatggacttgaaattgatcaagctcggctaggaatgtgcagacagcttggggatgtattcacggaagagaagtttcgttacatgtgtattctttcaggttgtgactacctgtcatcactgcgtgggattggattagcaaaggcatgcaaagtcctaagactagccaataatccagatatagtaaaggttatcaagaaaattggacattatctcaagatgaatatcacggtaccagaggattacatcaacgggtttattcgggccaacaataccttcctctatcagctagtttttgatcccatcaaaaggaaacttattcctctgaacgcctatgaagatgatgttgatcctgaaacactaagctacgctgggcaatatgttgatgattccatagctcttcaaatagcacttggaaataaagatataaatacttttgaacagatcgatgactacaatccagacactgctatgcctgcccattcaagaagtcatagttgggatgacaaaacatgtcaaaagtcagctaatgttagcagcatttggcataggaattactctcccagaccagagtcgggtactgtttcagatgccccacaattgaaggaaaatccaagtactgtgggagtggaacgagtgattagtactaaagggttaaatctcccaaggaaatcatccattgtgaaaagaccaagaagtgcagagctgtcagaagatgacctgttgagtcagtattctctttcatttacgaagaagaccaagaaaaatagctctgaaggcaataaatcattgagcttttctgaagtgtttgtgcctgacctggtaaatggacctactaacaaaaagagtgtaagcactccacctaggacgagaaataaatttgcaacatttttacaaaggaaaaatgaagaaagtggtgcagttgtggttccagggaccagaagcaggtttttttgcagttcagattctactgactgtgtatcaaacaaagtgagcatccagcctctggatgaaactgctgtcacagataaagagaacaatctgcatgaatcagagtatggagaccaagaaggcaagagactggttgacacagatgtagcacgtaattcaagtgatgacattccgaataatcatattccaggtgatcatattccagacaaggcaacagtgtttacagatgaagagtcctactcttttgagagcagcaaatttacaaggaccatttcaccacccactttgggaacactaagaagttgttttagttggtctggaggtcttggagatttttcaagaacgccgagcccctctccaagcacagcattgcagcagttccgaagaaagagcgattcccccacctctttgcctgagaataatatgtctgatgtgtcgcagttaaagagcgaggagtccagtgacgatgagtctcatcccttacgagaagaggcatgttcttcacagtcccaggaaagtggagaattctcactgcagagttcaaatgcatcaaagctttctcagtgctctagtaaggactctgattcagaggaatctgattgcaatattaagttacttgacagtcaaagtgaccagacctccaagctacgtttatctcatttctcaaaaaaagacacacctctaaggaacaaggttcctgggctatataagtccagttctgcagactctctttctacaaccaagatcaaacctctaggacctgccagagccagtgggctgagcaagaagccggcaagcatccagaagagaaagcatcataatgccgagaacaagccggggttacagatcaaactcaatgagctctggaaaaactttggatttaaaaaagattctgaaaagcttcctccttgtaagaaacccctgtccccagtcagagataacatccaactaactccagaagcggaagaggatatatttaacaaacctgaatgtggccgtgttcaaagagcaatattccagtaaatgcagactgctgcaaagcttttgcctgcaagagaatctgatcaatttgaagtccctgtttgggaatgaggcacttatcagcatgaagaattttttctcattctgtgccattttaaaaatagaatacattttgtatattaactttataattgggttgtggtttttttgctcagctttttatatttttataagaagctaaatagaagaataattgtatctctgacaggtttttggaggttttagtgttaattgggaaaatcctctggagtttataaaagtctactctaaatatttctgtaatgttgtcaagtagaaagatagtaaatggagaaact

SEQ ID NO: 1606 - DNA, 3070 bp, Homo sapiens
gcctaaggaaacgtgtcgtctggaatgggcttgggggccacgcctgcacatctccgcgagacagagggataaagtgaagatggtgctgttattgttacctcgagtgccacatgcgacctctgagatatgtacacagtcattcttactatcgcactcagccattcttactacgctaaagaagaaataattattcgaggatatttgcctggcccagaagaaacttatgtaaatttcatgaactattatatccgttttcctcggagtgagagaaaactctttttagatatcatctgagaggtagttaatttggcaccatggggatacagggattgctacaatttatcaaagaagcttcagaacccatccatgtgaggaagtataaagggcaggtagtagctgtggatacatattgctggcttcacaaaggagctattgcttgtgctgaaaaactagccaaaggtgaacctactgatagaagacgacaagccaatcttcttaagggaaagcaacttcttcgtgaggggaaagtctcggaagctcgagagtgtttcacccggtctatcaatatcacacatgccatggcccacaaagtaattaaagctgcccggtctcagggggtagattgcctcgtggctccctatgaagctgatgcgcagttggcctatcttaacaaagcgggaattgtgcaagccataattacagaggactcggatctcctagcttttggctgtaaaaaggtaattttaaagatggaccagtttggaaatggacttgaaattgatcaagctcggctaggaatgtgcagacagcttggggatgtattcacggaagagaagtttcgttacatgtgtattctttcaggttgtgactacctgtcatcactgcgtgggattggattagcaaaggcatgcaaagtcctaagactagccaataatccagatatagtaaaggttatcaagaaaattggacattatctcaagatgaatatcacggtaccagaggattacatcaacgggtttattcgggccaacaataccttcctctatcagctagtttttgatcccatcaaaaggaaacttattcctctgaacgcctatgaagatgatgttgatcctgaaacactaagctacgctgggcaatatgttgatgattccatagctcttcaaatagcacttggaaataaagatataaatacttttgaacagatcgatgactacaatccagacactgctatgcctgcccattcaagaagtcatagttgggatgacaaaacatgtcaaaagtcagctaatgttagcagcatttggcataggaattactctcccagaccagagtcgggtactgtttcagatgccccacaattgaaggaaaatccaagtactgtgggagtggaacgagtgattagtactaaagggttaaatctcccaaggaaatcatccattgtgaaaagaccaagaagtgcagagctgtcagaagatgacctgttgagtcagtattctctttcatttacgaagaagaccaagaaaaatagctctgaaggcaataaatcattgagcttttctgaagtgtttgtgcctgacctggtaaatggacctactaacaaaaagagtgtaagcactccacctaggacgagaaataaatttgcaacatttttacaaaggaaaaatgaagaaagtggtgcagttgtggttccagggaccagaagcaggtttttttgcagttcagattctactgactgtgtatcaaacaaagtgagcatccagcctctggatgaaactgctgtcacagataaagagaacaatctgcatgaatcagagtatggagaccaagaaggcaagagactggttgacacagatgtagcacgtaattcaagtgatgacattccgaataatcatattccaggtgatcatattccagacaaggcaacagtgtttacagatgaagagtcctactcttttgagagcagcaaatttacaaggaccatttcaccacccactttgggaacactaagaagttgttttagttggtctggaggtcttggagatttttcaagaacgccgagcccctctccaagcacagcattgcagcagttccgaagaaagagcgattcccccacctctttgcctgagaataatatgtctgatgtgtcgcagttaaagagcgaggagtccagtgacgatgagtctcatcccttacgagaagaggcatgttcttcacagtcccaggaaagtggagaattctcactgcagagttcaaatgcatcaaagctttctcagtgctctagtaaggactctgattcagaggaatctgattgcaatattaagttacttgacagtcaaagtgaccagacctccaagctacgtttatctcatttctcaaaaaaagacacacctctaaggaacaaggttcctgggctatataagtccagttctgcagactctctttctacaaccaagatcaaacctctaggacctgccagagccagtgggctgagcaagaagccggcaagcatccagaagagaaagcatcataatgccgagaacaagccggggttacagatcaaactcaatgagctctggaaaaactttggatttaaaaaagattctgaaaagcttcctccttgtaagaaacccctgtccccagtcagagataacatccaactaactccagaagcggaagaggatatatttaacaaacctgaatgtggccgtgttcaaagagcaatattccagtaaatgcagactgctgcaaagcttttgcctgcaagagaatctgatcaatttgaagtccctgtttgggaatgaggcacttatcagcatgaagaattttttctcattctgtgccattttaaaaatagaatacattttgtatattaactttataattgggttgtggtttttttgctcagctttttatatttttataagaagctaaatagaagaataattgtatctctgacaggtttttggaggttttagtgttaattgggaaaatcctctggagtttataaaagtctactctaaatatttctgtaatgttgtcaagtagaaagatagtaaatggagaaact

SEQ ID NO: 1607 - DNA, 3473 bp, Homo sapiens
ggaacccgcgcaaattgaaaggtcagcctttcgcgcgctgtgtaggcaagttacccgtgttctgcgttgccggccgtgggtgctctggccacagtgagttaggggcgtcggagcgggtttctccaaccgcaatcggctccgctcaaggggaggaggagagtcccttctcggaaggcctaaggaaacgtgtcgtctggaatgggcttgggggccacgcctgcacatctccgcgagacagagggataaagtgaagatggtgctgttattgttacctcgagtgccacatgcgacctctgagatatgtacacagtcattcttactatcgcactcagccattcttactacgctaaagaagaaataattattcgaggatatttgcctggcccagaagaaacttatgtaaatttcatgaactattatatccgttttcctcggagtgagagaaaactctttttagatatcatctgagagaactagtgaatcccagtcactgagtggagttgagagtctaagaacctctgaaatttgagaactgctggaccagagcctttagagctctgataaggtgtcaacagggtagttaatttggcaccatggggatacagggattgctacaatttatcaaagaagcttcagaacccatccatgtgaggaagtataaagggcaggtagtagctgtggatacatattgctggcttcacaaaggagctattgcttgtgctgaaaaactagccaaaggtgaacctactgataggtatgtaggattttgtatgaaatttgtaaatatgttactatctcatgggatcaagcctattctcgtatttgatggatgtactttaccttctaaaaaggaagtagagagatctagaagagaaagacgacaagccaatcttcttaagggaaagcaacttcttcgtgaggggaaagtctcggaagctcgagagtgtttcacccggtctatcaatatcacacatgccatggcccacaaagtaattaaagctgcccggtctcagggggtagattgcctcgtggctccctatgaagctgatgcgcagttggcctatcttaacaaagcgggaattgtgcaagccataattacagaggactcggatctcctagcttttggctgtaaaaaggtaattttaaagatggaccagtttggaaatggacttgaaattgatcaagctcggctaggaatgtgcagacagcttggggatgtattcacggaagagaagtttcgttacatgtgtattctttcaggttgtgactacctgtcatcactgcgtgggattggattagcaaaggcatgcaaagtcctaagactagccaataatccagatatagtaaaggttatcaagaaaattggacattatctcaagatgaatatcacggtaccagaggattacatcaacgggtttattcgggccaacaataccttcctctatcagctagtttttgatcccatcaaaaggaaacttattcctctgaacgcctatgaagatgatgttgatcctgaaacactaagctacgctgggcaatatgttgatgattccatagctcttcaaatagcacttggaaataaagatataaatacttttgaacagatcgatgactacaatccagacactgctatgcctgcccattcaagaagtcatagttgggatgacaaaacatgtcaaaagtcagctaatgttagcagcatttggcataggaattactctcccagaccagagtcgggtactgtttcagatgccccacaattgaaggaaaatccaagtactgtgggagtggaacgagtgattagtactaaagggttaaatctcccaaggaaatcatccattgtgaaaagaccaagaagtgcagagctgtcagaagatgacctgttgagtcagtattctctttcatttacgaagaagaccaagaaaaatagctctgaaggcaataaatcattgagcttttctgaagtgtttgtgcctgacctggtaaatggacctactaacaaaaagagtgtaagcactccacctaggacgagaaataaatttgcaacatttttacaaaggaaaaatgaagaaagtggtgcagttgtggttccagggaccagaagcaggtttttttgcagttcagattctactgactgtgtatcaaacaaagtgagcatccagcctctggatgaaactgctgtcacagataaagagaacaatctgcatgaatcagagtatggagaccaagaaggcaagagactggttgacacagatgtagcacgtaattcaagtgatgacattccgaataatcatattccaggtgatcatattccagacaaggcaacagtgtttacagatgaagagtcctactcttttgagagcagcaaatttacaaggaccatttcaccacccactttgggaacactaagaagttgttttagttggtctggaggtcttggagatttttcaagaacgccgagcccctctccaagcacagcattgcagcagttccgaagaaagagcgattcccccacctctttgcctgagaataatatgtctgatgtgtcgcagttaaagagcgaggagtccagtgacgatgagtctcatcccttacgagaagaggcatgttcttcacagtcccaggaaagtggagaattctcactgcagagttcaaatgcatcaaagctttctcagtgctctagtaaggactctgattcagaggaatctgattgcaatattaagttacttgacagtcaaagtgaccagacctccaagctacgtttatctcatttctcaaaaaaagacacacctctaaggaacaaggttcctgggctatataagtccagttctgcagactctctttctacaaccaagatcaaacctctaggacctgccagagccagtgggctgagcaagaagccggcaagcatccagaagagaaagcatcataatgccgagaacaagccggggttacagatcaaactcaatgagctctggaaaaactttggatttaaaaaagattctgaaaagcttcctccttgtaagaaacccctgtccccagtcagagataacatccaactaactccagaagcggaagaggatatatttaacaaacctgaatgtggccgtgttcaaagagcaatattccagtaaatgcagactgctgcaaagcttttgcctgcaagagaatctgatcaatttgaagtccctgtttgggaatgaggcacttatcagcatgaagaattttttctcattctgtgccattttaaaaatagaatacattttgtatattaactttataattgggttgtggtttttttgctcagctttttatatttttataagaagctaaatagaagaataattgtatctctgacaggtttttggaggttttagtgttaattgggaaaatcctctggagtttataaaagtctactctaaatatttctgtaatgttgtcaagtagaaagatagtaaatggagaaactacaa

SEQ ID NO: 1608 - DNA, 607 bp, Homo sapiens
cttatgtaaatttcatgaactattatatccgttttcctcggagtgagagaaaactctttttagatatcatctgagagcagaactagtgaatcccagtcactgagtggagttgagagtctaagaacctctgaaatttgagaactgctggaccagagcctttagagctctgataaggtgtcaacagggtagttaatttggcaccatggggatacagggattgctacaatttatcaaagaagcttcagaacccatccatgtgaggaagtataaagggcaggtagtagctgtggatacatattgctggcttcacaaaggagctattgcttgtgctgaaaaactagccaaaggtgaacctactgataggtatgtaggattttgtatgaaatttgtaaatatgttactatctcatgggatcaagcctattctcgtatttgatggatgtactttaccttctaaaaaggaagtagagagatctagaagagaaagacgacaagccaatcttcttaagggaaagcaacttcttcgtgaggggaaagtctcggaagctcgagagtgtttcacccggtctatcaatatcacacatgccatggcccacaaagtaattaaa

SEQ ID NO: 1609 - DNA, 2899 bp, Homo sapiens
cgagtgccacatgcgacctctgagatatgtacacagtcattcttactatcgcactcagccattcttactacgctaaagaagaaataattattcgaggatatttgcctggcccagaagaaacttatgtaaatttcatgaactattatatccgttttcctcggagtgagagaaaactctttttagatatcatctgagaggtagttaatttggcaccatggggatacagggattgctacaatttatcaaagaagcttcagaacccatccatgtgaggaagtataaagggcaggtagtagctgtggatacatattgctggcttcacaaaggagctattgcttgtgctgaaaaactagccaaaggtgaacctactgataggtatgtaggattttgtatgaaatttgtaaatatgttactatctcatgggatcaagcctattctcgtatttgatggatgtactttaccttctaaaaaggaagtagagagatctagaagagaaagacgacaagccaatcttcttaagggaaagcaacttcttcgtgaggggaaagtctcggaagctcgagagtgtttcacccggtctatcaatatcacacatgccatggcccacaaagtaattaaagctgcccggtctcagggggtagattgcctcgtggctccctatgaagctgatgcgcagttggcctatcttaacaaagcgggaattgtgcaagccataattacagaggactcggatctcctagcttttggctgtaaaaaggtaattttaaagatggaccagtttggaaatggacttgaaattgatcaagctcggctaggaatgtgcagacagcttggggatgtattcacggaagagaagtttcgttacatgtgtattctttcaggttgtgactacctgtcatcactgcgtgggattggattagcaaaggcatgcaaagtcctaagactagccaataatccagatatagtaaaggttatcaagaaaattggacattatctcaagatgaatatcacggtaccagaggattacatcaacgggtttattcgggccaacaataccttcctctatcagctagtttttgatcccatcaaaaggaaacttattcctctgaacgcctatgaagatgatgttgatcctgaaacactaagctacgctgggcaatatgttgatgattccatagctcttcaaatagcacttggaaataaagatataaatacttttgaacagatcgatgactacaatccagacactgctatgcctgcccattcaagaagtcatagttgggatgacaaaacatgtcaaaagtcagctaatgttagcagcatttggcataggaattactctcccagaccagagtcgggtactgtttcagatgccccacaattgaaggaaaatccaagtactgtgggagtggaacgagtgattagtactaaagggttaaatctcccaaggaaatcatccattgtgaaaagaccaagaagtgcagagctgtcagaagatgacctgttgagtcagtattctctttcatttacgaagaagaccaagaaaaatagctctgaaggcaataaatcattgagcttttctgaagtgtttgtgcctgacctggtaaatggacctactaacaaaaagagtgtaagcactccacctaggacgagaaataaatttgcaacatttttacaaaggaaaaatgaagaaagtggtgcagttgtggttccagggaccagaagcaggtttttttgcagttcagattctactgactgtgtatcaaacaaagtgagcatccagcctctggatgaaactgctgtcacagataaagagaacaatctgcatgaatcagagtatggagaccaagaaggcaagagactggttgacacagatgtagcacgtaattcaagtgatgacattccgaataatcatattccaggtgatcatattccagacaaggcaacagtgtttacagatgaagagtcctactcttttgagagcagcaaatttacaaggaccatttcaccacccactttgggaacactaagaagttgttttagttggtctggaggtcttggagatttttcaagaacgccgagcccctctccaagcacagcattgcagcagttccgaagaaagagcgattcccccacctctttgcctgagaataatatgtctgatgtgtcgcagttaaagagcgaggagtccagtgacgatgagtctcatcccttacgagaagaggcatgttcttcacagtcccaggaaagtggagaattctcactgcagagttcaaatgcatcaaagctttctcagtgctctagtaaggactctgattcagaggaatctgattgcaatattaagttacttgacagtcaaagtgaccagacctccaagctacgtttatctcatttctcaaaaaaagacacacctctaaggaacaaggttcctgggctatataagtccagttctgcagactctctttctacaaccaagatcaaacctctaggacctgccagagccagtgggctgagcaagaagccggcaagcatccagaagagaaagcatcataatgccgagaacaagccggggttacagatcaaactcaatgagctctggaaaaactttggatttaaaaaattctgaaaagcttcctccttgtaagaaacccctgtccccagtcagagataacatccaactaactccagaagcggaagaggatatatttaacaaacctgaatgtggccgtgttcaaagagcaatattccagtaaatgcagactgctgcaaagcttttgcctgcaagagaatctgatcaatttgaagtccctgtttgggaatgaggcacttatcagcatgaagaattttttctcattctgtgccattttaaaaatagaatacattttgtatattaacttta

SEQ ID NO: 1610 - DNA, 583 bp, Homo sapiens
accatcggccatcagcgccagtgccactcgcgccctcaagaagccgcacggagttcgggccggcagcagcggctgcagtcgtatggcagtgagccgctgtctacccagcgagacggagagctcaggacgcaaccctatgagttggaagccgcaggaggcggaaccgggttgcgggatacgcgttgacgtcacatcctctgggcggggccgcaaggaacccgcgcaaattgaaaggcctaaggaaacgtgtcgtctggaatgggcttgggggccacgcctgcacatctccgcgagacagagggataaagtgaagatggtgctgttattgttacctcgagtgccacatgcgacctctgagatatgtacacagtcattcttactatcgcactcagccattcttactacgctaaagaagaaataattattcgaggatatttgcctggcccagaagaaacttatgtaaatttcatgaactattatatccgttttcctcggagtgagagaaaactctttttagatatcatctgagaggtagttaatttggcaccatggggatacagggattgctacaatttatcaaaga

SEQ ID NO: 1611 - DNA, 8270 bp, Homo sapiens
gtgtaagtgtaacattcagaaccgggtaacattcggcgaccgaacgcggcggtcggcagcgttcgcgcgggggcctgcgaagcgctgctcggggccggcactgcccgcggggaggacgcgccgccgccgccacccagcgccgccgccgccgccgcctccagccgggccgccgcgcgtcccgggggccggccccgcgagcgcaggagtaaacaccgccggagtcttggagccgctgcagaagggaataaagagagatgcagggatttgtgaggttacggcgccccagctgcaagatgcactagccggctgaacccgggatcggctgacttgttggaaccggagtgctctgcacggagagtggtggatgagttgaagttgccttcccggggctcattttccacgctgccgagaggaatccgagaggcaaggcaatcacttcgtcttgccattgattgggtatcgggagctttttttttctcccctctctctttcttttcctccgtcttgttgcatgcaagaaaattacagtccgctgctcgcccgccctgggtgcgagatattcagccccgctctctcccgtgcattgtgcaacccaaagatgaaagaccgaaggggagaaagttaaagaaatcgcccacatgcgctggatcagtccacggcttggggaaaggcatccagagaaggtgggagcggagagtttgaagtctttacaggcgggaagatggcggactggagctgaaagtgttgattgggaaacttgggtgattcttgtgtttatttacaatcctcttgacccaggcaggacacatgcaggccaaaaaacgctatttcatcctgctctcagctggctcttgtctcgcccttttgttttatttcggaggcttgcagtttagggcatcgaggagccacagccggagagaagaacacagcggtaggaatggcttgcaccaccccagtccggatcatttctggccccgcttcccggacgctctgcgccccttcgttccttgggatcaattggaaaacgaggattccagcgtgcacatttccccccggcagaagcgagatgccaactccagcatctacaaaggcaagaagtgccgcatggagtcctgcttcgatttcaccctttgcaagaaaaacggcttcaaagtctacgtatacccacagcaaaaaggggagaaaatcgccgaaagttaccaaaacattctagcggccatcgagggctccaggttctacacctcggaccccagccaggcgtgcctctttgtcctgagtctggatactttagacagagaccagttgtcacctcagtatgtgcacaatttgagatccaaagtgcagagtctccacttgtggaacaatggtaggaatcatttaatttttaatttatattccggcacttggcctgactacaccgaggacgtggggtttgacatcggccaggcgatgctggccaaagccagcatcagtactgaaaacttccgacccaactttgatgtttctattcccctcttttctaaggatcatcccaggacaggaggggagagggggtttttgaagttcaacaccatccctcctctcaggaagtacatgctggtattcaaggggaagaggtacctgacagggataggatcagacaccaggaatgccttatatcacgtccataacggggaggacgttgtgctcctcaccacctgcaagcatggcaaagactggcaaaagcacaaggattctcgctgtgacagagacaacaccgagtatgagaagtatgattatcgggaaatgctgcacaatgccactttctgtctggttcctcgtggtcgcaggcttgggtccttcagattcctggaggctttgcaggctgcctgcgtccctgtgatgctcagcaatggatgggagttgccattctctgaagtgattaattggaaccaagctgccgtcataggcgatgagagattgttattacagattccttctacaatcaggtctattcatcaggataaaatcctagcacttagacagcagacacaattcttgtgggaggcttatttttcttcagttgagaagattgtattaactacactagagattattcaggacagaatattcaagcacatatcacgtaacagtttaatatggaacaaacatcctggaggattgttcgtactaccacagtattcatcttatctgggagattttccttactactatgctaatttaggtttaaagcccccctccaaattcactgcagtcatccatgcggtgacccccctggtctctcagtcccagccagtgttgaagcttctcgtggctgcagccaagtcccagtactgtgcccagatcatagttctatggaattgtgacaagcccctaccagccaaacaccgctggcctgccactgctgtgcctgtcgtcgtcattgaaggagagagcaaggttatgagcagccgttttctgccctacgacaacatcatcacagacgccgtgctcagccttgacgaggacacggtgctttcaacaacagaggtggatttcgccttcacagtgtggcagagcttccctgagaggattgtggggtaccccgcgcgcagccacttctgggataactctaaggagcggtggggatacacatcaaagtggacgaacgactactccatggtgttgacaggagctgctatttaccacaaatattatcactacctatactcccattacctgccagccagcctgaagaacatggtggaccaattggccaattgtgaggacattctcatgaacttcctggtgtctgctgtgacaaaattgcctccaatcaaagtgacccagaagaagcagtataaggagacaatgatgggacagacttctcgggcttcccgttgggctgaccctgaccactttgcccagcgacagagctgcatgaatacgtttgccagctggtttggctacatgccgctgatccactctcagatgaggctcgaccccgtcctctttaaagaccaggtctctattttgaggaagaaataccgagacattgagcgactttgaggaatccggctgagtgggggaggggaagcaagaagggatgggggtcaagctgctctctcttcccagtgcagatccactcatcagcagagccagattgtgccaactatccaaaaacttagatgagcagaatgacaaaaaaaaaaaggccaatgagaactcaactcctggctcctgggactgcaccagactgctccaaactcacctcactggcttctgtgtcccaagactaggttgtgtacagtttaattatggaacattaaataattatttttgaaatgattgctatgcaggtttaaacttttttaatgatcaaaactattaaaaaccagagttctttgtttaatcaaaattgtgttggttgtgaatatttcaaagctgctattccttttcccacagacatcattgtcatggccatgtagggtgccctgcagtttcaaaagctcaaacttcgtggaaaacacaataagtcactctacccattatcaagaaataactgagcataagttgtaacttcattattcaactttgccagtgcaaattgttttccacttcgaatcttcaaatccacttgaacttttatctctaaaatgtcgctgcatgaaagaaagtattacgacttccaggtaggcagttctaactgaaatctctatgtttgagatagatatatatgataatcgtttttcattgggggggtggggggaattagtaccaagaaaacactagtataattaagaaatgttcagtttgcacaaagaactatccagataacccaccagcatgttagtgagatggaaatacagacccacaacagtaacccaatacttgcaggggttgggggcacggttatagattcaaccattgacctaagtctgcgtagcactgggaagaggctttggtttagaagccaaggaataatgagtatattggggagaacagattatttacaagatgaactctttaatgtttgtgagaatctcaagtttcagagtttctcttttgagaaagaaaaaggggtaataaggtagaaattcacaccaatgaacaagaggattgctgcaaagtaactgaggagatgtctcgccattgggaccctaatgccatttttggtcaaacattgttttgagcaagaatctggcaaacaaaataatcaacaacaaatgtgaatatagtttcatttacttttaatttttaaatctgtggaaaagtttagttgtgcttcttgttaaaaagaacatttctatccctgaaaatgctatcttgggcttatgattattgttaaactccaagtataaactgaaaaaaaaaacatatccctaactctgttatgaaaaatggagacttctgatattaaatgctttcttctacttggaagaggccagagaaaacagggaagagaaagacattattgagtttgaccatgtattatgctgaataaacaataagcactttagagtccctccctcaaactctcatacatttcatatttcttttccatttattttcagttttgttttagaagaaaagttcatcagagaattttgttctgataatttcaagtggccatcttaggtcagtggaaaccgtaagtccattggactttacctcatcctttctttgtagacatctgggagaggaagaggagcttgtaatgatagcacggggatggtgctgtaaacaggagtgaaagtgtttgtggaagtccagagaagtgactcaacaggctacctagctgcagaacaaggagtagagcccacatatccagatggtgttttgagaggtgcgtagacagtgaaattcaattaaagagaggattttctcctcagcctcatgactcagaacagctccctaaatacctctctcatctaattggacccatccatagtccattctcaaacatgtgacattttcccctaagtagatgtgattatctcttaggcatttgttgaaaaataattcttaggtccatggtgcttgcacttgtgtcttttctataaaatgtttggtcttacaggtttcatgtcatttaagctgcacttctcagcaagttaaaagattagcagttaatctttattcatttggcctttgtgaatttgtatttaaattatttttttcaggattggcaaattattcttgtttctcctttaccaaaaaataaatgcgatattttgttcaatgaccccaaaaccaacttgaaacttaggtggtcatattggcttgcaaagcaatgtccctaattgtaccagtcagtcacacaagtggattcaaggacctgctttgccagattgacctgtcaccaagctcacaacacatatcctccacaaacaacatgtgttatgtgaagaaaaatggtaattataaataagaacaggatataacacacctttcatccactttaaatctccacagtttcattttatgtcattctctgagcaaatctctttgggatgtgagctagcgtgttcttctcccatttggaatataaggctgggaatagaacaatgcttaacaaatcagtgaagctcgacagtaatatgtaattttaattcagttaggaaagagttgtattgcattgcaacaagttgacaaatcatagccatctctgtagggtgtcaggaattatctcctggtcaactttaatgataactaggggtccctaagtgggctaacatgtgctgcattggagagaagccaagggctgagagtacagtgccaaccacgtaatgaattgcttgcagaaattccaaagaggactcagccacttatggatttccacacagcatcttttcccagctccacattaagacacaggatcttaaaagtaattttttaaaagctggctgtgtatttatttatatgaaagtgttataaatatcaaagcttacaaatacattaatacatatcacctttgttgaagctagcaaaatggctcaaaattgagactgtagagaaaaatccatgaaataatcacgatagtcataccacaaaagatagcatagctaggtgggcctacctggtcgtatcaacacactttcagatagatgcttcaaaaaaaaagggaaagcttgttactggaatcttatgtgcattacagtttaatttcttcttgtgacaaatggtgctcaaagaaggatcaatccggttgcatccttcaatttcccttttagaatgacttttggttttcattacagtaggctatgttagcctttattttggtggttctcaaatacctggtgacttgaaagagtattatgctggtggcctttcataaaggttactgaactttaatcaggggtgagatgaatgaatgtgaataggcctatatactattttttttaattaaaaaaaaaaaaaacagggcacttgatttaagaacaaacctgtttaaagggcaggatcagggggaagacagccttactaggttggaatctgaatgagattcttgctggacaaggctgaattatggatgcaaaagccaagcaaacttcccagacctggaagtgtcttgtgttcccttgggtctcttgagatctccagtatttaaaagtagcagttattgccatgaactctcaaataaaaatgctcctgcctcttacttgtgaatataatcaacatgcagccagtacatcaggaccgcagttgctgaattcatttacctagttcccctttacagcgactatggacaagaacctttcagttggttttgtcattcttggccagatttaaccaagaaatttctttcactatcagcctcattttctcaggcatgcttacagggacaaagttgttttgagttgagttctcagcaaataagcattaatatcaaactgtgctaaacttgtctcacttggtataagaacttcagcataaagagattagtttatcctttgacaccaagtcttttttttttctttgagacagagtcttgccctgtcacccaggctggaatgcattggtgtgatctcagctcagtcactgcaacctccgcctccccggttcaagcaattctcctgcctcaccctgcttagtagttgggattacaggcatgtgctaccacactgggctaatttttgtatatttattagagacagggttttgctatgttggccaggctggtctcaaactcctgacctcaggtgatccacctgcctctgcctcccaaagtgctgagattacaggtgtaagccactgcgcctggccccccttttttttttctttaaaaaaaaaaaaaagcttgggggattaagtaccctaagatagtggtctctcccatcagttcaataatgctgtacagaacctctggataaaaaagctgttatttacaccataattgtgatgatggatttgactcctcaaaaccatctctcccctttttgccctttccaaaaatcaaaggcttttgtctccatgagttttacctagtagggattgtagttgtcactggtctagagttccaatacattttatatcaggaacctcagtgagctacccagaattggaacttaacatggcccagcaactaggagaagaaggcaaaccttgagaaagctgagccctcaggatagcacagtctcacccttgtttaaaatcaagtcaggctagcctttcagtcactctggttttgtaatgatttgccttttaggcctcaggccatttgatttctgcaatagttttctgttcttctcctacaggaatacatccctgtcctttcggttgtaactattactaaaactagggctatgcaaatgacctggttaccatgtaatgaaccttgtgtacttattttgagagaacaatatgtataggatatgttgaggggcagaaagaaagacatcaaaaactggaactattttaggtggcaaattgtaacgcaaaaaacaaaagtataccttattttgtatacgatgtacacttgggacagagttttctaatatgttgccaatgtttttgtagtgtcaccacaggtcttttctgaagtgtttttcccatttgttatagagtattaatgacttagcgtaattaagccctcaagtatgtgtgagagagcgcgtgtgagaaaatacaaagccatagatattgatttacttcactgacctgtgtaactttatgtctgggtttcgccatccaagatagattgttttatagagagtgtcaccaaagactttttccttccaatttatagaagaaaaaaaaaagaaattattaataaatgacatgacttttca

SEQ ID NO: 1612 - DNA, 3424 bp, Homo sapiens
agccacagggatctgattcctcccagggggatgtcctgcgcctcagggtccggtggtggcctgcggcatcccttgcggtgccagaagccgtgggacgaggagtgtgaggaagaggctgtctgtgtcattatgtgtgcgtcggtcaagtataatatccggggtcctgccctcatcccaagaatgaagaccaagcaccgaatctactatatcaccctcttctccattgtcctcctgggcctcattgccactggcatgtttcagttttggccccattctatcgagtcctcaaatgactggaatgtagagaagcgcagcatccgtgatgtgccggttgttaggctgccagccgacagtcccatcccagagcggggggatctcagttgcagaatgcacacgtgttttgatgtctatcgctgtggcttcaacccaaagaacaaaatcaaggtgtatatctatgctctgaaaaagtacgtggatgactttggcgtctctgtcagcaacaccatctcccgggagtataatgaactgctcatggccatctcagacagtgactactacactgatgacatcaaccgggcctgtctgtttgttccctccatcgatgtgcttaaccagaacacactgcgcatcaaggagacagcacaagcgatggcccagctctctaggtgggatcgaggtacgaatcacctgttgttcaacatgttgcctggaggtcccccagattataacacagccctggatgtccccagagacagggccctgttggctggtggcggcttttctacgtggacttaccggcaaggctacgatgtcagcattcctgtctatagtccactgtcagctgaggtggatcttccagagaaaggaccaggtccacggcaatacttcctcctgtcatctcaggtgggtctccatcctgagtacagagaggacctagaagccctccaggtcaaacatggagagtcagtgttagtactcgataaatgcaccaacctctcagagggtgtcctttctgtccgtaagcgctgccacaagcaccaggtcttcgattacccacaggtgctacaggaggctactttctgtgtggttcttcgtggagctcggctgggccaggcagtattgagcgatgtgttacaagctggctgtgtcccggttgtcattgcagactcctatattttgcctttctctgaagttcttgactggaagagagcatctgtggttgtaccagaagaaaagatgtcagatgtgtacagtattttgcagagcatcccccaaagacagattgaagaaatgcagagacaggcccggtggttctgggaagcgtacttccagtcaattaaagccattgccctggccaccctgcagattatcaatgaccggatctatccatatgctgccatctcctatgaagaatggaatgaccctcctgctgtgaagtggggcagcgtgagcaatccactcttcctcccgctgatcccaccacagtctcaagggttcaccgccatagtcctcacctacgaccgagtagagagcctcttccgggtcatcactgaagtgtccaaggtgcccagtctatccaaactacttgtcgtctggaataatcagaataaaaaccctccagaagattctctctggcccaaaatccgggttccattaaaagttgtgaggactgctgaaaacaagttaagtaaccgtttcttcccttatgatgaaatcgagacagaagctgttctggccattgatgatgatatcattatgctgacctctgacgagctgcaatttggttatgaggtctggcgggaatttcctgaccggttggtgggttacccgggtcgtctgcatctctgggaccatgagatgaataagtggaagtatgagtctgagtggacgaatgaagtgtccatggtgctcactggggcagctttttatcacaagtattttaattacctgtatacctacaaaatgcctggggatatcaagaactgggtagatgctcatatgaactgtgaagatattgccatgaacttcctggtggccaacgtcacgggaaaagcagttatcaaggtaaccccacgaaagaaattcaagtgtcctgagtgcacagccatagatgggctttcactagaccaaacacacatggtggagaggtcagagtgcatcaacaagtttgcttcagtcttcgggaccatgcctctcaaggtggtggaacaccgagctgaccctgtcctgtacaaagatgactttcctgagaagctgaagagcttccccaacattggcagcttatgaaacgtgtcattggtggaggtctgaatgtgaggctgggacagagggagagaacaaggcctcccagcactctgatgtcagagtagtaggttaagggtggaaggttgacctacttggatcttggcatgcacccacctaacccactttctcaagaacaagaacctagaatgaatatccaagcacctcgagctatgcaacctctgttcttgtatttcttatgatctctgatgggttcttctcgaaaatgccaagtggaagactttgtggcatgctccagatttaaatccagctgaggctccctttgttttcagttccatgtaacaatctggaaggaaacttcacggacaggaagactgctggagaagagaagcgtgttagcccatttgaggtctggggaatcatgtaaagggtacccagacctcacttttagttatttacatcaatgagttctttcagggaaccaaacccagaattcggtgcaaaagccaaacatcttggtgggatttgataaatgccttgggacctggagtgctgggcttgtgcacaggaagagcaccagccgctgagtcaggatcctgtcagttccatgagctattcctctttggtttggctttttgatatgattaaaattattttttattcctttttctactgtgtcttaaacaccaattcctgatagtccaaggaaccacctttctcccttgatatatttaactccgtctttggcctgacaacagtcttctgcccatgtctgggaacacacgccaggaggaatgtctgataccctctgcatcaagcgtaagaaggtcccaaatcataaccattttaagaacagatgactcagaaacctccagaggaatctgtttgcttcctgattagatccagtcaatgttttaaaggtattgtcagagaaaaacagagggtctgtactagccatgcaaggagtcgctctagctggtacccgtaaaagttgtgggaattgtgacccccatcccaaggggatgccaaaatttctctcattcttttggtataaacttaacattagccagggaggttctggctaacgttaaatgctgctatacaactgctttgcaacagttgctggtatatttaaatcattaaatttcagcatttactaata

SEQ ID NO: 1613 - DNA, 2997 bp, Homo sapiens
ctcgccagcccagactcggccctggcagtggcggctggcgattcggaccgatccgacctgggcggaggtggcccgcgccccgcggcatgagccggtgaccaagctcggggccgagcgggaggcagccgtggccgaggagtgtgaggaagaggctgtctgtgtcattatgtgtgcgtcggtcaagtataatatccggggtcctgccctcatcccaagaatgaagaccaagcaccgaatctactatatcaccctcttctccattgtcctcctgggcctcattgccactggcatgtttcagttttggccccattctatcgagtcctcaaatgactggaatgtagagaagcgcagcatccgtgatgtgccggttgttaggctgccagccgacagtcccatcccagagcggggggatctcagttgcagaatgcacacgtgttttgatgtctatcgctgtggcttcaacccaaagaacaaaatcaaggtgtatatctatgctctgaaaaagtacgtggatgactttggcgtctctgtcagcaacaccatctcccgggagtataatgaactgctcatggccatctcagacagtgactactacactgatgacatcaaccgggcctgtctgtttgttccctccatcgatgtgcttaaccagaacacactgcgcatcaaggagacagcacaagcgatggcccagctctctaggtgggatcgaggtacgaatcacctgttgttcaacatgttgcctggaggtcccccagattataacacagccctggatgtccccagagacagggccctgttggctggtggcggcttttctacgtggacttaccggcaaggctacgatgtcagcattcctgtctatagtccactgtcagctgaggtggatcttccagagaaaggaccaggtccacggcaatacttcctcctgtcatctcaggtgggtctccatcctgagtacagagaggacctagaagccctccaggtcaaacatggagagtcagtgttagtactcgataaatgcaccaacctctcagagggtgtcctttctgtccgtaagcgctgccacaagcaccaggtcttcgattacccacaggtgctacaggaggctactttctgtgtggttcttcgtggagctcggctgggccaggcagtattgagcgatgtgttacaagctggctgtgtcccggttgtcattgcagactcctatattttgcctttctctgaagttcttgactggaagagagcatctgtggttgtaccagaagaaaagatgtcagatgtgtacagtattttgcagagcatcccccaaagacagattgaagaaatgcagagacagctcttcatggaaccagccaggagagagaactggtcagctgctaatcaccaaatgaactccctgatctggcctagggaacagtgggattcacagattatcaatgaccggatctatccatatgctgccatctcctatgaagaatggaatgaccctcctgctgtgaagtggggcagcgtgagcaatccactcttcctcccgctgatcccaccacagtctcaagggttcaccgccatagtcctcacctacgaccgagtagagagcctcttccgggtcatcactgaagtgtccaaggtgcccagtctatccaaactacttgtcgtctggaataatcagaataaaaaccctccagaagattctctctggcccaaaatccgggttccattaaaagttgtgaggactgctgaaaacaagttaagtaaccgtttcttcccttatgatgaaatcgagacagaagctgttctggccattgatgatgatatcattatgctgacctctgacgagctgcaatttggttatgaggtctggcgggaatttcctgaccggttggtgggttacccgggtcgtctgcatctctgggaccatgagatgaataagtggaagtatgagtctgagtggacgaatgaagtgtccatggtgctcactggggcagctttttatcacaagtattttaattacctgtatacctacaaaatgcctggggatatcaagaactgggtagatgctcatatgaactgtgaagatattgccatgaacttcctggtggccaacgtcacgggaaaagcagttatcaaggtaaccccacgaaagaaattcaagtgtcctgagtgcacagccatagatgggctttcactagaccaaacacacatggtggagaggtcagagtgcatcaacaagtttgcttcagtcttcgggaccatgcctctcaaggtggtggaacaccgagctgaccctgtcctgtacaaagatgactttcctgagaagctgaagagcttccccaacattggcagcttatgaaacgtgtcattggtggaggtctgaatgtgaggctgggacagagggagagaacaaggcctcccagcactctgatgtcagagtagtaggttaagggtggaaggttgacctacttggatcttggcatgcacccacctaacccactttctcaagaacaagaacctagaatgaatatccaagcacctcgagctatgcaacctctgttcttgtatttcttatgatctctgatgggttcttctcgaaaatgccaagtggaagactttgtggcatgctccagatttaaatccagctgaggctccctttgttttcagttccatgtaacaatctggaaggaaacttcacggacaggaagactgctggagaagagaagcgtgttagcccatttgaggtctggggaatcatgtaaagggtacccagacctcacttttagttatttacatcaatgagttctttcagggaaccaaacccagaattcggtgcaaaagccaaacatcttggtgggatttgataaatgccttgggacctggagtgctgggcttgtgcacaggaagagcaccagccgctgagtcaggatcctgtcagttccatgagctattcctctttggtttggctttttgatatgattaaaattattttttattcctttt

SEQ ID NO: 1614 - DNA, 3454 bp, Homo sapiens
tcccttcctgctgccaccttcccgccagccacagggatctgattcctcccagggggatgtcctgcgcctcagggtccggtggtggcctgcggcatcccttgcggtgccagaagccgtgggacgaggagtgtgaggaagaggctgtctgtgtcattatgtgtgcgtcggtcaagtataatatccggggtcctgccctcatcccaagaatgaagaccaagcaccgaatctactatatcaccctcttctccattgtcctcctgggcctcattgccactggcatgtttcagttttggccccattctatcgagtcctcaaatgactggaatgtagagaagcgcagcatccgtgatgtgccggttgttaggctgccagccgacagtcccatcccagagcggggggatctcagttgcagaatgcacacgtgttttgatgtctatcgctgtggcttcaacccaaagaacaaaatcaaggtgtatatctatgctctgaaaaagtacgtggatgactttggcgtctctgtcagcaacaccatctcccgggagtataatgaactgctcatggccatctcagacagtgactactacactgatgacatcaaccgggcctgtctgtttgttccctccatcgatgtgcttaaccagaacacactgcgcatcaaggagacagcacaagcgatggcccagctctctaggtgggatcgaggtacgaatcacctgttgttcaacatgttgcctggaggtcccccagattataacacagccctggatgtccccagagacagggccctgttggctggtggcggcttttctacgtggacttaccggcaaggctacgatgtcagcattcctgtctatagtccactgtcagctgaggtggatcttccagagaaaggaccaggtccacggcaatacttcctcctgtcatctcaggtgggtctccatcctgagtacagagaggacctagaagccctccaggtcaaacatggagagtcagtgttagtactcgataaatgcaccaacctctcagagggtgtcctttctgtccgtaagcgctgccacaagcaccaggtcttcgattacccacaggtgctacaggaggctactttctgtgtggttcttcgtggagctcggctgggccaggcagtattgagcgatgtgttacaagctggctgtgtcccggttgtcattgcagactcctatattttgcctttctctgaagttcttgactggaagagagcatctgtggttgtaccagaagaaaagatgtcagatgtgtacagtattttgcagagcatcccccaaagacagattgaagaaatgcagagacaggcccggtggttctgggaagcgtacttccagtcaattaaagccattgccctggccaccctgcagattatcaatgaccggatctatccatatgctgccatctcctatgaagaatggaatgaccctcctgctgtgaagtggggcagcgtgagcaatccactcttcctcccgctgatcccaccacagtctcaagggttcaccgccatagtcctcacctacgaccgagtagagagcctcttccgggtcatcactgaagtgtccaaggtgcccagtctatccaaactacttgtcgtctggaataatcagaataaaaaccctccagaagattctctctggcccaaaatccgggttccattaaaagttgtgaggactgctgaaaacaagttaagtaaccgtttcttcccttatgatgaaatcgagacagaagctgttctggccattgatgatgatatcattatgctgacctctgacgagctgcaatttggttatgaggtctggcgggaatttcctgaccggttggtgggttacccgggtcgtctgcatctctgggaccatgagatgaataagtggaagtatgagtctgagtggacgaatgaagtgtccatggtgctcactggggcagctttttatcacaagtattttaattacctgtatacctacaaaatgcctggggatatcaagaactgggtagatgctcatatgaactgtgaagatattgccatgaacttcctggtggccaacgtcacgggaaaagcagttatcaaggtaaccccacgaaagaaattcaagtgtcctgagtgcacagccatagatgggctttcactagaccaaacacacatggtggagaggtcagagtgcatcaacaagtttgcttcagtcttcgggaccatgcctctcaaggtggtggaacaccgagctgaccctgtcctgtacaaagatgactttcctgagaagctgaagagcttccccaacattggcagcttatgaaacgtgtcattggtggaggtctgaatgtgaggctgggacagagggagagaacaaggcctcccagcactctgatgtcagagtagtaggttaagggtggaaggttgacctacttggatcttggcatgcacccacctaacccactttctcaagaacaagaacctagaatgaatatccaagcacctcgagctatgcaacctctgttcttgtatttcttatgatctctgatgggttcttctcgaaaatgccaagtggaagactttgtggcatgctccagatttaaatccagctgaggctccctttgttttcagttccatgtaacaatctggaaggaaacttcacggacaggaagactgctggagaagagaagcgtgttagcccatttgaggtctggggaatcatgtaaagggtacccagacctcacttttagttatttacatcaatgagttctttcagggaaccaaacccagaattcggtgcaaaagccaaacatcttggtgggatttgataaatgccttgggacctggagtgctgggcttgtgcacaggaagagcaccagccgctgagtcaggatcctgtcagttccatgagctattcctctttggtttggctttttgatatgattaaaattattttttattcctttttctactgtgtcttaaacaccaattcctgatagtccaaggaaccacctttctcccttgatatatttaactccgtctttggcctgacaacagtcttctgcccatgtctgggaacacacgccaggaggaatgtctgataccctctgcatcaagcgtaagaaggtcccaaatcataaccattttaagaacagatgactcagaaacctccagaggaatctgtttgcttcctgattagatccagtcaatgttttaaaggtattgtcagagaaaaacagagggtctgtactagccatgcaaggagtcgctctagctggtacccgtaaaagttgtgggaattgtgacccccatcccaaggggatgccaaaatttctctcattcttttggtataaacttaacattagccagggaggttctggctaacgttaaatgctgctatacaactgctttgcaacagttgctggtatatttaaatcattaaatttcagcatttactaatactgc

SEQ ID NO: 1615 - DNA, 580 bp, Homo sapiens
gacggcccggatcccggttaccggcccctcgctcgctgctcgccagcccagactcggccctggcagtggcggctggcgattcggaccgatccgacctgggcggaggtggcccgcgccccgcggcatgagccggtgaccaagctcggggccgagcgggaggcagccgtggccgagagctactcagagttgctgtttctccttgagatgcttttggagtgtgaggaagaggctgtctgtgtcattatgtgtgcgtcggtcaagtataatatccggggtcctgccctcatcccaagaatgaagaccaagcaccgaatctactatatcaccctcttctccattgtcctcctgggcctcattgccactggcatgtttcagttttggccccattctatcgagtcctcaaatgactggaatgtagagaagcgcagcatccgtgatgtgccggttgttaggctgccagccgacagtcccatcccagagcggggggatctcagttgcagaatgcacacgtgttttgatgtctatcgctgtggcttcaacccaaagaacaaaatcaaggtgtatatctatgctctgaaaa

SEQ ID NO: 1616 - DNA, 580 bp, Homo sapiens
gtgtcagacggcccggatcccggttaccggcccctcgctcgctgctcgccagcccagactcggccctggcagtggcggctggcgattcggaccgatccgacctgggcggaggtggcccgcgccccgcggcatgagccggtgaccaagctcggggccgagcgggaggcagccgtggccgagtgtctttaatgttatagagctactcagagttgctgtttctccttgagatgcttttggtgttggggaaccactgattcaagtatacacatagaccttgagagcttcttgggaagttctaacatgggccagcggagggcagctccttgcctgcatttgtcccaaaacttcctgtcttcaaactccaggagggatatgcagaatggcaaggaagccataccatagggagtgtgaggaagaggctgtctgtgtcattatgtgtgcgtcggtcaagtataatatccggggtcctgccctcatcccaagaatgaagaccaagcaccgaatctactatatcaccctcttctccattgtcctcctgggcctcattgccactggcatgtttcagttttggccccattct
